United States Patent 11,549,145 (METHODS AND COMPOSITIONS FOR INHIBITING AND TREATING NEUROLOGICAL CONDITIONS) - sequence listing, part 79

SEQ ID NO: 1601 - DNA, 292459 bp, Homo sapiens
agaaacgcttttctgcggtccagtctagggggtctcagattggcggggatgggcagcagcggcaggtggccttggcttttgctgcagccgtcaacgacctatcatcggggtcctgcgtaaggtccggctggctgggacttggctgtgggtgggatggactggctgccggaccgagtgccctgcagttggtaggagtatgaggcagagtgatgcacacccgggcgcccagcatcgttctaattgccggagacattgcctcagactgtgcgctgctagaggctgcgttcctgagcaggaagcccgtttcctgggattggaactacccttcttggccagcgggaagtccccaaggacggagtcgaaaggtcaaatcttatctgtcagtgctgtgtgacagcatcgcaacgggatctgcagaacctgaactcggtatcaaatctattgggagggaggggaacgtgtccgggcaggcgctggggtcgggtggcaaaactggggtgaatttgtagaatttgggaaagggtcattgacatcttaaaataggtggtcgtttggagcaagaatgctcgaaaggggtgagggtaggttaggctctctagtgctgggggaaaacaaaatgtggaaggattggtggaaaccagacctttaagatttatattatgatttgagatttatatgattccatctaggccagatttaaaaaaatatttgacatccccatttctggaatgtaggagataaaggcactaagacgaaggaaatggtagttgtgctgtgtgtattacactgaagaacaaatatttgcaggataaaattaatttggacatttggctggacactgctcggtatgggtccagtttagttggacctcgagcagaagactggctgttgccctgttgtgtaccacaatctttggtttccagtgctgtgttgaaaagagcactaggcttagaatcagaaaactcaggcttaagtgttgactcttccactcataatgtttgaacgagacatgtcacttaaaattctgtctcagattcctcatcactgaaatggagctaataatgtgcactttacaagattgttcttaggattatatatcacgaaagtgtttccaagctctaaaattctacataaatgtaaaatgcatgttgcttgtaccattggttttgggactagtcttataaatttcttaatgatatatggtgttttatctccttcctagaagagatggaaagattctgaagggcagaaacagtttttcttttgtatcttccttccatatgacaaaaagctaagcatgcagaagggactcgatacatgcttgatgaatgaatgaaatgtgaaagaccgtacagtttgagaatcatactgagaataataaatcagaagagggagagagatctcaaaattaaatatttgttggatatatacatgtaaatacatatgtccagtcttctttaagttcaaaaaaatacatatataatgtgtgtatatttatctatgcagtatattatatataaatagagagtgggagagagacctcgagaatggaatacatccctttttcttgggaagaagcaatgtggtgtttttctgttcccaattaaaccactcttctataagtatatcatttaggtgatagaagtaacattgtttaaattaacattcaagttatgaacacacactggtaaaaattctcttaggaatgccttaagacagcaaaggaaaaatttttacctgttggcaatatttattttaaaaagccatataccaaagtataaaatcattactatggtgaatggcgttatataacttagaataaagattttacaattttttttcagtttcagtctttgctaactttagtagatgctaatcagtatactttagctgttaaaggtgattgtactttttcttcttttaaatcaagatttttctttgaagagaaaatcgaacattagaggcactattgacagcaaatggaaacagggattcaagagctaatatatctcttctcttacatttctattcttttgtattgccttatttaggaaattttttattttcttatttgagaactatgaaagaatcccagagtagaaatcagcttaagggaatagtgaaagaaatttaaataatcgattgctcaagggtataattattttgattgctcagaattttgctctatatgtttaatgtgttaaatgtaattaactgccagccaaataatgcttattgcatttaagatgtgaaaaatgtccttttctaatgcagtattttttattgtctcacaatgatctaagtgcctagtacataataggtactcaacgtgtttctagtcaatgatttaatgatctgacaagttaattttggacgaacattcagaaattgagtattttttagtgggcacataaattacttctctaccttattaggtagttaaatctttataaagctttaagagaaatttttgtgtgtatgtggagaaatctgtctttaattatcttttaattagaaaactcattatttcacttccttgcaaattctaaatttttaatgttaatcatgatacttaattcatcttaggtaatattattttccttattttaatttttcaaatgagtgcttaccctgatataaaagatttataaggttttaagacattttacttgttgtgcaaataacctggtttggttcaatactgaagcaggaccgaatctgaattttctcaaggttaatgctgtatatgtagttccttattttctgtgatgatgcaaacagccaaggatcttttcagttagaagggactttagtaaggctataataggtctttcttttcagacattttaaaccaaggattctaacatgtgcttctcttctccaaacttgccactaaatacttaaacaacaaagacattgaatcctggctgggcgtggtggctcatgcctgtaatcccagcactttgggaagccaagacgggcagatcacttgaggtgaggagttcaagaccagcctagccaacatggggaaaccctgtctctactaaaaatacaaaaaattagctgggggtggtggtgcacacctgtagtcccagttacttgggagggtgaggtgggagaattgcttgaacctaggaggcggagatggcagtgagctgagatcgtgccattgcactccagcctggttgacagagcaagacacttcatctcaaaaaaaaaaaaaaaagaaaaaagacgttgaatcctgcaacgtgacattatttatttttattatttgaaatagaagtgcaaaatcaatgttaatcaaatatgtaaaatgtattataaatataaataagtgaatttcagttctggtaaggatgctttaataccagggttctctggcaacataattactgaaatataaaaagatgtttagcatgttgtccatagactatcttatgatttaatactcctatgaatatctacatcaactggttctgtgttaaactttaaaacatgaaccttcagaatttcattttttctttgtttcaagtttttcctttacataattttatgattacacattaaagtggaatagatagggtgaactctctactgaaacttatcaactaaaaacctgtaagccaaaaaaaaaaaaatcagggaaaaaaatctctaaatacgttgaatttatttgggaattagaaaagaggattataacctgagatgcacagctgtggcaagctacatatacatcaaagaagggaggataaagggaaatgtttttctttttttctttttttttttgagacagagtctcactctgtcgccaggctagagtgcagtggcacaatctcagctcactgcaacctccgactccctggttcaagcattctcctgcgtcagcctccgaagtagctgggattacaggcgcacaccaccatgcccagctaatttttatatttttagtagagacggggtttcaccatgttggccaggatggtcttgatctcctgaccttgtctgcccgccttgggctcccgaagtgctgggattacaggtgtgagccactgtgcctggccaaagggaaacttttatttggcaaaaggagaagttcacataaactgcttggaaacagacattggttttggatactcaaagtcagagttggcaccattttagaggaagagatgctgttactgggcaggtattgttttgagagcattttatctgaattgctgcagtcctacagaatttcttattttagaaagtccttgagacaggacttccaaaaatgtcttttatctcgtccatgcaatcatgaaccctactcctttgtgctctcctggctctagtttgtgtttgacaaacagtgatttcatcctggtatctgcaactttcataaacctttatttatatattagtacttcaaagattaaaaaaaattgtaaatctcttgcctcaagaaaaagatttagtgccaaagaataagtcttatttttaaaatattgtgaatgagacttgtttcatttgatttttttaatggcttatgatgatataaaatgaaagctatggactttaaaacatatttatcctgtattctttcttagcactggtgtcttttattaatgctaacagtcgttttaaggttgcatctcttatcacactgtataatatttgaggtaatgataatttacatcttcttttctaatatttctgtcacctattttatcttgtgtttgctagaattgtgaaaagagtgttgaaaaattgagtgctgggctcttctgctttgttcctatttcaatttcgttggtatttcaccagttgacattatattgactttcgctttatgacttttagaaatgactgctaaaattatcaaatgccttttatggggatctaatgataaaaatcatatagtttctatctttgaatttatgagtgtagtgaatatatatatttttctacactgaaacattcccacatttctagaataaactctatttggttgtgaaatattaccattttaattacttgctggatttgattagtttatattttgtttatatggtttcagaattttttttaaataattgccacaagatctcactctgttgcctaggctggagggcagtggtatgatcttggcttactgcagcctcgacctcccaggctcaagccatcctcccacctcagcctaccaagtagctgagaccacaggagtacgccactacccctagctaatttttgtattttttgtagagatggggttttgctctattgcccaggctggtcttgaactcctgagcacaagcaatctgccagcctcggcctctcacagtgctaggattataggtgtgaggcactgtgtgctgcctttacaaactttgttttgtagatacagtgtctccctatgttgcccaggctggtcttcaactcctggcctcaagcgattctccctccttggtctcccacatgatgagattacaggcatgagccccccccaccatacctggccataatttcagtttttaagtaagattggtccatagttttatttatttgtgctatctttatccagttttgatattagtgttagtctaactttgtaaatgaatttagatttccacctttttttctatgctctgcaatagtttaaatgatgaaaaattatcatgctatttggtttttgaaagttagagtgtgctgcaaaaccacctgggcttgctgatacttttagaggtagatctttgattattcttttcttctatgattattgatttgtttgattgtctttctcttcttgaatcaattttagaatttatggtttttagaaaatcatgcatctcatctacattgccaatttattggcaagaagttgcacaaaatattttcttataattattttagtatcttccatgaccatggacgtttttcttttctcattaccactattaactctttaagcaaaacattgaaatcaactttttcttccccaacctgattatcacaaattctagtagcatatcttaacttcttaaagaaaataagaagtcaactatctaagactcataggtttgataaaatttgaaagatcctgcaatccttataatttcctactgtttgtccttatcctgttcatattttattagtaatagcaaccacttaatacgtttattgtgtgtcagacacttggtaaataaaccctttacttgcattatttaattcccagagtagctctatagcctagaaattagtgttcccattttatgaatgagtaaactaaagctcagagaggttatataatttggccaatgatattcaatcagcaagtggcagaatgatgtgggaaccgagtatgtcagattctggggtttgtgcatttaatcaccactctctactttcggtatctttttcattattccaaattataatacttacttttttctaaaaattagtatataaccaagtatcaaaggcctaaataaacccatataacagcttgaaatgcgctgtaaattatgaacctaaaaaaaccttgttattgtaatgattttttaaaggatatttgttttttagatatttctgtgaactttccttaccttatctctgtattttgagactagacatagagcctgatttctaatatttagtctaacagaaaagatgtcactttttttgtatttagagagaccagtaggtgtcaactagtaattcaatttttaaaaaagattatgataaaatagacataataaagtcactatcttaaccattttgaagtgtacaattaagtagtactaagcacattgttgtacaactattaccaacatccatctccagacctcttttcatcttacaaaattaactctgtacccattaaacaataactccctgttccctgctccccagcccctggcaaccaccattttctacttaccacatgtaagtggaatcatgtggtgtttgcctatttttgactggtttatttaacttggcataatgtcctcagggttcatccatgctgtggcaggtgaatggatttccttcctttttaaagccgaataatattccattgtatgtatataccacattgtgggtatccattcatctgtcaatggacatttggtttggttctaccttttggctattgtgaataatactgctataaacatgggtgtagaactatctctttgaggtcctgtttttttatttatttatttatttatttatttatttatttatttatttattttgagacggggtctcactctgttgccagactggagtgcagtggtgcaatctcggctcactgcaacctctgcttcctgggttcaagtgattctcctgcctcagcctcccaagtagctgggactacaggtgcatgccaccatgcctggctaactttttgtatttttagtagagaaggggtttcaccatgttagccaggatggtcttgatctcctgacctcgtgatccgcctacctcggcctcccaaagtgctgggattacaggcgtgagccaccgcgcccggcccgaggtcctgttttataaaaaaaattactttacttttttaaatagattcagggtcttgttatgttgcccaggctggtctttaactcctgggctaaaacgatactcccacctcagcctcccaaagtgctaggattacaggcatgaaccaccgtgcttggccaagatcttgattttatacccagaagtggaattgcctgatgatatattaattctctttaattttttgaggaacgatttgcacttaattttaactaaacaatgcaataaaacaatgttctattgccttgggtcccagatttagtacatccctgaaagtcagggacacctaagataagataatcttgggatttatgtttggcatgaggtcctgggcgacaggggagtgggggagggccaaagttctgggatctagaacctactaaagttttccaccctagcccaccctgcctacctggcttccatagtttagaggatgcccattggtactgtggtttgagcagaatgacagaaaagctacaggacaggtcctaaataaatatggattctttcagactttgtagtgaatctgcattgttattatttagagaagcattaaggcataatgattaagaacatggattctggagcttgacttcttgggtttaacgctcagctcagcctttttttactacttgggcagttacttaaattatctgtgccacaatttccttatatgtaaagtagttattataataatatctacctcataggattattgggaggattaaatgaattaatacatgtaagtgcttagaaaaatacttgacatatagctctcactcaatgttagtaataatgataatattattttttagaaacagggtcttgctatgttgcccaggctggagtgtagtggtgtgatcatggctcgctgcagcctctacttcctgggctgaagcagtcctcctgcctcagcctaccaaagtactgagattacaggcagtagccaccacgcctggccgaataatattattttaaattagcataggttatgatgtggctttccttttaaaatttattttattttatttttttaatttttaaatttatttatgtggctttccttaaaaaccaatacgaagagtaagattccattctgtgagttaaactttttggattgcttatactatgaataaaaaagatgtaacggcagtttaaagaaataggatttgctgtccgatcagcaggattagattatagcttgatgaattctaatctatttagtattatataaattggattgtagcttgatgaaacatagaaaacggatttctagtcacatagaaaatcgatgctatgacaggagctggtcatagaggtttgtgttgtctcttgttgcctagaccctcccaaacattgtccaggaatgagatgcctttgtgcataccccatccaccacttcattctaagcagatgtcagtcaccactactaaagcagaatctgatagcactaaacatttgagtcacataatggactcctctaatccataaggcaaccttatgataatttggcttgctatgtagcttatctacatggagaggctatgtaacctggatgacttgaatatatgcttgcatatccagttataagtcttactagaaatcagtacattagttttttgtctttacatgtcaatctcaagaggtttgttaatccaaacctgcttctgatgagtaaatccattctccctgtacttactaagtaggtagttgagcatataaagctaagacccccaaaccctggaccttggtagattcaccaagataatgtgtccgtctcttcagtctcattgttttcttgggatatatcccagtgccttttccagatcatcatattactagctaccttaatttacttctattttctttatttccattagttctatatgtgtggtggcagagatattcttccatatcaccattgccagttggctgaagaggggtggagcaacccaatttctctctctcaatccccggccagcctgatatgaccaagaatcactgcgtagtgagcaaggaaagctaatcactgcactgcaggatctcactttgtggaactattgctttgctatatgccttcttatagcagacggagctgaaaggaaccttaaagatgaactagcccacatttcttgttttacagatgaggaaacagattacttgccttggacagtatatctttatgctcttctaacagtcttttgtctaaggttggcctggacttacgacctgtgagtaatcttctttgtagccctagtcttatcgaaccagtacaaaagtttaactgccaaaggcactttctttcctatagttctgacaacttctccttttgttatataccactgatatccaggttcagttcatcatctatttcagaccatgtttctaattggattctctgtagcctggttcatgttgtagtctgccattttctggcaacaaattggatctattttaataatgatcagagatgctggatttgtcatgttgggatctttttaactcagtatcccaaattgtggacataggatttcatgaaataaaaataaacctcaacagtacttctttaaataatactcactatatacccagaataaaactatattccagtaattccattaaaatttgtatgctaacaataaaactttgttttaaaatttttattcatgtttattttaaccacaatactaattgctattcctaaaatatgtttttctttctcctcctcccttatggagtattaaatgttttaatgtcatggcaaactcttttattagcttaggattactttatatatatatataaagaaaaaaattaatagcaagttacgagaaaatgtacatttttcttgtaatgtatctttacatatttcaaagaggcaagtggcagcaaatgtgaaataagcataagcaaagtgctttcatttaagtgcttagaggattaatcaaggagcacttcctagaagtgtgttttgaagattttaagagaaggtacaaatattcactggtgacgaggatggagtcagaaagagggaagtaaaacacacattatgcattgggagctgcattagaaaggggaatggatgctaacaaaaagaaaaaacatctcttgcaggatggtgaagcaggctttcagctgggatggagaagggatgctgagttacaatcattggtgaagttattgagatgtcatttcagccttgctactcacattttgctgggtaatgtgctagatcctaagggaaaagctaaagagaagggagagacagtgcttgacctgtaggtacttatgatcttgctgatgagacaaggcaacaggaagttaaaggaggatccttgaaagccagtaagaggaacttggattttatacagtatgtgatgacaggagccattggaggttctcatgtatcatcttacctctatcatctgctcagaagggagaggtctgagctggggaagatcaaactgagcaggtggctaggttttaatctttatagctatatgtaatcagcagaagagctttttcccacacaaaactattttgaatcactttagaaaaaaatgagctgcctaaaatcttctgtccatgattaacaattaatagaaaatcactggtttgctcctgcaaacagcacttaatgtcagtagcttcaggctgtttttcaattttacagtaaattttttaccgaaacaaatttaggtagctattttgtccatgggcttttgtagtggaaagatgatgtgagtaaaatagaataatgagattccttttctgcatcaaaatattagcaagctgctaatggttccattttgatactgccactttcaaaataaaggagagagatcaagttgcttatggaaacattttggattatgtttaaaatagtgtaactttataatagttgatatggtaaataattcaaggtttgcttttagtgcatcagtttatctccatcttggctcagccctgagagagaaagtttccagatttttattgcctatctaataagtcccttggtaattggtttcatgctgtaggaatgtagattttatttcttccctttcttcttcttcttttcatctgcctccttgctacttgcaaactgttctgtgatttccactatctccactgaccttccagtgggaagccttccaaggtccttggtttcctggaatgacatttgaggcatatttaagtgccttacgatattcctgggtttatttgggttttggcccatatgcattggtggtaagtccctgagaggcactagcacaaaaacaacaggagccctgaggtctggaggtaggttgggttggagttgtccactcggcatttgaaaaaactgtccaggaaaggcattgtttaaggggtagctctctaaagcctcctgagcttttgtgtttggattcctttttgtctggagaagaacatcagtgaagtaaggttttacgcctgttatggcattgatttcatatgcgttgtgcctgtcagccagtgctctcccagttaaaatgggctgaaaaacatgtgatcctgagacaccacttataaagctgtggagaacagaatgccagatcccaccacttattggactcaaaacaacccgcggccataagctggccaggctccggagagcttcgcggttccatgctgaggcaggaaagtccatctcagtatgatagagctgagaaaaataaatactaagagtgatgcctggatacgtaatcaggaaattatacattttgctgatgcagcagtggttagcttcattacaaggggagttgttggaatacagaatgatatgcctgatgctgtcattattgtatatggctgagtcaagataaccattcatttcaaagagcattgattctggatggatataattcccagtgcaactgctagcatggcccttttgcaccaggctaccagaagaagtttttagttcataaaatgtgaggtgttttgtttgaggaaatgttgtcccataagggaatccaaaaatctgacaaaattctgtgagggaaactcttgcttcttcacctgttcgaatatggtaaggacaattagagcaatcgagagagaagcttagccagtaatatggttttactattgttccatgatttgctaggtactcctcatatatgggctccattgctagatttactgtcttctagctgcaaacctaaacaaggaagagaaattacatataaaaccagcgcaggaaaaactgaagacagtgcattaatttattaaaccatactttctttaaaggaagtagcacaataaagatagtgatatatgcatagatttaaaagctcaggattcattattctttattgagactcctagagcatggggaggaaacagaagagaaaggcgttcttcaactttacctgtttcatagattccaagtcagtaaagcaaatgagttaacaatgcaagttctagaaacagactgtctggttttaaatttgggcttggccaattatcagcttggtggcctttgacaagttatttaacatttgggagccacagattccttgtctgtaaaatgaagatattaatagtacttacctgataagattgtcttgagcattgaataacagaatgaatataaaatgcttcactaatgtgcttgtcacatagtaaggactcagtaaatattaactcttagtagtaaaagtacaaatcctagggttatctagattattcctaattataaaagtacaaaaaagtgttttgcattttgttcatgatctttcttctcagaatatgttaacatctaatgtattgtgcagaactattcagtgtgcttgcatttaacatcaactttcttaaaatcactggaaataatttggaggtttttgggttttttttgagactaggatcatgggatctcttttgcttaatgatagagacttcttaggaaagtgccacttgagtattctttggattgtggacactcattcattgacatgtaagagttttctttcccgtgagtgggtcttgttagaagacttttgaaaaattactgttacagaaagcaaatatggttctttagaatatttcaaattagtagtttctgggatgttaaactcaaaaagctgagatctttaagtaatgattttttcctttaaaaaatattccttcagttatcgttgttcctataatgctctaggagctacctattttgtttgtttttgagacagtcttgctctgttgctcagattgcagtgcagtgagatgatcatggctcactgtggccccaaccttccgggctcaagtgatcctcctgcctcagcctcccaaatagctgagaccacaggtatgtaccaccatgcccagataatttttttattttttaggagggatacagtctccctatgttgcccacactgatctcgaactcctgggctcaagtgatcctcctaccttggcctcccaaagtgctgggattacaggtgtgaaccaccatgtccagccttccgtcactattaacatgtctattccctccagtctttttgctatatgtgtatgttacatataatataaacaaagtcatgttttataccctgctttttcacttaatattgtgccatgagcattttcccatgttattaaaaataatattcggccaggcgtggtggctcacgcctataatcccagcactttgggaggccagggtgggcggatcatgaggtcaggagatggagacaatcctggctaacatggtgaaaccccgtctctactaaaaatgtaaaaaattagccaggtgtggtggcatgcgcctgtagtcccagttactcgggaggctgaggcaggagaatagcgtgaacccaggaggcagagcttgcagtgagccaacatcccaccactgcactccagcctgggtgacagagcgagactctgtctcaaaacgaaaaacaaaaaacacaatattcatggctaattagttttttattatgtaactgtaacattcagtttcttgcctcttttaattattataacactttgataaatatttctgtgagaaattatctattgcatatattatataatatttattataaagaatcagatttttttttttttttagaatagattactagaaatcatagtattaggtcaaacattgtcaaatcgcttcctaggaaggtgtaccaatcttatcacattctcttacaatgttgtttatcccaatttgagaagggagcattggtatttttttgttgctataatgtgtgcctttattatttctagtgaagttgaacactttttgacatgcttattggtctgtggtatttattcttctgtgaaatatatttgattttttacctattttttgcgtgaagttttccttattggtttgcaagacatttttatgcatcaagaatattaaatctgccacatttgctgctaatattttacctggtttatacagccttttaattatgccaatgttattttaattgcaccaaattttacatttttatgtggtccagtctctactcctgtgattttttttcttattgtatttagaaatgccttcctcatcaaagcataattaagtattccccatattttcttctagtatttatggtttcattttttacatttaactttgtcagataacaaaactgataaggcagaaaatttaaatgaggtaaactgaccattgcaacagaatatatttttcacttttcaaaatctcacttatcatatcacaagtatgaatacttgtgctaataaataaattatggcctctcatatggaagtgctatgttcaccttctgtcttcctcagcccacatcagctcattcattgctgtatttgatacagcttgatctctagcctgaaacctgcagagttcctatgctaatcctatcctgggcagaaaatatgttaaaagcctcaatccagctgtaggtggaatgtagctttattcatgtcaccattatcttagtggctaatatcctgcagtaactctggcaccacatacccaccagattctagatttctcctagcctctgctgtgtcatcttaatccataggattggacattagctttgttttttccttagtactatattttcctgatgtaactgaattcctgccttgaggcttcctagaccttgtcatagctttccttctagagagctggatttaacccttggcagtggacgatctcttggaacctgacgccatttcctgcttactcccgagcattgtttcctctctggacctcctccttgcttagccttcatcaggctggatggatctctccatcagaacttgccaaaaccaagcccaaactttcatgctttttaatattgtgcccttgatgtggtcgacttatgggtggtacaccggacatccaggttactgctcagattacaatttcaactcacccatagacaatttacagattgatttggctaaatgttatggaaacagaaccaaaaggcacttttctgtctttattactatttcttaaggtgatgtgtatgtggagttaactatatataatggtcccataattacccttttgggaaacaaaagtctttgtgtgtttttagataaaggtagcaaaatggaaactccctattgcttttctaagcacgccttcctttgcacccccatcttctgtggctgttttagccagaaatgatacatcattactgtctttaaggagatggagaggactgtggctttaacacatagtggagggagctctgtagtctcattcttgctgacaacttttcagtgtcaaccaactatagtttcctattggtgaagttttcactttttcagagtctttctgggcttgttctttgatcaccctcatctgaagaggaagcaggaaagaactgttgccctctttgaactcttagagaattcatggtttattgtatcaatttgttatcgaccacagattatcttgttaacttttggtatctgtcattttattctccccaaccaggtggaaatgtaccctgtttaggcccaggacctaccttagcaaccttgattggctcacaagccaggttgcttaagacttgtttccccagcagctggtgtccctacttcctgcctagcccttttccttttgctttgtctgtgcttgggaaatacatgttatactctgtagagcagatttgctggcagtaagaacagagatgtgtagagcccagcgtgctggagggctctctgcatctggctgtgagtggcccctggactgggaccgtgggaggacagctttccatagtttaacataaatgaaccacaccataaggacaatctgctctcatttcactcaactaggatttagtgagtactgttaaagcacagtttgcactggagtaattggagaatggagtttgcccttcacaatctgtgcacaatctgttagcagctaaaaacaaatgttagcagttataattaccatcaatttgtctccaggcttggatcacattccaggtgttagaagagatggtccatttccttttttttctcctttaagtcccatgccctgtttcaagtagcttcagaaggcaattgtgctgtaaagattcaccttgtaatgggttcaggactctttcacagtttgtgtctattcgttcatttgaactttgctgttccaagttagaaagcccttgctgaggtgtggctacctctaagaacactgttgattgggtgccatggtaacgtttgcaaagtagctactgctaggatacagctctgacacttattactttatttgcatatcaagccacctgttccaaagatgaaaatatacaggactgcatatcccagtctgggtaaaaggataatagctgactgttgaagagaacatgttgcagtttttctcctgctagctgaagaatcaagttctgagggcctgctcctcagcacctttctcctggtctagagtaggtgccaggcctggcggttctgttgcctgcgtgggtgccagggcttctccttgggaggcttgccctctgtgagagggagcagagagttgacttcctccaagaggcccatagtccctgaagggggtgtttttgattctgtctaaacctaggctatgtgttagcggtttccctcctcttagaaattgcctggaagactcttgctattggtatgtatgtggttccctccagtttaagacaagatttgttccaggatcggttgtagccccttctctgtggctaacggaagagccacttgtccttctccattcttttccttagtctcccttgacccccacatcatctcctagacacaaggcacattgatagtcacaattcactgtcaatcactctggattattccctcattcccctttcccaggccacctgaaggagtgagtggggattgctattgtgtacattccagtaataactattggctgtaagcagacatactctaaaaataactcagggatactgagcacccagagggcaccttctgtcttctcgaagcttcgccacgcctgtttccactgtcagacttccagtctgcaccacagcacacatcctttctcatccagagtgctcctactagacgagatgtttttgtctcctaagggcctcaggtgtattcatgaactcctcagctggttattttcagtttcatcttccttggtgcttgctctggcacatggtcactgctgcatcctgtcccttccccacagtttgccatgggtcatcccttttttctcattgcttgcatcttctaactgaatgaacttgtaaatatggaactgaaagtcaatcctcatagctcatcttttatttaatcctaataaatgacaatctattgcaaacattactttaaaaatattacttatcaaaagctgggtgaaaggataatagctgactgttgaagagaacatgttggggtttttctcccgctagctgaagaatcaagttctgagggcctgctcagttctgtaagaaagtattagctgtctgacaggttccagtgaggggaggaaaagacaaaaaatatagtccccaaatctgcaccagcatcccatgtgcactgtgcaccttccatggtggattagatgctcagcaaatgatatacctatggaaggttaagcctaaagaaacaggaaaaatgagcctttgtccactagcacatttatcaattgcattttagggtgattttagggataggcaaccccaattagtcattattctttaaaggtagttgtctgttagatgtaggaagactccaaggaatgttaagttggcaacattccatttaggttgcacagaatgacttttaagactaaacttcatcaggaggaaatgaaaggcctttaccatggttcctgttcacagtgaaattgacatgtattggaaaggagatgcttggaagaaatgtctagcttccccaacagactcctttcttctcttttctgtcttcctttgttaatctgccatgtttcatcttcattcagatgagttatgatgtatattatttatgtagagatattatgagattataatgaagaagatttacaaagactaaactatcctgcaatgatctaaatttttaagagacatttactcagtttggcactccaaaaattattaatctatgttctgacaacccagtttggggtatatccaagatggcttgtgtgttgctagttactgcttataaggcaactttctctttgggtggcaggaagtaaaatatttataagttattgctaaaatgttaaagttttatttgaacctactgtacccaagtaattatataattcatcactttagtagcagtttggttgacactgaacaacaatgctcaaattcatgtagcagtaacaaactacgtgataaaaggaactgaatttagaaagcaagcttcaagtaaagatcagaagattaagtagatttcatggagctcactaaggagttagatgggaaagatgagataagaaaagcactggagttgagaccaaaaggagacgaaaaagcagagggtggatcttcgagctcggggggttataaacaagatggccacaaggtggcagcacagtcttaacagcagagagctttctgtagggccacccttaatttgctaacaccacagactttctcttagaattcctccatgttgattttcctcattatcctaggggaaacagcagcaaatgtttagaattaaaaatgactcctaaaacttaagctgaggaaaagtatagggtaaaggcagcatctttacttccagagactgtttagatgctctaaagaaggcttccaactctctgtgggaaaggaccaattgacatttccaaaccatatgttaaacagtgatgggaggccattgttttgggctaagcttgtacactaggccccagccgaccagaccaaaccaaaatggagtcactcatgctaaatgtgacataaactaaaattttaaggaaacagatagatcccaaagcagaccaagttttttttcttttcttttcttttttttttctcatgaaaacaggagattccggcacaaggaagtccccttggctctctaactcttacaaaaaagtaacctgaaatccatgttcccaccttaaaaaccaactgttctgctctttccccgtgggatctgagaccaaataagtacatttatgatggtaacagagtgacctcaatgcctaaagttttggtcagtgtcaaaattgagaggttgaccaaaaggtggggaattgttaaattaagtttagcctaaagctgcctccttacatattttaagttcagcctaaaggtttcttcgtactcagcgaattgtaacctaactggaatgtaaatagactgtaacctactcttgtaccaatcaccaagttttggccaaaggcagccaactgttcaaactgtgttcaaatcagggaaatgccaagctgtaacaaatccagctgtttctgtacctcacttccattttccttatgttgctttccttttttgtccacaaatcctctgtgaccatgcagcagcactggagatgctttgaacctattctggtttggggagctgcccaatttgccagtcgttccttgctcagttaaactctgttaaatttaatttgtctaatgttttaacacatcatacactaatacttttgtaaaagttaataaaaatgatattatacaaagaagaacaaaaaagacatacagaacataaacctattttttggtaattagttaaactaattgtgaaaatagcacatcaaactttctttttaaggtttttgaaaaccagaaaatctaattattatgctctagccaaactacccaatgtttgctttacattctttccccacaaaatgaaattagtgaacttaggcagactcaactaagttcacaaaatcgactcaaaaaaaaaaaaaaaaagattgctttgcttattggggtcttttgtagttccatatgaattttagaattttttttatttctgtgaaaaatgtccttggaattttgataagggattctgttaaatctgtatagcactttaggtcatatggacattttaacaatattaattcttccagtccatgaatatgagacatcttgagacatctttccatttctttgtcttgttcagtttttctaatcaatgttttacagttttcagtgtataaatctttcttttttaaaaaattttattattatactttaagttttagggtacatgtgcacaacgtgcaggtttgttacatatgtatacatgtgccatgttggtgtgctgcacccattaacttgtcatttagcattaggtatatctcctaatgctatccctccccgctccctccaccccacaacagtccccagtgtgtgatgttccccttcctgtgtccatgtgttctcattgttcaattcccacctatgagtgagaacatgcagtgtttggttttttgtccttgcgatagtttgctgagaatgatggtttccagtttcatccatgtccctacaaaggacatgaactcatcattttttatggctgcatagtattccatggtgtatatgtgccacattttcttaatccagtctatcgttgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatcgttgaactagttcacagtcccaccaacagtgtaaaagtgtttcaatttctccacatcctctccagcacctgttgtttcctgactttttaatgattgccattctaactggtgtgagattagatctttcaactcattgcttacatttattcctaagtattttattctttttataaacgggaatttttcgggggtggagccgagatggccgaataggaacagctccagtctacagctcccagcgtgagcgacgcagaagatggctgatttctgcatttccatctgaggtactgggttcatctcactagggagtgccagacagtgggcgcaggacagtgggtgcagtgcaccatgcgccagccgaagcagggcgaggcattgcctcactcgggaagcgcaaggggtcagggagttccctttcctagtcaaagaaagggctgacagagggcacctggaaaatcaggtcactcccaccccaatacagcacttttccaacaggcttaaaaaacggcgcaccaggagattatgtcccgcacctggctcggagggtcctacgcccacggagtctcgctgattgctagcacagcagtctgagatcaaaccgcaaggtggcagcgaggctgggggaggggtgcccgccattgcccaggcttgcttaggtaaacaaagcagcctggaagctggaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacacagctggagatctgagaacgggcagactgcctcctcaagtgggtccctgacccctgacccccgagtagcctaactgggaggcaccccccagtaggggcagactgacacctcacagggccgggtactcctctgagacaaaacttccagaggaacaatcagcagcattcacggttcacgaaaatctgctgttctgcagccaccgctgctggtacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcgcctctcctcctccaaaggaatacagctcctcaccggcaatggaacaaagctggacggagaatgactttgacgaattgagagaagaaggcttcagacgatcaaactactccgagctacaggaggaaattcaaaccaaaggcaaagaagttgaaaactttgaaaaaaatttagactaatgtataactagaataaccaatacagagaagtgcttaaaggagctgatggagctgaaagccaaggctcgagaactatgggaagaatgcagaagcctcaggagccgatgtgatcaactgaaagaaagggtatcagtgatggaagatgagatgaatgaaatgaagcgagaagggaagtttagagaaaaaagaataaaaagaaacgaacaaagcctccaagaaatatgggactatgtgaaaagaccaaatctacgtctgattggtgtacctgaaagtgacggggagaatggaaccaagttggaaaacactctgcagggtattatccaggagaacttccccaatctagcaaggcaggccaacattcagattcaggaaatacagagaacaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagtggatctctcggcagaaactctagaagccggaagagagtgggggccaatattcaacattcttaaagaaaagaattttcaacccagaacttcatatccagccaaactaagcttcataagtgaaggagaaataaaatactttacagacaagcaaatgctgagagattttgtcaccaccaggcctgccctaaaagagctcctgaaggaagcactaaacatggaaaggaacacccggtactagccactgcaaaatcatgccaaattgtaaagaccatcgaggctaggaagaaactgcatcaactaacaagcaaaataaccagctaacatcataatgacaggatcaaattcacccataacaatattaattttaaatgtaaatggactaaatgctccaattaaaagacacagactggcaaattggataaagagtcaagacccatcagtgtgctgtattcaggaaacccatctcacgtgcagagacacacagaggctcaaaataaagggatggagaaagatctaccaagcaaatgcaaaacacaaaaaggcagaggttgcaatcctagtctctgataaaacagactttaaaccaacaaagatcaaaagagacaaagaaggccattacataatggtaaagggatcaatgcaacaagaagagctaactatcctaaatatatatacacccaatacaggaccacccagattcataaagcaagtcctgagagacctacaaagagacttagactcccacacaataataatgggagactttaacaccccactgtcagcattagacagatcaacgagacagaaagttaacaaggatacccaggaattgaactcagctctgcaccaagcagacctaatagacatctacagaactctccaccccaaatcaacagaatatacatttttttcagcaccacaccacacctattccaaaattgaccacatagttggaagtaagctctcctcagcaaatgtaaaagatcagaaattataacaaactgtctctcagaccacagtgcaatcaaactagaactcaggaataagaaactcactcaaaaccgctcaactacatggaaaccgaacaacctgctcttgaatgactactgggtacgtaacgaaatgaaggcagagataaagatgttctttgaaaccaacgagaacaaagacagaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaagacattcaaaagctagcagaaggcaagaaataactaaaatcagagcagagctgaaggaaatagagacacaaaaaacccttcaaaaaattaatgaatccaggagctggttttttgaaaggatcaacaaaattgatagaccgctagcaagactagtaaagaagaaaagagagaagaatcaaatagacgcaataaaaaatgataaaggggatatcaccaccaatcccacagaaatgcaaactaccatcagagaatactacaaacacctctatgcaaataaactagaaaatctagaagaagtggataaattcctcaacacatacaccttcccaagactaaaccaggaagaagttgactctctgaatagaccaataacaggctctgaaattgtggcaataatcaatagcttaccaacgaaaaagagtccaggaccagatggattcacagccgaattctaccagaggtacaaggaggaactggtaccattccttctgaaagtattccaatcaatagaaaagagggaatcctccctaactcattttatgaggccagcatcatcctgatatcaaagccgggcagaagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaattcaacaacctttcatgctaaaaactctcaataaattaggtattgatgggacatatttcaagataataagagctatctatgacaaacccacagccaatatcatacttaatgggcaaaaactcgaagcattccctttgaaaactggcacaagacagggatgccctctctcaccactcctattcaagatagtgttggaagttctggccagggcaattaggcaggagaaggaaataaagggtattcaattaggaaaagatgaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacaccaataacagacaaacagagagccaaatcttgagtgaactcccattcacaattgcttcaaagagaataaaatacctaggaatccaacttacaagggatgtgaaggacctcttcaaggagaactacaaaccactgctcactgaaataaaagaggatacaaacaaatggaagaacattccatgctcatgggtaggaagaatcaatatcataaaaatggccatactgcccaaggtaatttatagattcaatgccatccccatcaagctaccaatgaccttcttcacagaattggaaaaaactactttaaagttcatatggaaccaaaaaagagcccgcattgccaagtcaatcctaagccaaaagaacaaagctggaggcatcacgctacctgagttcaaactatactacaaggctacagtaaccaaaacagcatggtactggtaccaaaacagagacatagatcaatggaacagaacagagccctcacaaataacgccgcatatctacaactatctgatctttgacaaatctgagaaaaataagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagtttttgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtggacgaaggatatgagcatacacttcttaaaagaagacatttatgcagccaaaaaacacatgaaaaaatgctcaccatcactggccatcagagaaatgcaaatcaaaatcacaatgagataccatctcacaccagttagaatggcaatcattaaaaagtcaggaaacaacaggtgctggagaggatgtggagaaattggaacacttttacactgttggtgggactgtaaactagttcaacccttgtggaagtcagtgtggcgattcctcagggatctagaactagaaataccatttgacccagccatcccattactgggtatatacccaaaggactataaatcatgctgctataaagacacgtgcacacgtatgtttattgcagcactattcacaatagcaaagacttggagccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaaccattgcaagaacaaaaaaccaagcaccgcatgttctcactcataggtgggaattgaacaatgagaacacatggacacaggaaggggaacatcacactctgaggactgttgtggggtggggggaggggggagggatagctttaggagatatacctaatgctaaatgacaagttaatcggtgcagcacaccagcatgacacatgtatacatatgtaactaacctgcccattgtgcacatgtaccctaaaacttaaagtataataataataaaataaaataaaaataaatgggaatttttcttgatttccttttcagatagattatgattggtgtaaagagatgcaactgtgttttgtgtgttgatttttgtatcctgcaacttaattcattttgtgttctttacggttttcttcatataggatcatgtcatttactgagtacgtgctctgtggcaacaattttacatgcatcatatctgtactagtttagaattattataatttttatttgacaaataaaggaacttgggctcagagttgtttgctcaagattatacagctagtaactggcagagctgagatttaaacccagagcactctaactctaactccagagggcatacttttttttttttttaatgccataatcctgctatcgcatcctactttttgagcaaaataaaataatttcaaatttatgaactagtcttaagataaatgggaaaattgtatttcaaaagtgagacagtgataaagctaaggacaagaaaaaaatgttaactttgtatcctgtaaccttgctgtaattgcttattatagttccaggagtttttcggtcaattctttttggattgtctacatagatgatcatgtcatctgcaaacaaagacagttttatttcctcctttccaacctgtatacttttttttcccaatcttattgtgttagctaggatttccagtacaatgttgaaaagcagtggtaggaggggacatccttgccttgttcctgatcttagtgggaaagctttattgttttttaccattaagtatgatgttagttgtagattttttaaaaatcaaggtgagaaatttcctgtctattcctagtttgcagagagtttttgtatttaaaatcattaatgggtgttagattttgtcaaatgccttttccacattcattgatatgtggaaaaatcatatgatttttcttctttagcctgttaatgtgatggattacattaactgattttcaaatgttgaatcagctttacatagctgggacaaatcccacttggttgtgatgtgtaattctttttatatattcttgaattcaatttgctaatactttcgttgagaattttcacatctatgttcatgagagatattggtctgtagttttcttgtaatgtctttgtctggttttggtattagagtaatgctggtctcataaaatgagttagtaagtctttcacttgcttctatcttctgaaagacattatagataattgtgtaatattttccttaaatttttggtagaattcagtgaacctatctgtgcctggtgctatatgttttggaatgttgttaattgttgattgaatttctttgatagatataggcccattaagactgcctatttatcttatgtaagctttggaagattgtgtctttcaaggagttcgtccattttatctaggttgtcaaataggtgagcatagattgttcatcatgctccttgattatccttttaatgtctgtgagatccgtagtgatgatgtcccctctttcatttctgatattagtaattcgtgtccttctgttttttcttagttaacctggcttgaggcttattgattttattgatctaaagaaaacctatcagctttcggtttaatgattttctccattgtttttctatttttaattttattgatttctgcactggtttttattatttcatttttttctgcttactttgaatttaatttgctgtgctttttctagtttcctagagtgaaagcctagatgattgactgaaggtcttctttttttctttttttttttttttttgagatggagtttcgctctttttgcccaggctggagtgcaatggcgtgatctcggctcactgcaacctctgcctcctgggttcaagtgattctcctgcctcagcctccagagtagctgggattacaggcatgcaccaccacactcggctaattttgtatttttagtagagacagggtttctccatgttggtcaggctggtctcgaactcccgacctccggtgatccacccgcctcggcctccgaaagtgctgggattacaggcgtgagccaccgcgcctgggcctaggtctttctttttttctaatgtatgcattttatatatatttccatctaattattgcttttgctgcatcccccaaattttgaaacattgtattttcattgagttcaaaatagttttaaatttctcttgcaagttattctttgacctatgtattatttagaacttcgttgtttaatttccaagtattttggaattttccagctatctttcttttttcttttttaaaaaattgagatgaggtttcaccatgtttcccaggctggtctcggactcctgaacgcaggccatccacctgatttcagccttacaaagtgctgggattacaggtgtgagccaccacgcctggcaggaattttccagctatctttctgtttctgatttctagttgtaactccactgtggtctgaaagcagacactgtatgatttctattcatttacatctgtgaaggtatgttttagggtccagaatatggccaatttggtaagtgtttcctgttagcttgagaagaatgtatggtgttgaatgaagtaatttataaatgtcaattatatccagttgattgatggtgctattgagttcagctatttccttactgattttctgcaggctgtatctgcccattctgattgaggagtgttaatgttttcaattttaatactggattaatcttttgccttgaagttctatctgtttttgcttcacatattttgatactctgttgttaggcacacacacattaagcattggtatgttttcttggagtattgatcccttaaccatttggtaatgcttctctttattcttgacaactgtctttgctctgaaattaatgtagctactcttctttctttcgattattattagcatggtatatctttctttatctctttcaatctgtatgtgcctttatatttaaagtgggtttcttttaaacaacatatagccaggttttgtttttttagatcattctggcaatctgtcttttcattgatgtatttagatcattgatttattttttatttatttatttttttgagacggagttttgctcttgttgcctaggctggagtgcaatggcgcgatctcggctcaccgcaacctctgcctcctaggttcaagcgattctctagcctcagcctcctgagtagctgggattacaggcatgtgccaccatgcctggctaattttttgtatttttagtagagacggggtttcttcatggtggtcaggcgtgtctctaactcccaacctcaggtgatctgccctccttggcctcccaaagtgctgggattacaggtgtgagccattgcgcccagccagatcattgatgtttaaagaaattattggtatttggattaatatctaccttatttaatactgttttttatttgttgctcttattctttgtttctatttttgccttccacactttttcaaccttttatattttttattgagcaatctgtatgattgtatttttctgtcctttcttagcacatcagttctacttctttttaaacatttttcagtgattgtcttagagtttgtaatattcatttataactaatctaagtacactttcaaataacactatacggcttcaggtagtacaagtactatataataacaaaatatttctactctctcatcttttgtatcattgctgtgatttattttacttacatgcttatatatatgtgtgtgtgtgtgtgtgtgtgtctgtgtgtaattaaatgcattgttgctaatatccttttaaacagtcatctgttagatcaattacgaataaaaaaataaaagtttttattttaccctttacgtattcattctcaaatgctcttcctttctttatataaatccaagtttctgagctatatcattttcattctctttgaagaacttttaaaaatattacttgcaggtcaggcttactgacaacaaattctctcaatttttgcctgtctgaggaagtatttctctttcacttctgaacgttaatttcacagggtgtggaattctaggttgatgagtttttttctatcaacactttaaattttttcttccactctcttcttgcttgcattgtttttgagaaatcatgtgtaatttttatctttacttctgtgttcataaggtgtttaatgatttatttttaatttaatttaatttaattttttaagagatagtgtctccctatattgcccaggcttgtctggaactcctggcctcaagcaattctaccacctcagcctcccaaagtgttcagattacaggcatgagccatgagccaccacacctggctgcgattttttctttatgtttaattttttgaaatttgaatatctatgcctaagcatagttttttttgttttctttttgttttgcatttatcttgcttggtgttctctgagcttcctagatctgtggattggtgtctaacattaatttgggggaaattttcactcattattgcttcaaatattgcttctgctcttttctctttttcctctcctgggatttccattacatatgtttacaccctttgtagttgtcccccagcttttggatattctgttatgagtttttattttcagtctgttttctttttgcttttggtattggactttcttttctttttttttttttttgagatggagtctcactctgtcgccaggctggagtgcagtggcagtggtgcaatcttggctcactgcaacctccgcctcccgggttcaagtgattctcctgcctcagtctcccaagtagctgggattacaggcatgtgccaccatgcccggctaattttttgtatttttagtagagatggggtttcaccatgttggccaggatggtctcaatctcatgacctcgtgatccacctgccttggcctcccaaagtgctgggattacatggacatttttattgttatgtccccaagcttggagattctttcttcatcatgtccagtctactaatgggttcatcaaaggcattctttgtttctcttacactatatttttttgtaatctctgtgatttcttttttgcttttagaattttcatgtttctgtttacattatatacctgttcttgcatgctatctactttttccattaaagtccttagcatagtccatagtccatagaagcattaaatttctggtctggtaattctagcgtttctaccatatgcgattctgtccagatatgcttgttcagtctcttcagatctttaaactgtgttttttgtcttttagtttgccttataatttttggttaaaaggtacacatgatgtactgggtaaaaagaactgcagtaaataggcctttagtaatgtagtggtaaggtgtaggaagaaggggaagtgtattagttcattttcatactgctatgaagaaatacctgagactgcgtaatttataaataaaaagaggtttaatgcactcacaattccacatggctggggaggcctcacaatcatggcagaaggtgaaggagaaacaaaggcacatcttacatggcagcaggcaagagagaagtggcgagaaaaagggggaaaaaccccttataaaatcatcagatctcatgagaactcactcactgtcatgagaacagcagcatgggggtaaccacccctatgattcaagtacctctcaccgggtccctcttatgacgtagggattatgggagctacaattcaaggtgagatttgggtggggacacagccaaaccatatcagggagcattctgtggtcttatgagtaggtctcagtcttttggtgagcttatgcccctgaattgtgaacttcatcactgtttctctgtccctatctctctccatctccccactcccactcccacactttacatgggaaggaatgacttagaaggggttggaattgggtatttcttttcttccatgtggaaagctagagggagctgggttggctatttccctttccccagcttgatcaggctctgatcaaaccccagtaggctctggtaaaatagtttcttctgaggccaggctttcttaagaacagaatgctctggcacatttcaaaattggttttattttgtgtccccctgctggaatcataagggaatttttctctgatatttgctgtcaggtagagctcctggatgtaaaacgcataaaagtgtggaagcccccatatgactgggtctctctggagttttaaacttacagttgtcttcactgagcctctagcaatccattaattacagttcaggttttcctatcctagcacttgttcctgtggaggtttttgcctgggagtttatgttctgataagttgtgattctcagtatctgcctgtctctctgatatttggggcagtggtttgtcctataactctacttttctgatggttctaagaagagttgttgatttttcagtctgttccagtttttacgtgatgttaggatggagtagcaacttccaagctccttacatgctgaaccagtttattcctttttaatgctgaataatattccatcgtatggatatactacaatttgtttattcatctgttggtggacatttgaattgtttctagtgttgggctatcgtattagtccattttcatacttctgtaagaactgcccaagactggtaatttataaaggaaagaggtttaattgactctcagttctgcatggctggggagacttcaggaaatttatgattatggcagaagaggaaggggaagcaaggtaccttcttcacaaggtggctggaaggagaagtgctgagtgaaggaggaagagccccttataaaaccatcagatcttgtgagaattcacccactatcatgagaacagcatgggcaaaactgcccccatgattcagttacctccacctggtctctcccttgacatgtagaaattatggggattacaattcaagatgagatttgggtggagacacaaagcctaaccatattatgaaaaaagccactctgaacattcatgtttaagtctttgtgtgaacatatgttccacttttcttgcatgtatacccaatagtggaattgctaagttttatgataaataaatttcaactttctaagaactgccaaactgttttccacagtgatttaccattgtacattcccactagcaatttatgagcattccagttgctccacatccttgccaacacttggtattgtcagtgaaaggaagcatttactatatcaatttagaaagactagtttcttctaagcttgccatttgacagaaagggaatgaagagtggatgggactctgtagtttcttcatttggatagctaatgccccataaatctccaaagataccacatttatcaagaaatttgatatttaaattatcaccattttcagcttctcttgtcccaatttcttccaaatggagctaaactcagttcaatctggttttccaattaggtagagtatatggaagctgagaggaagtattatggctgtagactcagtagggcatatggtgagctctgaaaatcctccaagtggttgctgttgagaaattcattgtcggtctagttgtttcattatagataatttttctttgtgacatttaagaaacattccttacctttgattttttttttcttttttttttttgagacagagccttgctctgtcacccaggctggagtgcagtggcgcgatcttggctcactgcaacctctgcctcccaggttcaagcgattctcctacctcagcctcctgagtagctgggattacaggcacccaccaccatgcctggctaatttttgtatttttagtagagatggggtttcgccatgttggccaggctggtttcaaactcctgaccttaggtgatctacctgcctcggcctcccaaagtgctgggattacaagcatgagccatggcgcccagcccttacctttgatattttaatttcactatgatgtgtttaggtatggatttatcctgcttaaaacccaaatttcatgattcttatttttcattaattcagaaaaatagtcattattttctgagtcttattttctcaacagagaaatgtttctctgttctcaacagataaaaatatttctctcttttcccatcttttggaacatagatttggtatatgttgaacattttcatttattctatgtgattcttcatttctcttttgcagtggctataaaaattatcattcatttttcaatgctgcattctagttaatttctccggatcagtcatctagttctccacttctttctacaggtctttaatctgctatttaacctacttaaggggttttaaaaatccagtgcttatgtttatcatttctacatgctttagggattttggtctttaattaatttaaatgttcttatagactataacaaacaattctattttctaaagttcttgggagtctaactctgctttttgttatttctacctactcttgcttacctggattgctttttgagtgtggtaaaattttatttagtaagtcatacttggtggggatcctgtgtggcttacattcatgggatgtctttctagagcaatgtttccattttcttcttcaacttttattttaaattctggggtacgtatgcaggatgtgcatgtttgttacataggtaaacatgtgccatggtagtttgctgcacagatcatcccatcacctaggtattaagcccagcatccattagctattcttcctggtgtagagcagtgttttttaattttcctgcatattagattaatctactgagcctttaaatatcaagatgccaggttgaagctcagaccagttaactcagatactgtgagtatgagactgaagcatcagtgtttttaaaacctcacagtcaagattgagaaccattgctctagagaaaatttgcctttgatttttacaggcactgtgagtgtgttttcagacctggaccagtttaatatcagtgtctcaactttgggttcctgaactatataggtagcataaatttgaaactcatgtttggggaacctttttctttctctcatcaaacatgtaggctgagatagacagattccttgtcatctctttgcacttagagagtagccctttaggggtcatgggggcaaggaagggctctgttctacttcatcaggttgagcaaacccaaggcttcattgttgattccgtatgtctgtgaaatcctgaacttcttgattaccaatattaacaaatgccctctgtgtgacttaaatgtcgatgccagtgcagcagttctatgtttatgtctttttctgattttggttctaaattcctcttacttccgtgagagctcagctgtacatttagaatctttgttatatttaacaattctcagtttttctgtgtacttacatcacactattgctagaaatagaagtcttgctatgatggcattctctacctttgtggccatgccctaccctttgggatcatcctcttttccagatgcctgcctaaaccaagtgtgaacttgctgtgtctttagacatggtgcattgggtttgcaagtgtctatctggcaggcccctggagcttgtatgtgttccttcaccctgcttggcttggtcttggctttgtcttaatccatctggtctctgttgccaaggtctaggcatgctttgaattccaacctacctgaattatgtcaacctctattctttttcttgtgtttccaagtctttgtcttcactcacttgctaaactcaggtctggtttcagtttatttcctggactcatctttccacaaaggactcgctttccctgatttgagggtttgtagcacagtttataacaccatgggagtgagtccagctcaggattcacatttctaggatgccaagatggtctgagcaaatagcttctaactttatatgtcattaaaaaaacacttgttactgagtatgtaaattccaaatactttctattatatattgataacatttgtacctatagtattaattgaagataaatgctgtatcactgattttgtcaggaagaaggataccctttacagttgaggatacacttttgttttttttaaatttgcttaattcatgtatagccatcttcctgtgtatcaaataaaaccagctgtgactggattgtggctcttgtagtccatgcaacctttttactctgagaccttggaaggaagctgagtttggtggaaagcatccagagaactcttggcagccttgatggatcatttaccccagtttggacttttctatctcttttaggaagctctgctgagatcattactgaaacatcagttttcctcagagaataacccctggtcttctgccagtggagttagcatttggttatgaagatggctttgagaattaaataagatacctggaggcaagagtgcattatgtaccggtagtgagcccacagaaatgataggttgcatgattgttggtggatagtggtctaatataatctttaatctttcatctatcaattgcatcctttaggatttgtgttaatgcccccctttcaatcattctgtctttatttagatttctcttcatattttctgtcttttctttcttggcagtatcttcaaaagtaattaggcggctgtcccagaagttgcctttgaagattgttgcaatgtgtatacctgtcaaaaggaattgaccaaaccctgctgaaagctattttacacatcaatttatgagccaatctcagctcttctgttctgagctgatcatccagaatgatccaaaaggaaaccatcagagccaatcatagtgcctggagtgattttcagatgcctttttttcttcttttacttacacagggcactcgggaatcttgcactctggatgaacccagtttacattttggttgggatggggaaagtagagctttagactttattttgaaggcaaaaacccttttatttacataggaaacatttcaattctatatggtttttttttttctctttgttttcttttcttctttccctctatccttccttccttccttccttccatcctcccaccctccctcccttctttccttcctacctaccaacctacatttttttttctctcttttggtatcttggaacatatctaaggcttttggaaaatggacattgttgaagaaaaagtgttatcactattacaaaaatatgatttagaataatggaacctcagatttggaaagaacccaaggattcctttatttcagccatttaactaatgcttaaattctttccaatctagtcacagcccatgatgggatacctacatcacctgcaagtgttgggaaacttctgtgtcctgcagtatcccttacaattttgaacagctctggctgttatttagttactgtttatgttgagctaaaatatactctcctgtaatgcctatcctctgctctttagtttcttttttggggaccataaagagcagtatttttaaaatttcaggctgaaattcagggttgtgaaataattttaattggttatgaccatcattaaaagagaagaaaaaggccagatgtggtggctcatgcctgtgatcccagtgctttgagaggctgaggcaggagggtcacttgagcccaggagtttgagaccagcctcggcaacgtaatgagcacaggtctctacagaataatttaaaaattagcttggcatggtgatgtgtatctgttgtcccaactactcaggaggctgaggtgggaggatggcttgagcccagaaggtcaaggttgcaataagctgtgattgcactgctgcactctggcctgggtgacagagactctgtctctaaaaacaaataataataaataaataaaaggagaagaagaacaaatagaacagaatgagagtagaacaaaatagaaaatatcagagtatatcacaagtagtaaagttttcatgaaacctttgtcttgattttatgtttatttaattatataattaactatgtatgtgcactgtatctcaatggtcaaaagagtttgaaagctgctgaatagaacatgtctcacttttcttccctatgccacccacatagttgagccattctcatgccccatcaagtcttttcttccctacacgaagcatttccatttctttccactcatccatatgtatcacagtctcacatttccttgccacactgaacacagttcaatgaatctagtttgtatgaaaaattgggacctggaatcaaaaacaatgtccctagctatgttctaactgaaacaggggcaagtagaactaccctgttcttggttagcagaatgcacttcactgcattttaatgcagcctgaagtgattagatcgatgaggatgtgtcacagagactccagagccagaggcccctgggctgtgtctcatagtgatgaaatacacagcccaggggcctctggctttggagtctctgtttagtcagtgtaagcctgcagataagctgaagagtaaccaagggcaagttacttctctatgcctcaatttcctcatctgtaatataagcatatttcaaatttgcagtattttataatatttttggattttttttgtgagtattaaatgagttaatacatgtaaaggacagaaaagggcatataataagcacttagcaatcccaaatatttttaaagcaatatcagcaaattattgattcattgaacatttcatcaactcagacatgtagagctttcagcatgtgtataaatagtgtgattatatgtcccattgtgcccagggtagccctagtttttacctattgtcctggcataattaatggtatcccctttcattctcaaaggctccaacagaacctcagatttgcttattccaaatcgtatttttgcagtaggaattaatattttcctcagttgtgtgccatcctagataaaagccacaacttctctcactaaatatttaatcaattttggatttacttggaagatgggatctctctctctttttttttctactgaagtttcacctgagcccgctgcccattgctatacctcctttccttgccaagtggcagaagttagcttcagactagaaactccaaaggggaggctgtcccccttgggcccaattacctgggtttaatttgcccatcattctgttctgtgaagaccttttggattctgattctgtcattcaggatatttactaatcctcaatttcatgttattttcaagtcctttttcctagggagctgacatcccttaaaggttgctttatgtcttaatccaagtaagctgaggttacccaatggggttttccagagagggtttatataaagccctgtggaagtgttaatggttgctatgtattgaacctttattatgtgcaaacaaactgcacagtatccctcaaattaggggtgttgtgaacattttacacatgtatattccctggtcaatgtcacatcaccatgagttaggtgttatctccattttaggggtgagggaagcaaggttgtcacgtaggtagtgaggcggagagctgggacttgaatccagtctgtgtggtgaggatacctggagaacagggcaccctcagaatgaaggtctgaacagaggttcttgataacatagcctttaaactggaaggctttttttctgatgtgataaaattatacttccatatgtaattcatcattctgttgaggtctcatagtccttatttaaaatatcaattatttccataaagatgaaactattaaagcagatgtggatgaggtggaactttgggggttggaggattaataatttgagggacactgtgcagttttttttcttgtaaaacatctataatgtctatttgcttttcctcatacgaatgaaagaatatgtgcacctgtgtgtaacctcctaggcaatgaaacagttggctttctgtggaatagattggtgcaccaaagaccaaagtgccttcctttgaattattttcccactttccatagatttatattcttccctatcatgataccataatcagtgagttttttattgatttatatcagacttacttccaaagagaacttgagtttatatcactttttgttgatgtatcagcaacgttaaaaatattacttctgtattactaacatagtctattactaaaaagtaggcactataatggaatatgtgaatgaattggtgaatggccaacacatattaactttaagaatgtttctctctcacttgtgttttgttgttggtgagttgagctactttgtctctttttttttgacaccaagattttttttttttccctgagacagggtcttcctctgtcgccaggctggagtgcagtggtgtgattatggctcacttaagtgcaagattcttctaagcaagatttctttttttaaaaaagttgtgatgtttgaaagaatgagtctatttcctaaggctttggcttttggagaggtctggttagcttctttgaagatccagtctcacactgactggttacctgcatgacagaaggggtagaaaacagcctttccaagggtgagacaaagacctcttaactgtcactgttagtccccttttacaagcccaaaatagttactgaagccgctagggctgggcatttgccatattaacacctccagcttttaagtggaaagactaggagacgtgagtaccaaagtggatggaagagcatttatatataggtcctaagcatatcagagggaggaaaggctaagcccatcatttgttcctggctcctcctgctgatgcctttgagatgtgagggtcaggttgcttcagcagagcctaaaacttagtctttcccttgtagaaccttttaaatttctacctaagttataattcacatccgaaagcacaccagtctttgatttaagtatttttatatttacatttattatttatttttattatactttaagttccgggatacatgtgcagaacatgcaggtttgttacataggtatacatgtgccgtggtggtttcctgcacctatcaacccgtcatctacattaggtatttctcctaatgctatccctccccttgccccccacccccgacaggcccccgtgtgtgatgttcccctccctgtgtccatgtgttctcattgttcaactgtcacttatgagtgagaacatgcggcgttcagttttctgttcctgtgttagtttgctgagaatgagaatgagaaaaaaagaatgctcatccttttttatggctgcatagtattccatggtatatatgtgccacattttctttatccagtgtatcactgatgggcatttaggttggttccaagtctttgctattgtgaacagtgctgcaataaacatatgtgtgcatgtgtctttacagtagaataatttataatcctttgagtgtatatccagtaatgggatttctgggtcaaatggtatttctggttctagagccttgaggaatcgccacactgtcttccacaatggttgaactaatttacactctcactaacagtgtaaaagtgttcctatttctccagatcctctccagcatgtgttgtttcctgactttttaatgattgccattctaactggtgtgagatggtatctcattgtggttttgatttgcatttctctaatgaccagtgatgatgagcttttttttcatatgtttgttggccgcataaatgtattcttttgagaagtgtctgttcatatcatttgcccactttttgatggggttgtttgtttttttcttgtaaatttgtttacttccttgtacattctggatagtagccctttatcagatggatagattgcaaaaattttctcccattctgtaggttgcctgttcactccaatgatagttttttttgctgtccagaagctctttagtttaattagattccatttgtcaattttggtttttgttgccattgcttttggtgttttagtcatgaagtcttttcccatgcctgtgtcctgaatggtattgcctaggttttcttctagggtttttatgttttaggtcttatgttgaagtctttaatccatcttgagttaatttttgtataaggtgtaaggaaggggcccagtttcagttttctacatatggctagccagttttcccaacaccatttattaaatagggaatcctttccccaatgcttgtgtggcgttatttctgaggcctctgttctgttccattggtctatatatctgttttggtaccggtaccatgctgttttggttactatagccttgtagtacactttgaagtcaggtagcgtgatgcctccagctttgttctttttgcttaggattgtcttggctatacaggctcttttttggttccatatggcatttaaagtagtttttttctgattctgtgaagaaaatcaatggtagcttgttagggatagcattgaatctataaattattttgggcagtatggccattttcacgatattgattcttcctatccctaagcatggaatgtttttccatttgtttgtgtcctctcttatttccttgagcagtggtttgtagttctccttgaagaggtccttcatatcccttgtaagttgaattcctaggtattttattctctttatagcaattgtgaatgggagttcactcatgatttggctctttgcctattattggtgtataagaatgcttgtgatttttgcacattgattttgtatcctgagactttgctgaaactgtttatcagcttaaggagattttgggctgagactatggggttttctaaatatataatcatgtcttctgcaaacagagacaatttgacttcctctcttcctatttgaataccctttatttctttctctttcctgattgcactggccagaacttccaacactatgttgaacaggagtggtgagagagggcatccttgtcttgtgcctgttttcaaagggaatgctttcagcttttgcccattcagtgtaatattggctgtgggtttgtcataaatggctcttattattttgagatacattcaatcaaagcctagtttattgagagcttttagcatgaaggtgtgttgagttttatcaaaggccttttctgcatctattgagataatcatgtggtttttgtcattggttctgtttatgtggtggcttacgcttattaatttgcatatgttgagccagccttgcatcccagggatgaagctgacttgatcatggtggataagctttttgatgtgctgctaggttcggtttgccagtattttattgaggatttttgcatcgatgttcatcaaagatattggcctgaaattttctttttttgttgtgtctctgccaggcgttggtatcaggatgatgctggcctcacaaaatgagttacggaggagttcctctctttctattgtttggaatagtttcagacagaatgataccacctcctctatgaacctctggtagaatttggctgtgaatctctctggtcctggggtttttttggttggtagactattaattactgcctcaatttaagaacttgttattggtctactcagggattcgacttcttcctggtttagtcttgggagggtgtatgtgtccaggaatttattctagattttctagtttatttgtgtagaggtgtttatagtattctctgatggtagtttgtatttctgtgagatcagtggtgatatcccctttatcattttctattgtgtctatttgattcttctctattttattctttaatagtctggctagtggtctatttattttgttaatcttttcaaaaaaccagctcctggattcattgatttttttgaagggttttttgtgtctctatctccttgagttctgctctggtcttagttatttcttgttttctgctagcttttgaatttgtttgctcctgcttctctagttcttttaattgtgatgttagtgtgtcaattttagatctttcctggtttctcctgtgggcatttagtgctattaatttccctctacacattgctttaaatgtgtcccagagattctggtacgttgtcttggttctcattgatttcaaagaacatctttatttctgccttcattttgttatttacccagtagtcattcaggagcagattgttcagtttccttgtagttgtgcgcttttgagtgagtttcttaatcctgagttctaatttgattgcactgtgttctgagagactgttttttatgatttctgttcttttgcatttgctgaggagtgttttactttgaattatgtggtcaattttggaataagtgcgatgaggtgctgagaagaatgtatattctgttgatttggggtggagagttctgtagacgtctattagatgtgcttggtccagagctgagttcaagtcctgaatatacttgttaattttctgtctcattgatctgtctaagattgacggtggggtgttaagttctcccactattattgtgtgggagtctaagtttcttttgtaggtctctggtaactttctttataaatctaggtgctcttgtattgggtgcgtatatatttaggatagttagctcttcttgttgcattgatccctttattataatgtaatgcccttctttgtctttgttgatctttgttggtttaaagtctgttttatcagagacgaggattgcaaccccttctttttttttttgctttccatttgcttggtatatatttctccatccctttattttgagcctatgtgtgtttctgcatgtgagatgggtctcttgaatacagcacactgatgggtcttgactctatccaatttgccagtctgtgtcttttaattggggcatttagcccatttacatttacggttaatattgttatgtgtgaatttgattctgtcataatgatgctaggtggttattttgcccattagttgatgcagtttcttcatagtgttgatggtctttacaatttggtatgtttttgcagtgggaggtaccagtttttccatatttagtgcttccttcaggagctcttgtaagggaggcctggtggtgacaaaatctctcagcatttgattgtctgtaaaggattttatttctcctttgcttatgaagcttagtttggctggatatgaaattctgggttgaaaattcttttctttaagaatgttgaatattggtccccactcttttctggcttgtagagtttcacccaagagatccactgttagtctgatgggcttccctttgtgggtaacccgacctttctttctggttgcccttaaaaatttttcctttgtttcaaccttggtgaatgtgacgattatgtgtcttggggttgctcttctcgaggagtgtctttgtggtgttctctgtatttcctgagtttgaatgttagcctgtcttgctagtttggggaagttctcctggctaatatcctgaagagtgttttccaacttgattccattctccctgtcactttcaggtacaccaatcaaatgtaggtttggtcttttcacatagtcccatatttcttggaggctttgtctgttccttttcattctgttttctctaatcttgtcttcacactttatttcattaagttgatcttcactctctgatatcctttcttccgcttgttcaatttggctattgatacttgtgtatgcttcacaaagttctcgtgctgtgtttttcagctccatcaggtcatttatgttcttctctaaactggttattctagttagcaattcctctaaccttttttcaaggttcttagcttccttgcattggattagaacatgttcctttagcttggaggagtttgttattacccaccttctgaagcctacttctgtcaattcattaaactcattctccatccagttttgttcccttgctggcgaggagttgtgatcctctggaggagaagaggcattctggtttttggaacttttagcctttttgtgctggtttttcctcatcttcatggatttatccagctttggtctttgatgctggtgactttggatggggtttttgtgtggatgacctttttgttgatgtttatgctattcctttctgtttgttagttttccttctaacaggcctctgtgctgcccctccttccaccaagctcgagcgtcccaggtcgactccagactgctgtgctggcagcaagaattttatgccagtggatcttagctttctgggcttcatgggggtgggatccactgagctagaccatttgcctccctggcttcagccccctttccaggggagtgaaccgttctgtctcactggtgttccaggcgccactggggtatgaaaaaaacttctgcagctagcttggtgtctgctcaaatggctgcccagttttgtgcttgaaacccagggccctggtggtgtagggacccgagggaatctcctggtctgtgggttccgaagaccatgggaaaagcgtagtgtctgggccagagtgcactgtccctcatggcacagtccctcacagcttcccttggctaggggaaggagttccctgatcacttgtgcttcctggttgagaggacgcccccaccctgcttcggctcaccctccatgggctgcacccactgtctaaccagtcccagtgagatgagctaggtatctcagttggaaatgcagaaaatcacccgccttctgcgttgatcttgctggaagctacagaccagagctgtttttatttggccatcttctatttacatttatttttatatgtagttatatatttaaaactttatcttgaccacttgatttagagtaatggaaattggagaaatgtatacagtacagaacattctacattggctttttttttcctatttaaaatgcttaaacgttctttaactcaagaactttaattttgctaataacaaagattcttaagcttagtgtgaaacatggaaaggaaacgccagcagcctggttatgaataggatcagcagtgccatcttgtggtaaataccttgaattacaattagaggcacccgcatgggatctgggagactaagaaattctactctatgctcagtgatttacatagaatgtaaaaggtatttctcaccattttaagactttgggtttatataatcagaggaggttcttcctttacaaatgtggcaaagactacagttttctacaagaccttttaatgttgagcttttaatgttacatacaattacattaaatgttactgtatgtaatattaaaaactacagttataatttcaaaaagattatagtacatgaaacattttctctagcagcagctctaatgtgtaataaaacctagtattataggttaaattggatatatctataacataataaggtaagcagctatagataagtcaaagcatggcaagtatatgatcagataataatcctgtttccttcagacctaacatgtggtaatacagtaattttgtgttctttagcttgtctgctgcttttgaaaattcttttcaacagttaacaaatattgatgaatccaactggaaaaaataatgtttacctattcattagttccaagtctgtgatagttaaatacgtgggaccattgtagtttctagaataattacatttaaaatccccagcaccttgcaaaaatatttattcaattcatattttgctttttacgttatcaacacatattagtttagagagtttagcacaaatcactaactagaccagtattagtaatccattggtaattccaagtctcacactggatcatcttgaaaatagttcatgggttactatttttttcattagttatatatgtcatgccgaatcaacattattttcagaagtcattcctctttattttattgcccttttgtgtcactttctttttcaaattataaaagtaatatatgttcatgatgcaagttcagatattaaagtaatcattcctgataaacttaacccctggaaataatcaccatttacagtctggtgtattattttcagttgctgcatttattaataaaaatattttctcttttcagttggtcagaggtaggggcaccccatcttcatttccctcagtggcactttcttccagaaaatttgctgacaatatgttttttttgtctgctaagataactgggaatttcattaccctgataggaaattttgatttttattcctagttttgctgtttctcacttcctgcagtgttggatttattgggcactggatgacaacactctgtagtgctatacagatttcctagcatgttcagatatacattaaccatgcatagaaaggttgtagaaagcttaatgactttgcccaagttagctaacatgtgactagccacgatttaaatcccttctgattatacctgtacctaggtgaattcttctggtcccatgactttaaataccatctgtatttgagatgactctcaaatttgtatctttagccctgccttcccccctgagcatcagacttgtatatgcaatttaaaaaaatacatctccgcctcagtgccatctcaaaccttgacttggcaataaagagaatgcttgatgtcctcaccgctaccttttttctcccaaagacttctccattttagctattggcatcattagctatccatttgcctaagcacaaaccttggaataacctttggtttttctcttcttcaagcgtgacatcaatccatcagcacatgctgattctaactacgtttccctaacataagttcatctcttacctaggctaacataatcacatcccaattggttttcctgcttcccctctgtctgtcatcaccattatgtgctattctattacctttttatttttttcattatatttaacaatatctggtattattggcttttggatctattgtctgtcttactttccttctagaatgtaagctctgcaaggcagaaacttttatcttgtcaccactgaatccccaagacctagaacactgctggcaggtaggtttcgtgttgaacctgtaaacaaacaaattaattaatagaagaagtctggtgcttgttcagtagttgggaattcaggaaaattattcctttgctggttttctcagcgctgttttgtatagcgttgaaagaactgaaaaacttttatttaataatgtgttcttgagattgatattagagtcttattatcttagatatacagtatcacttaggccttgctgaatgcattttatgctccctgagatctttttgggagattttctgtggaaacctgaaaaggaaaccatcacagtgctttctcagagaagcaaggctcaacaaatgactgggaagaaacttttgctggttgagagaggtattcagtatgtgcttcaacaatgatgtaaaagggaacaaagagaagtgaatgcaaaacatctttatttgctttggactgcccttcttccactaaggctaactttgaataaagaggaactcgataccgggccaatgaataaatttttaaaactggaaacttaaaatgaaggtttgaggatcctgaaatactatatattttaaaaaatcaatgattcttttaagaaatggaaaacaaagtgagggaagagtgggtagagagattgattggtcattctatatctagtgtaatggaaaaggtattttgtgtcagcaagatctgggttttgattctagtcttgccactagctggccacatgaccttggatgtcttgcttctgaaatctaggcttgttatttctgttggtggtttaggatgatcacatgagatgaatcttgggaaataattcttacaattataaagcacaatacaagtgtaatatattatcctgattatcattatctcaccattctagtatgaggatccagggcttcattctcttgatgttttcaactttgtggtcccagaactccaatggctacaaagatgccaagatctgaactcagagattcatgaaacagctctaaatagttttaaattacttccttgggaaatttttgcttgcttatgtgtatctgagattaacaacagtaaaaacaccttttatatagcaccatcagtgaggctttatgtctttattataaattttggagcatcctccaggctctcaaaatgaaatctctggatctactgaagagagagagagagagagagacagcaaggactttcatgtctttaaaagcaattacaggctcaggtctctgaaaaagtattaagtgccaagactgacgcctctgcaaccatttattcttgacattttttcaacttttttttaagccagactattgatgcattttaataccattagtatttgttaaaattagttcagcagtattattaatttgtcttcttaaaataaaaggcaggaaaacagtattatgcatgtatttaaataagtcccctttccagatattggaaggtatgtttttaagtattctggagaaaagtcattttaaaaaaatttccaagcagaccattttgctttagaaatattgaagatgcaatatgtgaatcatatttggattttaaagcaggatattaaacttcacagtaaaaatgattccatagttgttaaagtccaaagagaggtttacgaagccagcagacagagaaactgaaattcacttggagaggtaaatgacacaggaatggaaacattgaataaataactttacagcaatttttcttgatgttattttatcccttaaaggcagacagatcattaaaattaaaattgtattaaaaatattctctataaaaatatataacccaataaaatgaatgttgagtcagccacgtgtatttctttccaaacccataatttggatttggattggatttccaaacccacaatactaaatttatttagtattttgaaattcatatttgctaggcagtgcatcttagtaaattaaaaaatatatattcccattacttagttcatgtaaataatcctaaaggtgaactgaattggccttactgaaatggaggctcatgccagggctgaccagggaaggtgaagagaggataagagacattttatcttcatgcatttgtgtctttgcatttgctgtttctctcctggatgtgtttcccatcctgggtcatttgcttaaattcataccaattttttttagcatctatttcaagcaccctgttctccactatgacttcactaacatttctagatagatagttgctcctttctattgctgccttgtatgtaactctgttattgcatgtaacacatcatcaataatttgcttacatttctgtagcttttgtatttccagtacctaccttagtgcttgacatatagtaagaacttaataaatgtctgctgagtgaataaataaaaaagtgagtgatagctcctgatcactgcataacatagatacaactcataaagttgtgattcctggcctcatccttgtggggcaagtaggggtggtgggacagaggctacccagaagatgaacagagggatgggttgattatgcaataaaaaacattcattcagcttctggcactgtgccaggtgctgtgggggaaactgcagagatgtgaggtacattgtatctgctttcaggggtttaccagttaggtttaagggcctaatttacctgtatgaatcatctagagggaaattgaaggctaagttgtaagacttgactgtgtgtctatgaggaagttagaaaagttagaaacccacatgagttgaaggagcttggaaaggcttcatgaggagccacaagttaatttgggctcagcagtattgactgaaggaagggctgatgaagtggcaagccttgggctaggtgggagttgaatgggtggctgtgtgggaattggcttgtggagcagtgtttactctgggagaccacagacactttctacacctatggatggattttagagatgctttgaacccctggaattatttgcaaaatgttgtatgtatgtttatatgagcagttttccagggagaattctcagctttgaaagaagtagatgcagattttaaaagaatgttacgttttgtagttgtaatcacgaataggtagcattatcattatttatcttttcatgaagtcttaaagaaagggaaaaaggaagaattcgatggggtagggaggtgaagggaggagggagattcaggctaacaatataggtatcaatatttattaaatgatctttccctgaaagtgtatcactaacatgctgtatctttagctgattgtcaaaagagatcatctaagcgatggaggctacactgcctgtttgagagaaactactgaactaaaagtgaatgaaaatgtatcccattgttgcccaaatgaaaatatacttaattcaaaggcagaaataatttttaaaaattgttagtgctagaaagatgaggtacttataaaaaaaaaaaagaatgtatttcaaccagatcatgtaaaagtatgcccattctcccactgatttttcttctacttgttaatagttttgctttttatacttagcacgttagcatatttgaagtttatgacatcaagtagtgactcaagttattttaatggaaagcaagtcatgttaagatcacttcttgaacaacttatgcttttgtcattgacatgatatgcctaattgaggtttatgttgtatatatcctgattggggttcactgagatttttggatttgtagattaaagtataaattaaattttggaactttaaaaaataaaaataaaaaataaaaataaaaattgttagtgctttaaccagcaaacattattttttaaggattattctatttaggtttttgaatgtagggatttgcctcataatgaaaaatctgcatttcatcataaaaactgaataaaatgaacatgacttggttatttgccatagatgcggattcttttaatattggatgctcagtttgtatagaaaacatttggattggagcccctctttgggccattgccaactagaggttaacatactaatatatcagagataggagtgatggatttctacttctgggtgagtgttacgctatcacatgccctgaagtgatagctctatcatgttgcaattgtgagttaaggaggaaggaaagagatctatgaaaaaataagctgttcctttgtttcctggcttgttccaaaaaggattgcaataaaaaagagtttcatattattggtttatgtaattgataagagcccagtaattgaggaacaaaaaagttgttaagtttatgcaaacgaataatacaaaagggattttcccataattctatctttaggagagtaattaattggataatagttaaagaagatagtaatgttgagagaatgaataggtatataaacctcaattatatcttaaacattagtaagccatatttttacatagaattcagtttaattggaggacctgagaaatttgttgacactggaaacttgtgcatttttgatttataaacctgaaatatgcataactaatgttaatttaataatgttgaattttaatagccttaaagtcaagcattaagaaaaatgctcagatcatacaattttatgaaaaatagactattcaactcttaatgattcaacataaagggccacttcagtgaatgttcaaaatgtattatcacttctgtggtgatctaatcttatttattgaatctggtaacatatatttatgtatatatgaatatgagaatcttaatatatattttaatatatatattattacattattctgtgtaatatactttttgagttcttaatatcttatattttctataaagtcatatatgtggcagatacatatatggagatatttcagattattgtattgcaagctgaggaatgtagtatcttcagaacttgccacttgctagggacgaggttggaatgagaaagtgtattggcctcatggccattcctaagtcttggggccgaaggctggaggttggccctagtgaacaaattacttggaggatccagaagtggctagtgcacaggagacagtgcaatccattcccaatggggagcagtgggtcatgactggatgaaccatatacatcatcagttctgaaaatgaggctgattaaagggcattcaggagcagggtgaatgaagcttctctggggaaggagagaaggtccaggcctttgtaaacaggattgagttttctaggttgcccagtcccaggttgactttggctggaattaaaagtcatggttcaggtagttcaccttttatagtttcgtgcttattaacataaatttacttttattttgaatacattttgctataattagttaaaacaattatagtaacaagatgcttaactctcactctataaacaatagcattatgaagggaatatggaacaaacaacaatctatttatgaagaacagatcagtggttgcagctagggtgggagcagtgactataaaggggtagcaacaggaagtttcttggggtcatggaactgttctggatcctgatagcggtggtgtttacacacatctatatgcattaaaattcatagaatcatctgccccaaaagtccatttaactatacgataattgtttttaaaaagcaaaaaatgctagcagggagataaaaaaaatttttttttttttttgagatggagtctcgctctgtcacccaggctggagtgcagtggcacgatctcagctcactgcaacctctgcctccgaggttcaagcaattcttctgccccagcctactgagtagctgggactgcaggcgtgtgccaccacacccggctaattttttgtgtttttagtagagacgggatttcactgtgttagccaggatggtctcagtctcctgaccttgtgatctgcccacctcggcctcccaaagtgctgggattacaggcatgagccaccgtgcccagccagaaatgtttaatatatcaaatatacacaacagaacaaagtaaatcctaacagtcctagaaggctataggaaagccagagtcctaaaagtatgccatttgcctgtttctgaatgtcttaggttggtggaaggcacattttacctggaagctgaaaatgatttggtcccctagttcttcttttatcttgctttcaaaaatagacctgtcttccttcctttcttctttcctccctctcttctctttctttcgatcattcctcccctccttactctctttctttcttaagttcatgctatctgacatggtgaagtggcattctagattactttttttttttttggtcacaagtgcctactggtggaagggacatgaagggaggatgagaagctggtctagctctgctccaatcctgagggtggacagttgagccagaataaaaccaaaagtgaagcctcactgcttaccagaatacacttgtgtagtgcctacactacctgtaggccttcctgtttcaggcagtaaagtgttgttctggagctgagcacctgctttgagttagaattgagacaggcaccagaagttggatgcagtccagactgatcagaggacccttggaatagactttaagttgaccttgaccctttagtcttctttggattggacttcccaggattactctgtccctttgaaaaaatatatttgtgtcttgggcctgaaccaaattttaatcagtctcctagaaattgtgaagggctgctatggcatggcacaacatggcctgttttctcaatattgtctctttaacttctcatttacttggcaacctgatttctgattttctgaatgggtgttgctgtggacatttgcccagaaaacagctctgagtgagggactatcagagagaattttatgtctcttgggaagggaaaggttaacttttatttccaagaggactggctgcatgagttcttggatgcagcagtccccaggagagtgcggtgtgttgagctgtggctagtgtgtgtagttccacacaggcaggagtgggctgtgcagagctacttgtttacaacagcttcctgaatctgctaatgccagactgagtgaatgaaagattagtttgaagttcttgacccatattctttacattaaacattgatgaccattttttctttcagtccttcctctatgttattctggatttgaaatctctagctatgagataatattaactgaaattcttgacatttgccaaccctagtcacaacccttgctatagatcatttcaacataaagcatttgtcttttagcttgtctgaaaatatactgcagtatgttgctggtggtaatggatttcttggagttgaaccattgggtagaggatttgtgattggagtttaccatctgatttatatgttctatggtcatgataactcagatttgcagatctgggtactactgggactgtggggctattgtgcctgacttaattgcatatttaaatgtaaggctagaagtaaagctgaaaaagcagatggatttggaaaatgagattgtcctgttttgaggtcatatggaaagccaagaaattgctggagcagctctgacagggatttcaggaaaacaggctggtaatatttccacttctctcagcttgcagtctggctgaaaatgtagtaagatcagccttttccaaaggtcttggtatttctgcagctgttttcagaaagccttgaaagtgaaaagcaaaggagtccacagaatctcaagtatccatgctccaatcactaaagctcttggatgatctaagtggaaaagagctgaagccatgtaagtgaaggtgtgtatgacacagttcatgtgtggagtctgctctttcagatatgacatcatgtctgtggcccccaaaagcttccaggaaagcatcggcttgacagcgaggatgccaaaaagtccttgataggagctctgcacattatatttccaccttctattattttagattcttttttgttccattcacctaagtcagctgggccatctgcctaagccagccaacatctcacattttctaattggtctagttagtccagggttaatatgtcacttactatcactaatgagagactgtacttgctagactcgtaaagcatttttaatgaatgcttccagtattatgattcctgttctacagaaaaagaaaccaggtttcagagaatttatgtgatttgtacaaattatttgaacagattagtggatcatgagggctatggaatgtatattttatactgtcagccaccaactttcaagtggttgaagctctccacatatgtaatgtgtttaaaaggaagtttaaaataatagaaatgactagattgtgtcagtgatttttaaatattctgcaaatgaaacttaagtaaaagttcaatatgttaaagctacaagttctattttagcatgaatttatttcacaagttcaggtttctaataactacttatcttcaaattaaccagtaacattaacgaagctatttatgaacacaagtatttgaaatctagatttgtagatgtgagttggagccttaatatctaatatattttaaagttttgttcggttgtcccccactgaaaaaaaaaactgatttacagataaattcttgaaaataggtataattttcttaaaagctaagcctactgaaaatattattcaatctgattgaatcagacacttgagaaattattaacaggtagttttggacccactttgaatcactatctaactatacctgaaaatattcatttttcctcttctctcctaagcccagtccaattaccatcctctgaaacagcatttgtcaaggtccctagacctctgtgtagccaaatctgtccataaattctcagttctcacttcatgggacccatcatcagcatttgacactcttgatcactccacttactctccaaggctcgcgctctcctggctttcttcccatctcaaaggccacttctcagcttcctttctgtgcccccgtcattgtcctgactatctcaaactccctatcagtccttttcaaccatggtttctcatctgaaccaaggacacaaaaaatgattccagagaatattttctcaactttttccaaggaaaataactagttctaggtgcataggaaggaagttaatccatcacatacaatgggtgccttagggctttgtcttaatgtttcttcacataacctcagttgacaaaggttgccagcctcaatccacaaacattaggcatctgatgcattttcatgaccttaactccatctatatattgacaactcccaaatttatatctccagcccaggcctctatctgaacacaagataatgttctctccaatttgatgcaacctcttgtaaatatctgacatctcaaacttctcatgttcaaaaacaaaacccgatctttcccccaaaaactgttccactcagagttgtcatctctcaggccccaaattttagtcatccctgaacttctggtctttctctcacatctttcatccaatcctttggcaaatcctactgtacctatgtttcaaatacatccagaatctgaccaattcttgccacctttacttctaccaccctgacctaagccacatcattctctagagcttgaactattctagttgcctcctaattggcctccctgctttcattgttggacctctacagtctatttcaaacacagcagccaaattgatccagtcctttgctcaaaattctccagtagctcccaattacaatatgtatggtaaaagctggaaaccttacaatggcctacgtgatctgtagtgcctctttcctgactgctgcagtctttttgctgttcttacaatacattgagcaacttccacccagggcactttcccctgctcccgccccaaacccccatggcttactgctcatttctttcaagtctttgcttagatgataccttatcagtgaggcctttccctcccaaccttttaaaaattgtaacggccctaatcactcactatccccattccattgcttatttctccctattgtgtttattattttctaatattttacatggtttgcttatttatttttattgtcttccttttctactagtgtgcagtttcctcaagggcagagattttgtccatcttgtccactactatatgccaagtgtttggaacagtttgcacggaggaatggttcctgaatgaattgaatgcatggtgagcgtttaatttgaaatttgaaatgtgattaatggaattttaatcattttaaattctccttgtattgcacaaaatgcttcttaaatgcacgttgtaacatcatgagatagtcaatccagatacctcagtgcccactcctgctaaatatttactcaaaggttaaaaactgtcattggttttgtatgctgaggccaaatttgaatttttagttgcgtgctggtacttcatctgcagatgtaggtatcatgcatttcaaccctacattgctaggttaatctaattgagtatattgaaaatatcagtaggattccaagtatctcagttctctcccttccccactgtactctgtgtgagttgtagcggggctggtccctgcaggttgcatttctcttggttgggcatctttctgtctgtgttgacctaattgcaggcagtaatgcatgatgagaagcagcttggagaagccagggtattttcccctccttgtctgctgctgtcagcttcctgccatggccacagcttctgtcaaatgattccatcctagtgtgtgagccagctcacaccagttcatgagggacaattttgtttatttttttcaactccacgtttatgtttttccaactccatcaatatcacattgatgacttaaaataggccaaatcctggctttccactgacagagaaccaatttgttaaacattgaccagcacaccctggtgggctcagcccttgcgttctgtaacacccctttttccttttctctctggtctaggagtggtagtggcttccaactgttgctagtccctggcttattcactcttccctgtttaggactcaattccttggtcacctttgtaaagaatttcctgcattaattctcttcccttttagaaacaggaaatgatttctgttttcctatactttgatacaatgcctaaaatagaacaaccatgctatgtttgagtgaacttgagagaacctttagcagcaatacaaaacaaaaatctttgtctcatctgaaatatttgcaccagtgccttgccttggaacacataaaaatactttgatacaaaaagtaaatttctgatctcattgccaaaattattacacattattttgaaatgctacaacttaaagacagcactctaatatagttaacacttaacatgacattatccaatatagttttaagagatgctgccattttgttacctcctaatacttgtttctgaagcttataggaactacttgaatactttttttcaattgcttttcttataagtcattttcagttgctttcctatggcttactcatcatttgtagacttggtcacgttgtgaatgagttacttcatggtatgttcaaagtcatttaaatatctccctctgttttgatgtatgtattgagtgtttttcaaggctataaactcccttaggtttggccacaggaacaaagtgtacaaaaatggagaataggaagaactataacatccatactctcatttagttgaattataaagattttagctgtcttattcatcacatatgttggatgcccagtcttgggtgctgtgagctgtgatatctgacaatggtaccaatatttcagaggcagggaagcctggtcatttaacacattcactgtggggtcagtagctcaggaggtaatagggttcacccagtgtgtttccttcacatgtgttgatgtaacttaccctgaacaatgtttttaaattcatttttaccatttaaatactactggtccagactgagtaagcatccttgaaactatattgtagtcccatctacagtcctacatcaaggcttgttccaaaattgctccaggtcgtagacttggactttaactccatctttatctctatgcccaccttacagagtcctctaaggaatgttctagagagcccatctttctgtataatcagtctatttagagtggagcaagtgatgaaatttaatgtgaaagattccttgattttcatattatcctattgtctgaagattctgatcaatctaataaatatgcaggttaggcctagtctggttttctttatccaggatcccttctatccccagctagagccactagatcactaaatcaatcgtatgtgcaggctgcctctgatttatttccctcgctgctgctggcctgcccctgccttttagccctgattggaatgtttcaatgtttgctttgttctaatactctgtcccttgtactctcttttaaataaccagcctctgactgtcttggttcttgtttacccaccttttcatcagccccttcctcattcttcaagcccaaattccagcttgaagtctgggttctacaatctgttgacagacttcctcgaagcttatgatctgcattcctgaccttcctaggagtgtctacctcacaattttctgatgttatgttgtgcaatgacacctcattttgtttgtttttgctgttgctgactggaccattgtatatcagatgtggtgttttgcctgccagaccaagccttcccgtattgcatgggagtatactagtggctgtgaccagactgattttaagttctaatccctcttcccactcctaccctcaacctgctcagacctgacaaagtaatagggaattgcccacccatttaagtcccataaaaagccatactgcaccactagccacttcaattatgatgagtggttttatgggaagaaaggaattgtaggctgatgatagtagctttgttgagttggtagcactggatccagtctctgagggaaacataatggttggatttcaactttgtagtattattccaggagcatctgtatagtatcataaatatgggatctcacatgacgtcttcctgtgtctcagaaaaatggacagaaagcaggtttcaataatcttttttttttttttaatttgactttaagttctgggatacatgtgcagaatgtgcagttttgttacataggtatacgtgttccatggtggtttgctgcatctatcaacctgtcatctaggtttgttttttttttttggcagagtctcactctgtcacccatgctggagtgcagtggtgtgatctcggctcactgcaacctctgcctcccgggttcaagtgattctcctgcctcagcctcctgagttgctgggattacaggtgcacaccaccacacttggctaatttttgtatttttagaagagacggggtttcaccatgttggtcagactggtcttgaactcctgaccttgtgatccgcccacctcggccttccaaagtgctgggattacaggcttgagccaccgtgcctggcctgtcatctaggttttaagccccacatacattagatatttgtcctaatgctctccctttccttccccctgagcccctgacaggccccggtgtgtgatgttccgctccctgtgtccatgtgttttcattgatcaactcccacttatgagtgagaacatgtggtgtttcgttttctgttcctatgttagtttgctgagaatgatggcttccagcttcatccatgtccctgcaaaggacatgaattcattcttttttatggctgcaagattaaagaatcttttgcaacagatggggaaattgagatttagattgatcaattgttgcccttgagatcacacacagatttgttgataggatagatcctaggttttggttttggggaataacaatccactgtcccagggacttccaaccatttgatgaaagaatggtttttagttctctgaagccttaaggtaatttaatttcagagctggtctggaactgaccttggagattgcctggttattagtctaaaccctcattttcaaggtactgatgacagagaataggaggtgtgttccatttccctaccccggattgtatgactgatgggaatggagaggtagagtaggacagaggtgtatggtctatcaagaaaggcttgaagtcctctctcaatcttttgtgcaaccagttttattaaatggatggaattcaatgggaagtgaaatagggaacaacctctacccaaaatcccaccccaccctccactgccttcaataatgttaggctcttaatttttccatttttcttttttaaaataatattttattggccgggtgcagtggctcatgcctgtaatcccagcagtttgggaggccaagacaggcagatcacaaggtcaggagttcgagactagcctggccaatgtggtgaaaccccatctccactaaaaatagaaaaattagccgggcatagtggcagccacctgtaatcccagctactcgggaggctgaggcaagagaattgcttgaacctgggaggcagaggatgcagtgagctgagattgcaccattgcactccagcctgggtgacagaccaagactccatctcgaaaaaaataaaataaaataatattttattgttttttgcataatgtctttattttgcagaaaatgctttctgcttattgtctttggctactttgtcaaaactctaggtatgtcaactctagctatgatacctgacacaaaagaagcctgaacattacttgaaagcaacaaggaagagaatgaaagtttgttttttatctcactaaagtaggaccattgtttacaaattctggtatgccaaagtcatctatatgctatatgagaaacaaacaagaagtttctggaccctagtgaacagttttttttttctgtgagtcatggtgaattacgcccaactgcattgcttccagccttgaattcacctagatgactcaggacaacactgccactgcagattaccagcaaagtgggaggtggtgatgggactttttgataaatagtagaatatgtattccttcttctattttaaaatgaagttaataaggctttatttccttcctttgacccatgcgactgccattttatacctagtagatccatcagatgaacgctggttgcaaagtcattgcatatttcaagacataggtcttgattcacatggaaggtggtgacatggctgtctatgaggctaccagtaaggttgggctgaggcattgtactggctgtcaggcgtgtctgtgtctgtgacagtcccttcatacagtggggatcctagagctagtagatggattggtgttatgactcatggggcacatactgatgtgggcaggcattcgaggctggaccaactgacaggggattggagcatggataaacacacagatgaattgtcagaattgtaaggctcttgtatcggtttgaaccctgaaagcgcaccaacgaacaacacaaggcggtgtggagcaacacgctgttttaatgtgtgcctgggtgcagacgggctgaggcttaaaagggcatcagcaccaaatgcggacagggtagcagttttatagtctcctgtaaacaggaagtatctcagtctgatgtaactgctatgcagtacctggacagcagtacctctctcggtcttcagggggtacatgtcttccggccagttctcttcctgcttctgccatcttgctgacaaacactgttggcacaagtggtcttgtgccttgggactaggcctcagaagtgaggagttattcaccaccacctccccccgccggcttccaggccctggggaaagtctttcattcttgtctatttggttatagaaaaagggaaaagcgacgactttctcaataactacttcaagcgtgacatagggggtggtgtggccaccttggaaacaaaaacttaattttgggggtatttttgagagatgggttggtattcatcatgtcgttgcagcaggagcatcgtctggattgtctggtggttaactatggtttcaacaagacttttattagcttttattattagtgggataatacaggggagaaacaggaggagcccagtgatgaagattactgtccctaccagcattttaaatcctcttaaattagagaaccaccctcctagaatgtttgttgggtcccatcccttccaggtttggactggtacatgggctacttttctgatgtttgaagcgatttatagtactgtttttccattatcgtctatgttaagacaacaattggagatattaaacttaccacaaacctcaccttctgaagttgtttggaactacccacctggagaaagtacagacaaagactagaagatagtggagctgtttatcgggtgggatgtgagtgaagtctacttgccaatcttgcccaggtacctgtctctgggcttggtgggtaggaaaaggcagtggctggagggagccctggggtgacactgagtggcagatagagcaggactgggtgatttcttgaacacagctggaaaggtgaggacaagtgagaatagggcggagaagttgtaagagaggtttggaactgacatggaaaagttgtggagactttgggggatagggattgtttgagagtgaggaagaacgaagcgcccttccttgacctaccatggtccttgcttttgaaggttttgggctcagaagtcctccttttcttccgaggattaaagaggagagaacaaggacagggacaaaaactggccttgcacaggttgtaggtgtacttgtttggctacctaatctgctagtgcatttccagctgctataggatcgtatggagtttggtggcctctgcaatgaatgatggcaactttctgtgggagcctggcagcttgaaggagtttgttgatgagagagccatgtatgacaggagtgttttttgcagttaggaaacgctgttctttccagatggaagagtgtgagtgcactatgtggaatgcataatgagaatttgaatatatgttgatctgttgtctggctgctagagtgagagcttgagtgagggcaatgagttcagctttttgggaggtggttcttagagggagcatattggcttcaatagtgtgtggggggtgacactataaaatagccagcatgttggtgtccttgatgtaggaaggagctgccatctacaaaccaagtaaaggaggcatctggaaggtgttggtctgttaggtttggaaaatgtataagaaatgtttgaacagtgttcacacaggagtgcgtagggtcttgggtggttgtagcttcaggtaagagtgtagccaggtttagacaggagctggttagcatggtgatgtggggagtttctatgaatagagcatagagttggaggagctgttgggcagagatgagacttagtacactgcagtgagctagcatgtctttgatgttatgggttgaataaactgttaggttggcatgaagagatagttttaagctttcaagggtgaggatagcagctgccgccaatgcttggaggcaggcaggccatccaagaactgtggcttcaagctgtttaggcaacaacctggaaggtgggtcccttagactgggttagaacacttattgcaactccacatcattcattggtgtagaaggagaaaggtttggtgaggtctaggtctgggagagtgaggacgggggctgaggcgagagccttctggagtagacggaaaggttaggtaataggcagtgcagggtttaaaggctcatggagagggcctttagtggcttggtataacggtttggtgagtagagtgaaggagggaactcagagcctaaaatatcctgctagtcctagaaaagagataatttcttgcttagtttgtggaggtgggagggactggaggagggatatgccatcggttgtgagccctcgggtttgcggggtaagagctaggcctagataggtgactgggggggtgcttatttgtgctttcttaggggagacctgatgcccccattctgccaagaagtttaaaagagagatggtatggacattgcagtctctttgagagggtctacataggtgtagatcatcaacatactgaaggagagtggatggttttagggataaggtacagaggtcacgagccagggcctgcccaaaaaggtgggggctgtctctgaaaccttgagttagtatgcaccaggtaagctgatgtgaaaggtgggtgtcggggttttcccatgtaaagacaaagaggttttgggaatcagggtgtaaaggaattgtgaaaacagcatcctgtaggtctagaacagaaaaacaggtggtgttggagggaattgcagaaagtaaagtatatggtttaggaactactggacatactaggggtatggcttggttaatgagcctgaggtcctggactaagcaataagttccatctggctttttgacaggtagaattgatgtgttaaaaggggagtctgttgggcagagtaggtgactgacaaggaggtgagaaatgataggctttaggcctatgagagctgcttgggggatgggatactgcttctgtgataggaactgggtggggactttaagagtaacgtggacaggggtgtggtgttttgtgattgagggtgtggaagtatcccaaacagtggggttaactatggatgggggataaggaaaggttgcatgttttaaggtgggaggttggaggagtagaagaaagttagaagccccagaggggtctgggttgatgcgttgggtactatggggaatgtggaagtggagagtagtgtggagttttgaaaggatgtctctacttaggagcagagttgggcatgagggcaggactaagaaagagtgagtgaaggaaaaggtgtgcagggagcagaaaagtggagaggtggctcggggtttggagacttgtccatcaattcccacaacagagacttgggaggactgggtgggtcctgaaaaattaggtaaagcagagtaggttgccctggtattaattaaaaaacatactggcctacctgccaccatcagggttacccttggatcacatgaagagatggtagttgccggggtgtctgttccagggcactgtcagtcttcagcagcaaggctgatgagatacgagtaggaggttttgactggctcaggaagggatgggggcagtccttgtgggggctgctcacagtctgacttccagttgggtcctccacagagggggcacagcctggtgggcttacctgggtttgggcattgtctggaccagtggccttcattgccacacttgaaacaggcaccaggtggaggtggattgctaggaggcttctgtgtggagctgcggcccccgtgggcccacagagcccctgatggcagaggcaagcatttgaaactctgcctgttttttgccttttacttttctcatcacgattgttaaggactttgaaggctaaattaagaaggtctcgtgtggtttgaaggctgtcgtcaagcttctgaagcttgcgccaaatactgggggtggattgggagatgaactgaaggtttaagatagtggttccttctgggctgtctgggtctaggttggtatactttctcatggcttcagttaaacgagacagaaaagggctgggtttttgtcgggaccttgggtgatttctgaaagcttttcatggttgactgctttatgagcaccctttttgagtcctgtaaggagacacacaatcatgtggtcttgatggcggcgtccaggggccctgtcttgataatcccagtggggggcctggttggggactgcctctgtgtcactaggctgggcaggagcttggtgatgaattgtatcagcatgcgcctgagctagggtccagatacggtcccagtcttctggggtgagggtggaagagaggataacatagaggtcatgccaggttagttcataagactgggtgaggtactgaaactctctaatataagaggtaggatcttctggaaatgaaccgagtcttttgttaatttgagagagatcagtgagggggaagggaacatgaactctaacaatatctttagttcctgctacttcccaaagtgggcactctagcacaggcgctgaagtaagcgtggggcatgggccaaagatggcacctgagcgagtatgggaaggagagaaggaagagcctggaagtggttcctgctgagggtttgaatggggaaaggggggttgagttaacaggcagtggaagataggggcgtaaggtggcgggatgaatttgcaagcctcaggagagggcgctgggggaggacaatgggtacaggcaattctagaattgtcctgaggaggggacggtgtagaaaaagaagtgaatacagctgactgggaagatggcagctgggaagatggcggctgagaagctaaagaggaggcttgggggttaaagaagatggttgagaggggagaggtaggggctgggagaggtagacagcagactgctggatcaaacaaggaaaaagaggtggggtggggaggaggaaggcgatctgggtggtgagaatggaggagaatgatttgaacaggtgagcaagaattgcagaggtcaggttgtgatctgagtgcaaaaaggcctggacataaggaatttctccccatttctccagttgtcggcaataattgcttaaattagttaaaattataaagtcgaatgttccatttgtgggccatttggacctgttatgtaattcgtactgtggccagattgaattgcaaaaaaagacaaggcgcttagggcggatatcttgcatgaggcctaaggtctgcaggttttttatgaggcagtctagaggctgccttttggaatggaagactgggaatttcccataacggagggtaggctcgggagaacagggaaaaggagaccatcctggacggccggagggagatgataaaaggagcgatcgtcactgctgcctttttcaaggccttgttcatgttcccttccccctcactgatctctcccaaattaacaagacttggttcatttccagaagaccctacctcttatattagagagtttcagtgcctcacccagtcttatgaactaacctggcatgacctctatgttatcctctcttccaccctcaccccagaagactgggaccgtatctggaccctagctcaggcgcatgctgatacaattcatcaccaagctcctgcccagcctagtgacacagaggcagtccccaaccaggcttagaggcatccccctaagaccagatgatcagtgagtgcctggcacatgccagagccttcttggaccaacattggatctttggattggagaaaccaagagaggccacgtggatttttctctgttaacccggctcctgggaaatttatcagtagatgagatcagtgactggtgtgcatgcacagagaggtgactggaggctgaggagcttcctttgtccggttgctgtggactaccgtccagggtggaaggacacaagggacgcggaccggggccccttccagatttcggcaccagatgtaaggctcttgtatcagtttgaaccccgagagcgcgccaatgaacaccacaaggcggtgtggagcaacgcgctgttttaatgtgtgcctgggtgcagatgggctgagacctaaaatggcatcagcaccaaatgagaccgggcaggggttttatagtctcctgtaaacaggaagtgcctcagtctgatgtaactgctacagggtacccggacggcctctctctcagccttcagggggtacgtgtcttctgccggccgtctctcttcctgcttctgctgtcttgctgatgcacgctgctggcgcaagtgttcttgcgccttgggactgggcctgagaagggatgagttattcaccccctcaccctcttcccgcccagcttccaggcctcagggaaagtctttcaagaatgtgttggagaactgttccagtgagcacagggctagggtaggaggatgaatgttggttcctcagggcagggtacctttcacagctgtatgtggaaggaagtgagggaggcctccaaactgaggatgggggttggcaggtggacagaaggtactggttctaggaataagctacccactgaatgggagttcctagattggggttcttcctggctgccttggagttcttccatcatatctttgtaattgcttctttcctttgcatccagggaagcttttgcaaatggattgtgtttaattttcagctgtgagctcttcattctgataagctgtcacagttatttatgaactaggtctcggaaagcaatggctagtgatcatgtgttgtggacaccccactctcactatgtgaattcgaggctggtgcttattaaggagtttgacataatcaggccccctctgtgtagctagttgttgatcttgactttgctgagggagatggacaccttcatctagtagggccctgagttgggggaattgggctggatgggcacacacctgagcacctgcagctcaggcttgccctctggcacccattcctggttcccactcctggttttcttccagcgcttactgtgggcctccatgaagtccagcaagaaggagtacatggctcttaaagccaggccagacatgcttggcactggaaacaacttcctggcattcctggtggtgatcatgtcattggtgagctccttgaagcatagccacaacttgctctcctccaggcctatgtgccactttcactctacatggtcacccttctcaatgcctggcttgttgctcacgcttcatggctctcagcaggtggtccactcggtactgcaggctcttcgatgcacactcttaccagtgctgtgggagctcattctcctgcctgcctcccccgcacccccactttcttctaagccccaacttgctacttgagaaccatctttacctctccaagacctatgaaggtgcctgggtccctgtatagacttggaggagggtaaggacggagatctggtcaggaaaggcactggtggtaagggggaaggttatcatacttgaactcctgaaaggcatgactagggcagacctcttgctcttttgtttttgcatcccctgttttttggcaggtgtttcccaggtgtattagtccattttcacactgctgtaaagatactacctgtggctgggtgattcataaacaaaagaggtttaattgactcatagttctgcctggctagagaggcctcaggaaacttacaatcatggcagaaggtaaaagggaagcaaggacattcttcacatggtggcaggagagggagagagcacacaggggaaactgccacttttgaagtatcagatctcatgagaactccctcactatcaagagaacagcatgggaaaactgcccccacgatccagtcacctcccaccaggtacaatttgagatgagatttgggtgagaacacagagtcaaaccatatcaccaggatcacagaagtagtggaagtggataactagaaggaaaagggcaaaaatcccttgcttatctgggtgccatctttctcttggcccttgatgctttccagatgtgacatgcttacatatgtcttctctctcctgagctacacttctgcatctttggaggcctctcacttgggatgtctctgctttacccttctttgaatttatcctgagctcctgctcctggaggttgaccccacaacctgttattgagtcagcccttttaggccgggtcacacacgatgtctcaaggctgggttaccctttgcagtgtgcactcagatcctgggcaactcacatcgttatgcaaagggtagcctgctgcacaccctctgcactctacttttgcacactggttccaaccaactcttcagtgagaagcagaacccaagctctgtgttcataggcacccagattccagaggacatctgtcattttctctcatgaactgtccctggatgtagttcaatgacattcagcccatggagcctgcagtctctcccagcctcagtgagcagttttctgggagccctccaactctcccacccaccactgcacttaatgagtatgtaggaggtgttggggggtgaggtgacagagaagcactctagagaggagtgaaatactatagcccactcttactgggtctttccaaccgcctcttaagattagtaaggttgaatggggtacaaaggtgagagtctaggggcctttagttttccccttggaaagccttggaggggaattcattccatgtcctgttataattatctggagaggtcagctctacattcaattgaacctgtgagtggatttggcaactgtcttgagcttagccctggttgccataactcattaagtttctcacaagcatttactatgttaacagaacgctgggaatggggtgtgggggcgggcggagaagaagaagacattcacagttaacacctctgatgacatctctgatagcaaatagatactattacaagactctatccacccaagagctaaatcgttagtcacagatgcaaagtgctgtgtggtcttgagtaagcctctcagttttcccatctataaatctagagtagcagtgcagatttacttggcaaggtttttctgaggattaaagtaccctaaatcatgtaattaaaatgaacataaagtattttccaaatttgaagagccatggaaatgagaaaaataattactaagagacccagtgaggggctatgtttgaactgttggccattccttgggcagtagtaatttcctggcaggaactggcctgggagggcccttgacagatgttgcacagaactagtttaagaagggctgactggcatgtggtttttattttatctttgtaaagctacagtgtgaggcctgtgacagcaggaggaggccgtgaggtattcacttgacagcctgccattgtcaactctaatgggagagaaacttcagtggctagaagggcagcctcaggttgtaagcgattcatttttagttcagctgcaataactcctgctggtgatttaatcctgtgacttaggaactcttcgtgtgtgcttgagtgaatgaataaaagagagacagagtgagagagagagagagtgtgtgtgtgtgcacgtgtgcacacatgcacacacattcatgtgaacaatttctattcactcacttgtgattaccaatgggccacattctatttaggttttggaggcttggcatgaagcatgttttgctaggatgatttgttttttggacaaggaagctaacatggtaagtcatatgataatttagtttatgtcttcattgttgcagagtttggctgatagcaagggcagtcgagaatgatagtctcatatagaccttaatcccagctcctaaagtagaatggaattgtggaaatcaagttttctggtctaaaataaatgttttgtggcattcttataaaaggaacaggttgaaaagtccctgtggaatcttaattttgccactgcagattattgaagaccccaggtgagcaaatcaactgtgaggaggtgatttttatcagttggcattgaacagaccacagcatagctatcacctgcatggccttcctttgcctttgatgatcgtgtgtgtcagtgggatggaggattttttttgttttgttttgagacagagtctccctctctcgcccaggctggagtacagtggcatgatctcggctaactgcaacttccacctcccaggttcacgtgattctcctgcctcagcctcccgagtagctgagattacaggcgtgtaccacaatgcatggctaatttttctatttttagtagagaaggggttttgccatgttggccgggctggtctcgaactcctgacctcaggtgatccttggcctcctgaagtgctgggattacaggcatgagccactgcacctggctgggatggaggattttaaaaggagttgtattgcctttttgaaaaaaaaatctagaggcaccccccccccccgcttttataatgacccttttgactgaaactttatcttaaaaattccaggataagggataaattagccagttgaatgtgatttccatgtgctataaattttcatattctcccaaaattcctttctcaatgcgatggcatttgggagtggggccttttggaggtaattaggtcatgagggcagaactctgatgaatgtgattaaaggccttataaaagaggttccacagagatccctcatcccttctaccatgtgaggtcacagggagaaagcactgtctgtgaaccagaagatgggttttcactagacaccaaatctaccagagctttgatcttggactttccagcctctagaactgtgagaaatcatttctgttgtttataaaccattcagtttataatattttgttatagaagccctgttggactaagataccatgaatctagagatattttgcatattttattcaccgctgtatccctaggccctagatatgacctgacatttatttaaggtgctcaataaatatttgtttgatgaatgaatcaatcgaaaaagggctataacctcctattaggagtgatctctgggtattggctcatgcttgccttttgggatcatttgcatggatgtcataagtgctaaaatcttaagccacgagaaatatggagcttgtttccaccgcagtgattttctgtgaaatcactacccaaagatttttcacgctttccaaaaatattttttgaatgaacacatgtcatgggtggggaagttttcctcttattgggcagatatttattttcttatttcatgcagatgcccctgtgatgttaacttaaccctactactgggttttccatttttttgcatttgaatcatactcaaacccatgccagagaacaatgcagttcagctttctgatgaccatgtacagtttttgcaaggtggtctatcttgtccctttttaaactgaggactaatttagtataaaagatcatttagagaacctattccatctattctagctttgccagcatgcacagaaacacccaatgccacaaaatcactgaaatgagactcacacaccaggattaagggaagatgatgcttttgatgaaacattagtgaacaaatagaattttagaatcaatgataatctctgcctcattatgtaatttaagccccttgatttgtacctgaggaaaccaaagccctgtggagcacagactaaggacgtataagaactggagttaagacttatgccctctgactgacagtaaattctttccatagtactgtcacagcatgccacagggaacaagtgtctttttatcttttaataactgtatcgaatgcttaaggccagaaagaagagtatagatgttaacagatatttgcactgtaccagctcccagccacctgaaagagcttgatgggtcggcatcagtgagtcttggagagtacatgaagacccgttgctcacagggtgtgaactgggagttggaggcagtctggtgcaggtggaaaggcattgaactggggtggagtgaggaagcttaggttctgattctgatcgagccattgccatgctatatatattttaccttgtttagtcctaattaccatcctactaggtagggatggttattcttattttaggaatgaggaaaccggggcttagaaaggttaggaaacttttttaaattaaggttatacaggctaataagtggcagagcttcatttgaaccccagcctatataatactacccaaaagttactgcccagtttccctctctgagcctcattgaaaagaaaatgtttggatgatctctgacattccttccaggtcacaaattctacatttgatcttgttttttttgttttttttagtgatgtttggctttgaagatttagtccaccccctttcctccctcgttgttggtgaactgattgttacacaaccaacctcacctcattgttggtgaactgattgttggtgaactgattgttatatatggtgaactgattgttatatagattttcacacgtctgtctcccaggatagtgtgctaagaggaccattggagactgtagaagtttgtttcttttaggtgtaagccttgtttctcagggtactatgctttcactagcatcttaaataattaggtgacagagactattaacactttattttcacataacaccaagtaactaagaattgctattattttgccaattagcccatgcaatccttagctcataaaccaaactattatcttcagatacatattagtctcgattacccagagaaacagaaccaattggagacctatatctatatctatacctgtatctttctataactatacatgtagaaagggagggagggagggagggaacgatggagaaagaaactataaggaattggctcatgtggttatggaggctgagaagtcctagaatctgcagttggcaagctggagactcaggagagctgatgttgtagttctagtgcaactctgaaggtctgagaaccagtagagctgatagtgtaagttctagtctgaggagaggactgaagacagaagactaatgttccagctcaaagacaatgaatgaattggatgaggctcacccacattggggtgggcaatctgctttactcattctgccaattcaaatgttaatcttatctagaaacactctcacagacatactcagaacaatgttaaaccaactatccggataccacattgcccagccaagttgacaaataagttaaccattacaatatactagaactattatgtttttacacttcaagaggtgttgaagtgactcagtcgatctaaggggaaaaggtgatatgctattaaaaatataaacacagataaaaactgtatgttttagttagggtaagctaactgttataacaaatagactccaaaatttctactggcttaatcataaaagaagtttatttcttgcttgttacaaagtactgatcaagttaccaggtcagcagagtccctgctaaaagaggcctcttcatctttaatatgtagcttctgaagtcagcccaaatgttgtcttcatctcaaccagctgggaggagaaaagagcatggagaagtgccacatgggaggattttatgagctaggccaggaatggcccaagtcttttctgtcacattcttttgcatggaactcagtcacatggctgcacctaactgtttgggggcggctgaaaaatgtagtccctggctgggcagcccatatcccagcatgtccactgtaccctgtataaagaatcagaagatctgaattctggaattggctttcctattaactggctggtgatcttttcttgtctgtaaaatgtaaaagcttgttgatatcccaaataccttcttgctctagaattctgtgtctctgttttgctctttaaaagaaaatgttctgtgtgaagacagctagttctttgcctggatgcagtgaaggtcctggttcatgcagcaaactttgtctcatgtaggacttaatactggcaaatcagggagccaagtctgggggctcttttgatcctgtactggataaattattattcactgggcatagtaagcattgattcatgggtggcagtttactgtattttaggggtcttctaagtggtgtgtgcccctggcccacatgaagatttttccaaagggttaggtgttacagccagcatttttagaggatcagttatctttaatttttatatgtacctactcctaaactgatcaaagaacatctgcaatgaaagaattttgttagttcttctttcccacctctttcacagttgcccttctctacctttacaaatgaaagtctactgcttactcagcctgcatcttgcatagttcattgttccaagtgtagaaacctctagggcaccaaagtgattttttaaaatatgtgtcacttatattcaagatattaaacatactttctccatctggcacattaaagagtatatttataataaaagttttgctttttatgtttagtaataatttatgaaaagtatatgtatttatgttgttttgatcaattatgtaccactcataattgagaatacagctcagtaaaacattatttaacttatagcctgatagtgacagaaacttaaaaaatattttttatttatatttggtacttttaaatttaaaactattttgccctaagagaaaattctatagcaaaggtgaaacagaaatacaatttcaagaagctaaaggagtgactgtgtgtactcgggtgatgattgagatagattccgcccttgtggctgataaactagtggaggaggcataaacaagtaaattagcaaaagtgcaagataattttagaccatgataaatgctatgaagaaggtaagcaggagggtggtcaaagaaagcctctcagaggaagtggcatttggtatgagcacagaagaagtcttctctcctcttgagcaaatacatcctctcaggttggggcatggatatggtggaagggaagcagagcttatttctgttaaaaagagcttgttcatggctgggtgcggtggctcacgcctgtaattccagcactttgggaggctgagacaggtggatcacgaggtcaggagatggagaccatcctggctaacacggtgaaaccctatctctactaaaaatacaaaaaatcagctgggcatggtggcacacgtctgtagtcccagctacttgggaggctgaggcaggagaatcgcttgaacctggaaggtgaaggttgctagtgccactctactccatcctgggcgacagagggagacttggtctcaaaaaaaaaaaaaaaagagagagagagagagcttgtttatgtatattttaaatggatgctgatggagatcaaattgctttggtatttatattcccactggatacatttaaaggaatgacataagtttgtgatatttaaactatttcaatagtcaccatacactagaaattatatcatttgcaaatatttaaacttacaatgaaaactttttcatatcaacctaaaatgaacaagtggtaaatagtttattaaaatgtttttggggatacatgagcaaaggactttcaaaaccactggcatagtagcttagaatatgggctttgagtttaggctgcttaagttggaatcctggatccactactactggtcgtgtgatgaagagtcagttctgtgagcaacagcatctgaatctgtaaaacagaactgtaatcccagcactttgggaggctgaggtgggtggatcacaaggtcaggagttcgagaccagcctgaccaacatggtgaaacccccgtctctactaaaaaaaaaactacccgggcatggtggcacattactgtaatcccagctacacaggaggctgaggcaggagaatcgcttgaacctgggaggtggaggttgcagtgagccgagatcttgccacttcactccagcctgggcaacagagtgagactctgtctaaaaaaaacaaaacaaaacaaaaaaacgaaaacgaacaaacacaaaaagcacctaagaaggaggaaatttgaagtttacatgagataatgcatgtcaagtgctaatctcacaataagggctgaacaatgttttctatattatcaacattataactttgctctcaactgtatagtgctgattgaactctattatctttcatatggttgcagagcaggctgaaaggtaaattgtgaaatctagccctttgctgaactggagtagcacttaggggcaaactacactattcatttcattctttcctacttgctttatgtgttattgattgatattcattcattcattgatagtccaagttgagtatgttttgagacacttactgagcagtcctgcaccttgactacagtgtggtctcttctcctccttgtagttcattgaagtcattccaaggaaattacagattttccttctctccctgtgcacgtgtacctctagagtgtagggagatgcaatcttgagaagagtacttggtttctccctgaggacaagctgatggcactggctctgtctcctgatgtccttgctgtggcttcctcctttgttctgctaaggccttagggcctttgtgtgacacagctggggattactaggaagaagtaaatatttgcaaagggtgttctgtagaatgttaaaaaaaaatagaaaaaaattaaaggccaggtgcagtggctcctgcctacaatcccagcactttgggaggccgaggcagatggatcacctgaggtcaggagtttgagaccagcctggccaacatgggtgaaaccccgtccctataaaaatacaaaaattagctgggcatggtggcgcatgcctgtaattccagctactcagggggctgaggcaggagaattgcttgaaccctggaggcagaggttgcagtgagccgggattgtgccactgcactccagcctaggcaacaaagtgagactccatctcaaaaaaaatgaaaaaaaaattgcaaaggaaaggggaccttgggagcaagttaacatggtctggtgaggtgaagagaaaagctgaatgaaggtggcattagaaggagagaggatttaaaattattgagggaagtatgattaaagaaactggaagatgaaggtaaaggatggtagaaaaattagcgttaaaaaaatagagtctgccaaaagcaaaagtaaggattcattaagatacatagcagaaggaaaattgtgaaatgaagtaaaggaaaaatacaactgatgaatcaccagggagttatagcaaggccttaaaaatcattaatggaaagtttaatgccaaaatattagagtaaaaagatagcttgaaagtacacagcttgtctgtgcctggctcctaaaaaacaccacagaacggccaatcctttgcctctggcacccacacagcatgcatgccctgaagtgaaatctttcataccgtccctatactccctcttcacacacaagctttgttaccattctttttatttcattcccactggtccaaaactgtatatgcaacctataagaactgacccagcggtgctgccaatgtgcaaagacctgcatccatgggctgcctacttctggcaaaggatcagtttgcttaagttgtccacttcccttgtcatactactgacttgtcaatattacaagtgtttattgacagtcttccttctttcagctgaaggcctttcaagttagggactgtggctcttttgcttattgtagtagtcctggaacctaatgtgtggagaatggattagatggggagagagtaggagtttacctactaccagggtaagaagtagttttggtgagttaagggtgacttggtttagggagttggaagctgcggcataggaaaatgtctgtttgagacttttaggagatatgttttgatgaaagaaaaggacttggtaattgattggatgtgggtactgagcaagggaaagtgtcaaggatgacttggagagagctctgattgggtggtggtataattgagtataacagagaacactggacgaggatcaagtttgcgagggaaataaaaaacccctgagatatcctggtggaaatgttgagttggcagttggatgtatggagctgaaagtgatgtcctttcactcccatttctctagacttgacttacttcctgatcccagatctctgtttccaaccaattattgaacatattatctggaaaaaccacaggctgctcattctcagcatgactaaaactcacctaatcatattcctctgtgtagcctggtttccttcttaaaatcttagtcattcagtgggaattttattttcctgtttcctctgtctctacctgacctgcaaatccattccacccttgtcatgtaagtctttttgatctatacgtctaactcttattttcatttccactgccattgttccactcccactgcctgatgctcattttacccctgcctattataatagcttccaaatttgtctccctgaaactgtgatttcttaacttcaagcacacgtccttattcacactgggtgcaatctttcaaaggctcaatagtaagtatgagttttaaccccacagtatgttagaaaacgcctttccccttctgtcctctgcatacctcaccaatcttgtcttctttgctcaaccaatctgtaatcagatctttggataacctgctattatacaaatgcgcactctaatttaggcacccttgtgcctgttgtttcctctcttcaggatgaagtttcttcacctttggccaccttggatactgttttcttagcttggaatgtgttttcctcacttcattcaaaggaccagcttaaacatcacctcctcatagagacctacactgtgcctgtgtcttggtttagctcccttgcctacttttactttaagacacttatcacaatgatgatggtattatttatgtgatcatttatgtaatgactatctctgtcactagattaaagacctcatagggtcagggtctgtgactatttcattcaccattgtgattcagcatctgtggattgcagttgcaagcatggatagggatgaaattagtcaaagagaaaatttggagtgaggaaagaaagtcaagacagaacactagggaataccaatatttatggagctggacatgaaggcagatcccacagagaagtctgtggaggagcactggagaaggtaagagaacagggcagaacagtgtcatggaagtcaatgatggagaggattccaagaagaaggagagaacacttaatagtctgggaccaaaaaaaaaaaaaaagataaatgaacttgaaggcatagcaatagaacctatccaaaatgaagcttacacacagagataaaaaagaccaagaaaaataagagagacctggaggcaataacatgttgactgacatatgtaaatgggaggcttcagaagagaagagagtaaaagagaacagagataatatttaaagaaataatgaccaaacatctttcatattttatgaaaggtataaactcacagagctaagaaactcggaacatgaagcaagatacctactagggaaaccacaccaagaacttcattatcaaattacagcaagttactaattctgacaaaaatcttaaaattagagaaaaaagggcacattccatacagggaacaacataaaaataattacaacagagttttcggaaactatgcatgtcagaagacaatggagtaacatctttaaaatgctggaacaaattttgtcaatctaaaattctagacccagagaaaacacctttcaaacatgaaacatgtctttccttagacaaagaaaagttgtgagagttggccagcacacctgcagtacaaggcttgttaaaggaagttcttcaggcagaaggaaaatgatacctgatgataatgtggatctacacaaaagaataaagagctctgaaagtgataaatatgtgggtaaactaatttcatcatttaaaaaattttaaaaaggcaacagtagactgcttaaaacaacaaacagcagcaacaatatattgggggaattcatgacatgagaaagtaaaatacatgacaacaatagcacaaagggcattgggggggaaatggaagcacaccaatgcaaaattcttgtattttatgtaaaatattgtaatgtttttccaaggtagacaaataagataaagatgcgtattaaaagccctagatgaatcattaaaaaataaagtatagccaataaaccaatagtattgagaaaatggaatttaaaaatactcagctagcaggaggcagagcaagatggctgaatagaagccttcaaccaattgtcctccttgcaggaacaccaaatttaacaactatctacccacataaaaaaacaccttcgtaaggactgaaaatcagttgagtgaccactgtacctggttttaacttcatgtcactgaaagaggcactgaagaggataggaaaaacagtcttgatttgtcagtgccatccctctctggttccctggcagtggccgcatagcaaagagaatctgtgctcttgcgggagggagagtacagtgactgtgggaccttgcattggaactcagtgctgctctgtcacagtggaaacaatactgggcagaactcagccagtgcacgtggaggaagcatttagaccagccctagccagcagggctttatccatcctagcagtgggaacttgagttctggcaagcctccccaccacaggctaaagtgctctggggttctaaataaacttgaaaggcaatctaggccataaggactgcaactcctaggcaatcctagtgctgggctcagagccagtggattttgagggcatgcaacctagagagacaccagctggaatggccaagagagtgcttatgccactccttccccaaacccacgcagtgcagctcacagctccaaaaaagactccttctttctgcttgaagaaaggagagggaagagtaaagaggactttgtcttgcaacttggataccagctcagtcacagtaggatagggcattaggcagagttatgaagcccctatcccaggccctagctcccagataacattactagacacaccctgggccagaagcaaactcattgccttgaagggaagagcccagtcctggcaagattcatcatttgctagcaaaagagctcttgaacccaaaataatcagcagtggtaggtgggtagtacatgccatgggtcttgggtgagactctgagatgtgctggcttcaggtgtgacacagcacattcccagctgtggtggctatgaggagagactgtttctgcttgagaaaagcagagggaagagtaaaggagacttcatcttgcagcttaggtaccagctcagccacagcagggtagagcactaagtgggctcttggggtccccagttccaagccctggctcttggacagcatttctggacgtcccctaggccagaggggagcccacttccctgacatatgagtcctaagcctggcaacattcaccacaagctgactggagatcccttgggccttaagtgaacatcagcagtagcctggcagtactcctcacaggcctgtagcagtggtcaccatgaagagagactcctctgcttgtggaagggggagggaggagtatgagggactttatattgtagtttgggtgtcagcacagcagcagtagaatagagcaccagggagattcctaagatttccaactctaggccctggctcctggatggtatctctggacctgcctggggcctggggggagcttgccatccttaagcgaaggacatgagcatggctgttttcaccacctgctaattatagaaccttagggccttgagtgaacacaggcagtaggcagatagtggttatagcaggctttgagcgaggcccagagctctgctggcttcaggtctaacctagcacagtcccagtggtagtggccacaggggtggttgtgtcatctctcccccagctctaggcaccacaacacacacacacacacacggagggaagaggaggaggaggagagagaaagaaacggactctgtttctttgggagaaagtaagggaagagaataagagtctctacctggtaatctggagaattcttccaaatcttatccaagatcatcaaggcggtacctctataagtctgcaagagccacagcgttactgagctcgaggtgtccccctaatgcagatacagctgcagtgaccaaaaactcagatgacaatatccaagttcctttgaatacctggtaagctttcccaggaaggatggtgtattagtctgttctcacactgctataaagaactgcccaagactcagtaatttataaaggaaagaggtttaattgacggttctgcatgtcttgggaggcctcaggaaacttacaatcatggcagaaggggaggcaaatgcatccttcacatgatggcaggaagaattgctgagccaaggctgaacttttaaaaacccaattatgtgtagtctataaaaatttatttaaataaaaatacacaaaagagaaaagctgggaaaagataaagctgttttagttatattaatagccaaaaaaaataagaactattaccagggataaagaggaatatttcacaatgatggagtcaatgaatcaataaggcataacattcctaaatgtgtattcaccttataactaaacctcaaaattcattaagcacttgacagatctggaaagataaaaagataaatctacaattataattgcaaatttcaccactccttttagtaattaatagaacaagtcaacaaatagaaatatggaagaattaaactaatcatcaacttgaactaattgacatttttaagaacatgtcacttaacaaatgcaaaatatacattcttttctagtgcagtggagcatttaccaagatagaccacatgcttagccattaaacaagtctccagaaatttaaaaggattgatatgatatagagtatgttttctgactacaagggaataaattagaaataagcaatagaaagatacatagaaaatctcaaaatacttggaaattaaatagcatacattgaagtaattaatggtttaaagatgaaataaaaaggaaagtagaaaatatttgggggtaaatgaaaagaagacacacatatcaaaatttgtgaaatgcagcctaaagggaaatttataggcttaaaagcttaattagaaaagaagaaaactctataagcaacaggccaagcttccatcataagctagaaatataagagcaaattaaaccccaaactagtaggaaacaaatagtaaagaagagaaataaatgaaatagagaaacagtgaagaacaatgaaatcaaaatctgattctttgaaagatcagtataatagataaactgctggctatattgatcaaaaaaacaaaaaggatgacaaatattaccaatatagataatgaaaaaggggacatctctaagattctttatatactaaatgtctataattaagggaatattataaaaaaacttgatgttaataaattaaacaaccttgatgaaatggacaaattccttgaaagacacaatcaaaactaactcaagaatcaacagaaaacctgaatatcaattaagcacattaatttgtaattagaaatctttccataaaaaaatgtataggcccagatttattacctggtcaattctattaccgggtcagtttattacctagtcaattctatcagacattcaaggtagaaatataagtgacaatcccttatccaaaacgcttgggaccagaaggactttagatttttgattttggaatgcttccattatacttaccagtggagcatcccaaatccaaaaatttgaagtctgaaatgctccaatgagcatgttctgtgagcaccatgttgttactcaaaaagttttagattttgaagcatttcctattgctgatttttggatttggaatgttcaacctataccactatatgaatttgttttgaaaatataggagaaatacttttattttatatggtcagcacttttctgatctcaaaaccagaccaaaaatattgcaaataaagacaactacagaataaaattacttatgaacatggaccaacaatcttcaacaaaagatgtgcaaactgaaaatgaaatatataaaaaacgtaatacatgataatcaaataatgtttatcctaggaatacaaggttgcttaacattacaaaattaatgaatgtagttcatcttattgtcataatgggacaaaaaccatatcatcatttcaataaatgcagaaaagccacttgataaaattaacatccattacatattatcatattgtaccataatcatcttccagtaaactaagaatagaaaggaacctcctcaatctcataaaaggctgatgatgacacatttctatgaatatactaaaaactaccaaattttacactttaagtgtttgaattttatggtatgtgaattattaaactgttttttttaaaaaacctgttgctgacttagtatttaacctgagtgcttttgccctaagatcaagtagacaaggatggtcactctctccacttttcaacattctattgaagactcttgccagtgcagtaagacgaggaagaaaaataagaggcacataggttagagagctacaagtaaaactgtctttattcacagatgacatgatcaagcatgcagcaaacagcaaatcttcatgaatctaccaaaaactagtagaactaataagtgattttagtaagatttcaggatgcaaaattaattgcatttctatatattagcaataaacagatggaaattttaaaaaggacaatattatttgcaatagcatctcaaagcatgaaatacgtgagtatgatgattaattttgtgtattagcttgactgggctatagggggcccaggtgtttggttaaacattacttttgggtatgtctatgaaagtatttctagatgagattaacatttgaatgggtagactgagtaaaacaggttgccttccccagtgtatatgggcctcatctaatccaattcattgggagcctgaatagaacaaaaagcagggaaagggagaatttcctctctctgtttttaagctgggacattggtctcctgcagtcagactggaacttataccattggctcctaggtctttggacttgaactggaacgtatatcatcagttctactgattctcaagcctttggacttggagtagaatttacattgttggttcttctggttcttaggtgtaaggacttgaactggaagttcaccatcagctctcctgtgtttccagcttgcagatggcagatggtctgacttctcagcctccataattacattagccaattccatacatatatagccaatttatatacatatatagttggttctgctcctctggagaaccctgaccactccaaaggggttaaattaaataaagtatatgttaaaacccctaccctgaaaactggaaacatttctatgtgaaatttaagaatatgtaaatgtattgatttatgatgtttatagattggaagacctgaaattgtgatttcagttcctcgaattgatttatagatttgatgacattccaataaaaatccagattttcttatagaaatgttcaagccatttctaaaacctaaatgcttagaataaccaaaacaattttgagaaagaacaaagttagaacacttaaacttactggctttaacacttactgtaaagatacagcaatcaagttggtgtgttattggcatagttttgacacatagatcaattaaacacaatcgagaacccagaaatagacgagcatgtgtatggccaattgatttctgacaaagatgccaaggtaattcaatatggaaaggaataccttttcaacaaatggtcttgaacaacttgttatccacatttaaataaattaacatcaacccttactttatggtacacaactggataatcttaaatgtaaatgctaaaactatacaacttctggaagaaactttataaccttcacgtaggcaaagatttcttaaacaggacacaaaatagcataaacataaaaagtataaaaaatttataaattgggctacatcaaaatttaaaacccgtttataagaaaatgcaaatgcaaaggtagacctcagacagataaaatatatatgtgtgtgtgtgtgtgtgtgtgtatactattttatattataaggactgatatctagaatatataaagaagtctttcaactcactgatagaaccaattataaagtcaataaaatggacacatttgaacaaactttaccaaagaagatacacagatagccaatatatccatgactagatgctcaatatcattcatcattagggaaatgaaaattacaaccacaatgtgatatcactacacatccgttagaacattagagtggctaaaattaaaaggaccccaaatactaactgttgatgaggatatgaaaccactgagattttcctgcatacaccgcttatgggaatataaaattgtacaaccactttggaaaacagttttggcagtttcttataaagttaaacatagatttaccataagattcagcaattctactcttaggtgtttatccaagagaaatgaaagcatgtgtccacaaaaagagttgtacacaagtgttctttcactttatttaaagtaacccaaactggaaacaacacaaatgtccatcagcaggtgaatgtataaataaaatgtttaacaatggaatactacttagtactgaaaaggacaaactatttaaacatgtaccaacatagatgaatctcaaaataaatgtggtaagtgaaagaagaccgaaaaaaaagtaggtattgtatgatattcaatataaacctctagaaaagaaaaacttaacatatatttacagaaagcaggttcatggttgcccggggccagtgatagggtgagatcggctgggaaggggcttaagagaatgatcttttgaagtaatggaaatgttctaatcttgactttagcagtggtaacatgggtgtatactatttgtcaaaagtcatagaatatacccttaacatgagatatgtaaactatccctcattaaaattgtgcttgtatgtagtagttgctgtttttgaggggcaacatcttggagtcagtaaagggaaacattataaaggtgttgacaatttctccatagtataaagcctgttccatattgggcactgtgtcaggcattcctgtgactcttggctgtaatacaaagcaacttcccacttaaatactggctaagaccaagagccagggttccctcctagaagtcccaagctggacccagaggaaggtgctaacatggtgtgtttcggccacaggtctctttcagaggaccacaaaactcactacctcccctctctgagataatggagtgagtgtgttaggttggctcagtggctcagactaaagcgtcagggactcttatatttaaaattgatgtcactgctaatgtactgcttgaatgtatctaagcccctgcctttctatttcaatttcctctgtggttacaggaaaccaactatgacagtccattatacatggaaggctagtgttgccagattttaatttggagagtacagaacataattttgactaattggtccagtaggaactagagtagaatctaaacaactctggaggtctgtggcaatgaaacagggaaggagggagagatttaatcaaccttcacccaggcaggctgttgacagatttctaggctgacttaatcaatgtacttatttctcaggtaagacctcaaaactatttggatctaatttcactatacttcatcctgttcatgatattatgctttcaaagtaacaagcctcgaattccttttaagggcacacaaaagagtaaaacacactttctttttgtcccgtctgaagtggacaaatggagtgggtgcatagaagttgtaactctgagtccacttaagttttgcaagtgtataagtcatttttcagtacacaatgaagttaacaattaatatctttgtggtatccagaaacaatgtcaaccaaaattggagcaatgaacctgagaattgaattcacttgagctataaatcataaacccatcaatctctagagcagaagcaaaagtgaagtcattgaatattataatagattccatatgttgttttaaagaaggcttaaaaataactagacttacaggttaccatatttctgtggcaaaaatttacatatgtgaataagaagtgaaataactgactgtccaatttttgcttctgttttctgccacttctttttagtagtggaataattatttagctcttgaagggcagggcagaggaagtgtgataggcactagagaatgtggaggagctgataaaatagaatatgaagggaggtagaagaaactgactctcagctttggtagaaaaggtagcacagataaggaagcacaatttcagataaccctcttggcctttcccctgctaccttattacagagagttagtgtttctccttaagcattaaagttacaaagccaaatagtaacatggccacaattctgtgaaaattttgaaaggccatgacaaaatgaaaatgaaagctttgttctaagtcagacagatctgttttcaaatttggaccctgctctgtgaccttgggcaattcacttaatttctctgagcttcagtttcatctggatggggaattaatacttacctcaaagagctctcagtgtaatacacttgtgtatttctctcttctaacacctatcctgtcagtttgaaatataatctatcattttgaaatgtatctctttcttctcatacgattgtagacttcccaggaattgagattaagaactcccagctcaagggccaattagtggagaacacaggcttaacttatctttgtttcgccctgccccatacacacctcgcacaataattaggctatagctacgtaaaactttagggacttcttccttcctgtgacagcatggtgctaggtgagatttaaggaaactacacgtcatgtccctgcaaatttgccatcttgttatagtcagtcagattggcccactaaccctccagctagaaagtcaggaatgctaaatcttatatttgcatgattgctgttgtgctaaggtgtcagaacgcaagatacaatcttagttcaagtttacactttggtttatgggaaatagcaaggtcaatctgtggcaatgaaaaaaatggaaagtcctgtaaaagtttaaggagggaagaataaaaggaagagaaaagaaactgtaacccagttggaatgaaatggtaacatggaatgaaatgatcctctttccccccagacagatgttggcatggatttcatatggactctgaaactaaagccgacacccaaccgagtgctcaagccctacattccatccacccctcatttgttagtatcaaaattgaggcatttcacaaacttggctatcgaatactgtatgtgtgtggaaaagggccagataaaatgggccaattagaacacagccacatctgtcaaaactctaacccttaaccttagtgaaaatataatctaggatcaaacacagaagccccgcagatgtacacaagtcatttaatgcagcccttggaaagactgtgatgaacagctggtgctattgtgaaggcctgatgagaaagccaggcttggttttgctacgaatatttgcaattttaaagaaaaaaaataggttctaattgagtaaccattgaatgtatcccagtaaggtccttcccataggctgagttgaaaatactctgactccgttgctatgcaaagcagtttctaaacatgttttgaaaatccgtttgaaatttgagagtagaatttggttctcaaaggcttcatttaggcttaaaaccttttggttcactctaaaataatgcgagggtttcatccttaatggactatcgaggttaaattcaacagctgcttctcctctgatatatatttatgaatgcaggatgcattctatatggtacagtacaccctcacagagctctgagtaagaggaaaaaaacatggaaacaaatttttttttaatgttggagtgtccttacggggtttgctaaaggacaaatggggctctcattaaaaatagggattgtatcttcttgagtatacatggatcgtgaccaacacaacagtttttactgaatttactgataaaaatgtcactatgttatgtcaagctcaagtctttgggagggtttttcaggattctgtaagatatggctttgactttgtattcgcttttgggcaccaggtcatcagggaaaagtcacaagatctatgcaaaaggcagcgtcaggaagcagcatctctagtggtttccccttggtttcattgtccctgtgttcctgtgttcatctgggttattgagtctttgatcccacatgggaaaggtttgccatgttgagccagtagtagtataactcattctaactaaggcacatagcttctgccctctcccctgctggatgagtattggaccaattcctttgtccttagcaccacttacaaggatttatttccattccagaggatttattcccattcagagaaggaacaacatagttagataggaataaaaatgctactctgtgtataaagcttcttgcacctagctaatctagcaaactggtgttttggtcttcaacactaactagatcattattatgtgacactaattaaagggtcttctgtaatgggataaggtgttatctgatcaaatgaaggaggaatgatatttggcagtatatggtatatgtgaaaatcatggtgttcttgctacttagagactgtgagaagggataaggattggcttagagccagctcactctacatgctctcccagaagtgttttcttgaaagagtttttccccattgggaccttccattttcctctggcttagtaaagtgactgtaattaaatagattcaatttctgtttatggtgaagtaaaagattgagaacagattgctctttaacctgaaatgtggaagggctagtcgattcggaagctagttaaaatgattttgtgtattaactggtaaactcaacagattttttcccctgtgaatctaacatttctagatctttgcattcctcccgtgagaagtccacctctgaatcctttcgagagctcagattcctaggaactcagatttttgaacatctacatgatgttattttgtaagtggaacactgactattaaaggatagcagtggagtggagtggtgagggcacagctctgggtcaggataactggagagaaaccctaaggcttattccataatctctcttgatttgagcttctgaggataaactgaggcttgtaacatgctagcccagtatctggtgtagtaaatattgaatgcactgtggtggagagggttgtgttgtcaatgttgctgttgttattgttgagacctaaaggattgctatgatctaaatcagcttaatttccttcaacttgataaaaattagcctgtgactattgaactggatgatgctctcctaatggtttttgcattttgccttcattcagccagttaaagctggtgtttacagaattgtgaaacatttgagcctgggacagtcatgtgatttacagttttgtcttgtttcatgctttccagcaacataattactgaactttttatcgtaataaaaatataggcaataaaaaaggcagtcccctggaattccctctatctctcttagaatgctaaaggatatttttttgtgatctcagctctgttctgttaagtatcctctcccttccccacgtctgtctttgcagatttgtgaccagacggctgcactgaatggagactaggaagggagcccaactgttttccttgtgttggccctctgtgccgagcagggattgttgagcaaagcagggattgctgagcagcgtttctccagggagggtcacagggtagtacaaacccactctggatttttcttttttttttaattattaaaaactttggccaaatactatcagtaagggggagaaagtatgtggtttgaagaccagttggaccagtcttttaaaatatcaactggaataaagcaagaatgccttacacttctttaattttctacatttaacaggagacagttgctcccagagtcacttctaactccacagacagtattgtgcaaccttgctcagcatttggagacactatataattaaaattcctttgaaaatggttgcccaatgattgacatttattccaaaatacattatcatgttgaatgcttaattccttcttccagtacattttctttaataaaaaagtaaaaatctattttttaaaagggtgatggagttttgtaaaaaattgaagcagtgtaacaaacttatgtctaatcttgctcttaaagagctggcaggctagcaggggagaccagagtaagttatggaaagcaaaaaaagcaatactcaggatataactgagttgccttatatagatagacttgaaatgctgctgagattccaaagaggaagagataataggaatctgttgctctcttacctcctagtacattgactcatacctccacttcaaacacaagcaacatttagtattactacgaaattatctaatgggcttcctttctcagggcagtaggaatctgtctctctgctgtggctttctggagtccttcccttctgatgtctgtctgtgccccagtttccattttcatatggtcatctttgattctggatagctgcttctctctgtgttctcagaagaaatagactagtgagatcactgtcatgccccctccacaattaggaggctgtatcttgagaccttcttggatcccacaatttgtagatatcacaatagcaatcatggttagagaagtctaccaccaaaccaggagttagatgctaaggatgggtgagcatgtccaaatagcagctttaaaaagcctcagcacacttacaatagactacatgtcagagttttgggttatctctgaatagtcaaaaccccgatattatatacatgtatgtaaagaggctattttaatatcatactgtttgtttgacttttgagtagtgaatgcataatatgggaataagtacaatacgtgagtgaaacaccgaaatcacctttcactgttttgtttagtagtttggagccttcagttcttctggaaaaataattcaatgcacattagttttgctttctacatttgagggaggtgaatgctttacttttgtaactgtaagaggtctcagcagtcttgtagcctattcatattaaagataaggacactgaggccaagaaaggtgaaatggcttgcttaatggttacacagagaattaactgtagcttcatgattttaactcaggtcttgtgactagaatttcagtgcactttgcattaggcaattctgaacctttgagtaaaactaaaatgcaaagactgctcttgatagcattctaggtggaagagttgaagatagtaggatataaagataaacaaacctatcttatctggacaggacctcagctcattaggaagaggaatgaggaagagagaatgtaggaggaaagaaatggcagaaagacaaataatcatgggaagggactggaacagggtaaatgccagacattttcaagattagaagaaatctgagttgagtttgaaaaattgaaagatttcttcaggtagaagcaaaaggaaaataagcagaaatattatcacatataagggagtctgcagaggaagaagaaaagcatgaccctaatagataaagataagaagcaccaaatcatttcaataagtttctgaattttaaacactttcttttccttccaaaccatttaaagaggaggaggaggagaaaaaaataacgatttgtgagggatgtctcatatgctatttattataagaaggaaagtaaaattcaataaattacaaaatgatgtatcaaacaaagttcagcatggaggttaataaaataaatacagacttgagtggagttgtgtcctagcacttacttttaaagccatgtttcaaaaaaagggcatccatggaagtgatggataatttttatctgatagcaagaacagacactaataatggcaagttattgtgttcttagattgttattttaatacttaacgttttcaagattagcctctgagaagctgctcatttacttttggtgcataatgatcacttagggtatgaagccatcagctgcgccctttgttatgaccatggaaaatgttatgacctcctgtcaatgattattttggaaggaatagaagaaataagttatgattacatattatagatattataagcatagtgttagtaaatattttaaaaagaagactaggcacagtggctcatgcctgtaatcttagtactttgggagactgaggcaggaggatcacttgagcccaggtgagaccagcctgggcaacatagtgagattctatctctacaaaaaaaaaaaaaaaaatctttccatggctttctcatctgcagattgtttctcagtgtcaagcaagcacatctttcttccatcccacctgtcttccctgttttaattttatttctgtgcttcataaggttgaggcagtatgcaatcacaatccttttacaattacaaaaaaattcccaaacaattttcttttttaatttttgagaaaaattttgcttttatgctctctgatcagatttgcctttatatacatacaggttccttttttcaccccactcccaacttaaggctgattttaccatccagttgtttaaacaaaattctgttttgggtatcaggtgttttaaattaaaaattcttcaaaattgatttccaaaggagtccgtaaggcttacgatattttagaccaattcttaactagaacagaaaattttgccttttaggtttacagtgatttcatattatctgatgattctgttgaaggggcccattatttatggtatttgcctggaggttgtcttgtaagccttgactatgtgttttaagaaagaaggcaggctgagtgcggtggctcatgcctgtaatttcagcactttgggaggccgaggcaggcagatcacctgaggtcaggagttccagaccagcctggccaacatggcgaaaccccgtctctactaaaaaatacaaaaattagctggaggtggtggcagatgcctgtaatcccagctactcgggaggctgaggcatgagaatcgcttgaaccctggaggcagaggttgcagtaagctgagatcacgccactgcattccagcctgggcgacagagcaagactccgtctaaaaaaaaaaagaaagaaaaagaaagaagtcagcagttcaactataagatgcacagtatatcagaggtagtggaaagtctacatatgcctcctattttaattttaacaaaaaaatgactctgtcacatagacttctagctctttttagcggaataggtaggaaacctataatgcatgaattgtttaaagaaagtatcgaggctgggtgagatggctcatgcctgtaatcccagcactgtgggaggctgaggcaggtggataatttgaggccaagagttcaagaccagcctggccaacatggtaaaatctcgtctctgttaaaaatacaaaaattagctgggcgtggtggcaggcatctgtaatcccagttactcgggaagctgaggcaggagaattgcatgaacccgggaggcagaggttgcagtgagccaagactgcaccactgcactccagcctgggtgatagcacgagaccctgtctcaaaagaaaaaaagaaaagaataaagagagtatggaataaaatgctagatttgaagaggaaaaggacaggttggtagcaggactggctatataatttgtggggctcagtgcaaaatgaaaatagaagtccccttgttcaaaaattaagaagtttaaggtagcaacagcaaagcattaaaccaagcatgaggctcttctgagcatggggccctgtgtgacttcataggtcacacactcataaagctcaccctggtcagaagttgagatgtcagtaaaaaggaaaaggaatgatccattccctgtgatgttttcctacctctatgccatccttacctatgtactcatcaggtgtgaccatctctcaagggggcaccattgtgccagtgagctgaggcacagacactggctctagtctatggaggaaggagcatgagaaggaggttgcattctaccagcggcgggagagtaggatggagctgaaggctttctgaactgatctaggagagagagcatgaacttgggaactctgcaactttctagcagtgtagtaaagttatttaacctctctgaatcttattttttcattgccgtaaaatggtgatatctacctctcagggttactgtgtggattacagataatgtggaaaatgcctagcactgtggctggtatgcagtggaagctcaagatatattgtacatatggtcatttttgtaagtgcggagatacactgaggatgagtgaaaaagacttcaagtctcagatagggtggaggatctcagaatgcttgaagagccttgtaagaactggctgcctctcttgagtccctccttagttcctgagtgctttggaatcgtttaaaactcacaattgcatcttcttcccaaatagggtgaggagcaatctgtgggaagtcagtgcacagtagagttcagtcttccaacgctgaaaatttgccaactttcacccacactgtggagatgagaaagcagctgtgggcagacagtagagtaagctgtggggtctctggaacatgttacgcttacggatgttccattgttcccatgagattttgtactttgtctgttttatccaggtttgtttccataatatacgaaggagacagccaaaaccattttatgtagttttcctactttgttttgatttatttgttattatttacagtattatctccaataacaacaatggaatttcctttcctactaatctggcctgtttccattttgcctgtttattttaatttcctttttttggactgaaatctctacatgactctgatttgtttatttccttgcgtgtatgtgtcagcatcatttattagtgtgtccactcagaggaactttgttcattaattatgtaggttttgtttcctggttcctaatgggagggtattaagtgctctatgtttctaagtacttcacgatggttttggttatcagtttcttcatcactgctctctgcaagtagatgggcttactctccatggcttacagatggagcatgggaagccccagagcagagaagtaactcctctgcagatgatgattttcttaaatccgctgacccgtcacgcctgccactcgtatagatttcaatttccacttacttttatttgggtagtgggttaagtgagcataacacctgtgttttgcagacgtgattccttgaagacatttccatgaaaaccagcctgttgttaacgaatgagcaatatcgtcttgcattataagctgcttggggggtgtgtgatgaatgttagacttatcccttttttgtgaagaacttacagcccactaagtcaataaaaaagttaaaaggaagaggtaacctgacttttacatctgttacttgaatatataagatctgctgcctccttttcaatggattgtcatgatttactaaatgattgaattaatgattcataaaacatttatttagtacttactctgtgtgtgatactatctctagtctcaagatgcttataagactagaaggcgaaaatagaattgaaagcaaataaatataataaaatgttacaggtgacatgatagaagtttgtctagagtacatagaataacaaaggagggaggcctgtattctcttgggatggggattggagagaaggtgtcacaaacaaaggctataggcaccagatgtatctggggtccatagatactttcaaatggctgaaacagtggctgaggaggcagcagtgcatgcatgaggtgggagaagggaggtggagaaagccagacacaaagatccttggatgctgtgtgaaggaatttgggttttattctttaggaaaagttttaggtagatggaacatcagtaacagttttgctttttagaaaaattacaccaagaatagactcaaggagacttgaatggaggcaaggagactcttctgataatatggggctgagccaggcaagatatgatgagattctgagcaagccagtggtggatggaaagatgtcaaagaagtagaccttgtaaaattggtatcaatttttaaataatatcttacagtaactgttagcgaaaccaaggcccaagaaagtgcatagccagtgaatatcaaagggatcttcctctgccttcattgcagtttagaaacacaattattgtggcatttcagacactacgttgtaatacatcatattgttaatacttgtttacaatctttctgtcctgaggctctaagcttcttaaggttaacagccaaactactgaattatttgtgtatgcctagcatggagcctcatatacacaagtgcataatagatgtttgaagagtaaaactcttgacatcatagccagtgcttcttccacatggagcacttggcatgaaaatatgaaaacatcactcaggtttgcctgacagccacccatttccatcactccccctgagagcaccaaagccaagtgatgagcaggtataacaggcagatgatggcttgcactttgctttaaaatttgtatcagtttgccattatcagaatgcattcttacctcccaaagcctgcattaaaataccaataatgaatatttagaatataaaagtggccataaaagttgatgcctattatgatactgtctttaatggtctcactagtcagaagtcaagcatgataatttgcttcgatgtctcttttaatgttacccattgttttaacctggatcacactttattcttccacacagatccgtaatgcctcctgcctgcctctttcaagatggaggtgaaacctgtgggagaacctactcaagaggtgtctaaattcaaactttccaccaaggtagaaagcacgggacactggctggtggaagatcatgttcgaatatgggaagttttaaagacagaggaggtaagatgactctaaatgacacagttggtgaaatgttggatttgtttatacctgagaccataattcttcgtgtagccagcaccacaggccagcttggcaaatctttattcaggggctgtaggcacagccatgactggagaacaagtaagtcaggagcatgtcctttgcacattaatgactacacagtgattcaggccaaggaggctgcactgaaagccagcgcttaaaaaatgatgatctaaggctcatatgcatataatctgcactttagcctcaggtatcagcagtgtagctgtgggtatcccgctagctacattctttctcaaggctgcccttctgtgacttccctctctcaagcctattgttgttgaagtttcatttgacttatataaaatgctgatatttgtgtgcatatttgtggggggtgtgtgtgtgagagagagaaagagagagaggggacggggagagagagagagagagatgctattattctttcaatggaaattataaattaaagcttttatttttattatgcgtttgaggtaaaatacatattggcaagatattgaaaaccatttccatataggcatgaagaggtataaaaggaagattggaaaagagaatggagttattaaccagatcatggaaaggcctaatttccctgagcttgggttgtgaccatcttttcagctcagcaaataaaattaaagctagaggtttttatgtttttgttttttttggagacaggatcttgctcttctgtccaggctagagtgcagtggcacagtcatagcttactgctgcctggaactcctgggctcaagtgatcctcctgtctcaggctcccaagtaactaggactacaggtcacacaacaccacacctggataatttttaaattttttgtaaagatgagactctcgctatgttgcccaggctggtcttgaagtcctagcctcaagcaatcctcctgcctctgccttccaaagcactgggattacaggtgtgagtgactgtgcccagccccaaaagctagaggttttaatacatgggaaagagcatctcagagagaggtagcaaagcaacaactaagatagcatagaaacgtaatagggaaaacagagaacactttgtcaatggtattttggctaccagaaagaccagcagctgttttctgagaggcttacctgggtgatattcattatcttgggtagttgtctagggtctggtccttagcttacatgcttggaaattttattttctcatgtatccaacagaactttctggggcaaactcacatgaattaagtttatgcaactaatatataaaaagaaaatggcaattccttaattgataaagacaaatagaagagttttatcttctggaatactcaatttaaaatgtttagcacacattctccttgtaggcaaacctaatgggaaatcaaataatgctgagaaagttgattcctaaggatggaatcataacaagtggaaatatataaattccttgtttgacagcatgaggctaagtatattggtatggctctttggttccaagtaacagaaattgactaaattaaggagaatgagaaattgctggaggatgttgagaagcttacagaattggtgagaagtttggaggactaggcttggaaataagacaggaaccaagtcagtagaaactgctcagggtgccaatcctggcacaaattctaaactggtcccttcccctccatattctcatattctgctcaggatgcaaagctgtgggagagaggagctcattgccaagtttagttgcatgcctttcttttggttattctgtgaagagaaagaggaatcttccatgggaaattattataccaactcctcactacagttgtgtttaaaattcaaattcctaatattgacacattatgacaattccaatccaaggaagtaacctaacaactagttttgaacatgtaaaatccagcagaagcaaatacaagccttctctatagggatatacttgcacaacagacttttttttttttttaaagaaataaactccacaggtggtagatgaagtctttgtgtatcttacctaacaggtccaagataagatgagatgagtgttgtgctgagggcacaaaatttaaggaagcactcactcttaggtttatgccctgtacttgcacaaaattgagagtgagtgtatccttaaattttgcaccctaggcttgatgcttgtctcactccagtcctggccctgtcataaatctgaatttggtgtttatcatttttatgcatatttcagtatttatactacatgcatgtggatctatatattcaatatacagtattgatttacatcttgtaaattttatataagccttgtactgtacatctacttctacagcttgtttttttgtttctatttttatgctgacatatgtagtttcactttattcatgtttaactgctgtttatattattttaatatagtcaaatttatttcttcattctcttgttgattaacttttagttttctttcaatacaattggcagtataatacatttttcctcgtgaacatatgctagagttttttctagcatagacacctggaagtggcatgctgagttgtaaagtatgaatacctttagttttgctagatattactagatcagctctgaaatgaggccatgagtttgtatctctgttagcagcatatgaaagttcaaccattctatatcctcacctgttattggtattgacagacctttaaatattggccagtctgtttgttttgaaatgggaccttgttgtaacacaaatttccctgaattcttgtggcattgagcatctgttcacatggatattggccatttagttttctgtgaattatctgttcttatcctttgcttgtttcttttcattgggtcatttgtctttccttgttgatttctggaaactaatgttttgtttactaaacaatcctttttattgatttcatgcactaaaacaatattttcccactcctaaatttttgttttaaattttaatttggtaaaatttatgtcttcttttctccttatggtttgtgttttttctgctttaagaaattatttctgacctcatgatgataaagatactctcctgtgtttcctaaaagttctaaaagttctaaatgtttgcttttatttgcttagtatttatttcacaatctgaaatagggatatgtgttttttccatatggataattaattatctagtgtcacttttgaatgttattgtttcttcttcagtttataatgctatttttcatgtatcatgtttctatagatatcctgtctgtggatatgatactcatttaactattctagctctaaaaaaaagccccgagtatccagtagggaatgtttctctgctgagctattgatcttcaagattatcttggttgtttttggaaactgcattttccatatggatttaggatgagcttgttcagttctgaagatatgaagaaaaattaagcagaaacttgttgggaatttgatttggatttcagtaaatttgttgactgatttggagagtatcaacatttttatattcaatggctatcttgtcttctttttgactttaaaggttatgctttaatatttcatccttaatgtctcaccaatatttgatcccacattcttttgctgtaggattttgataactaaggctaaagaagttccttcaattcatttttttttttttgctaagtgcttattttttaacattatagtatttgatacctacaaaataatacacatgcaagttatggattataatattgtggaatcacaaatacttgtgagtccacaaccaacttaagaaatagtttgttgagtctatatgtgaactgtttcacctactatctctttgatttctttccctgcaaaggtacccatcttcctgaaagttgtgtttaatcatccttttgctttttaaaaagtctttactgcatatgtgtatcctcaaacaatactgttgagttatacacacacacacatgcacacacatatatacacctacatatgtatgtatatataaacacatatatatttatatgtatggtgtctttggtgactcacttcttttactcaacattatgtttataaaatttttaagattcagccacaaaaatatatatagtagtacttcattaattttcactattgtacaatatgccattgtgtggttatatcatgattaattattcatcgttatgtggatgaacatttaagttatttatagttttttgccatgatgaacaatgctgatatgaacatagtatacatgtattttttttttttttttagttttcttatatatttttttaatatactttaagttctgggatacatgtacagaacatgcaggtttgttatacaggtatacatatgccatggtggttagctgcacccatcaacctgtcacctacattaggtagttctcctaatgttatctctccccttgccccccatcccccaacaggcctaggtgtgtgatgttcccctccctgtgtccatgtgttctcaagttctcattgttcaactcccacttatgagtgagaacatgcagtgtttggttttctgttcctgtgttagtttgctgagaatgatggtttccagcttcatccatgtccctgcaaaggacatgaactcatcttttttttatggctgcattgtattccatggtgtatatgtgccacattttctttttccagtctaccattgatgggcatttgggttggttccaagtctttgctattgtgaatagtgctgcaataaacatacatgtgcatgtgtctttatagtataatgatttatgatcctttgggtatataccaagtaatgggattgctgggtcaaatggtatttctggttctagatccttgaggaatcaccacgctgtcttccacaatggttgaactaatttacacttccaccaacagtgtaaaagcattcctgtttctccacatcctctccagaatctgttgtttcctgactttttattgatggccattctaactggtgtgagatggtatctcattgtatacaatgacccctgatgatgagcgttttttcatgttttttggccgcataaatgtcttcttttgagaagtatctgtttatgtcctttgctcaatttttgatggggttgtttgtttttccttgtaaatttatttaggttccttgtagattctggatattagacctttgtcagacggagagattgcaaaactttcctcccactttgtaggttgcctgttcactctgatgatagattcttttgctgtgcagaagctctacatttattgatttgcatatgttgaaccagtcttgcattccagggatgaagccaacttgattgtgatggataagctttttgatgtgttgctggattcggtttgccagtattttattgaggattttcacatcgatgttcatcagggatattggcctgaagttttctttttttgttgtgtctctgccaggtgttggtatcagggtaaggctggcctcataaaatgagttagggaggagtccctctttttctatgatttggaatagtttcagaaggaatggtgccagctcctctttgtacctctggtggaattaggttgtgaatccatctggatctgggctttttttgattggtaggttattaattactgcctcaatttcagaacttgttattggtctattcaaggagttgacttcttctgatttagtcttgagagggtgtatgtgtccaggaatttcttctagattttctagtttatttgtgtagaggtttttataatattctctgatggtagtttgtatttctgtgggatcagtggtgatatcccctttatcattttttattgtgtctatttgatccttttctcttttcgtctttattagtctggctagtggtctatctattttgctaatcttttcaaaaaaccagctcctggattcattgagtttttgtgtctctaactccttgagttctgctctgatcttagttatttcttgtcttctactagtcttctacgagcttttgaatttgtttgcttctctagttctttttttttttttttttttttttttttttgagacggagtctcgctctgttgccccagctggagtgcagtggcacgatctcggctcactgcaagctctgcctcctgggttcacaccattctcctgcctcagcctctggagtagctgggactacaggtgcccgccaccacgtccagctaattttttatatttttagtagagttgggggtctcactgtgttagccaggatggtctcgatctcctgacctcgtgatctgcctgcctcggcctgccaaagtgctgggattacaggcgtgagccaccttttatttgtaatgttagtatgttgattttagatctttcctgctttctcccgtgggcatttagtgctataaatttccctctaaacactgctttaaatgtgtcccagagattctgatacattgtatctttgttctcactggtttcaaaggacttatttatttctgcctttatttggttatttacccagtaatcattcagaagcaagttgttcagtttccatgtagttgtgtggtttttagtgagtttcttaatcttgagttctaatttgattgcactgtggtctaagagaccatttgttatgatttcaattcttttacatttgctgaggaatgttttacttccaattatgtcgtcaattttagaataagtgctatgtggtactgagaagaatgtatattttgtttatttggggtggagagttctgcagatgtctattaggtccgcttggtccagagctgagttcaagtcctgaatatccttgttaattttctgtctcattgatctgtctaatactgacagtgggttgttaaatctcccactgttattttgtgggagtctaagtctcattgtaggtctctaagaacttgctttatgaatctgggtgctcctacattggttgcatatatatttaggatagccatctcttcttgttgcatcgatccctttaccattatgtaatgcccttctttgtgttttttgttctttgttggtttaaagtctgttttattagagactaggattgcaacccctatgtgtgtctttacatgtgagatgggtctcctgaatacagcacacctataggtcctgactctttatccaattttccagtctgtgtcttttaattggggcatttagtccatttacatttaaggttaatattgttatgtgtcaatttgatcctgtcgtcatgatgctagctggtaattttgcacgttagttgatgcggtttctccatagtgtcgttggtctttatattttggtatgtttttgcagtggctggtacaggtttttcctttccatatttactgcttccttcaggagctcttgtaagggaggcctggtggtgacaaaatccctcagcatttgcttgtctgtaaaggactgtatttctctttcactgatgagcttagtttggctggatatgaaattctgggttgaaaattcttttccttaaaaatgttgaatattggtccccactctcttctggattctagtgtttctacagagagatccactgtcagtctgatgggcttccctttgagggtaacctgacctttctctctggctgcccttaaatttttttcttcatttcaaccttggtgaatctgatgattatgtgtcttggggttgctcctcttgaggagcatcttagtggtgctctctgcatttcctgaatttgaatgttggcctgtcttgctaggttggggaaattctcctggataatatcctgaagtgtgttttccaacttggttccattctccccatcgctttcaggtacaccaatcaaacgtaggtttggtcttttcacatagttccatattctttggaggctttgttcattccttttcattcttttttctctaatcttgtcttcactctttatttcattaagttgatcttcaatctctaatatcctttcttctgctttattgattcagctattgatacttgtgtatgcttcatgaaattcttgtgctgtgtttttcagctctatcaggtcatttatgttcttctctaaattggttattctagttagcagttcctgtaacctttttgaaggttcttagcttccttgcattgggttagaacatgcccctttagctggaggaatttgttattacccaccttctgaagtctacttctgtcaattcattaaactcattctccatccagttttgttcccttgctggtgaggagttgtgatcttttggaggagaagaggcattctggtttttggaatttcagcatttttgggctggcttctccttatcttcttggatttatctacctttgatctttgatgctgatgacctttggatggggtttttgcgtgggcatcctatttgttgatgttgatgttatttctttctctttgttaattttccttctaacagtcaggtccctcttctgcaggtcttctggagtttgctggaggttcactctagactctgtttgtctgggtatcaccagtggaggctgcaaaatagcaaaagttgctgcctgctccttgctctggaagcttcgtcccagaggggcacctgccaggtgccagccagagctctcctgtatgaggtgtctgtcatcccctgctgggaggtgtctcccagttaggaggcatgggggacagggacccacttgaggaggcaggctgtcccttagtggagcttgagcattgtgctgggagatctgctgctctcttcagagctggcaggcaggaatgtttaagtctgccgaagctgcacccacagctgccccttcccccaggtgctctgtcccagggagatgggagttttttctatacacccctgactggggctgctgcctttctttcagagataccctgcccagagaggaggaatctggagaggcagtctggctacagcagctttcctgagttgcggtggtttccacccagtccgaacttcccaatggctttgtttacactgcgaggggaaaagtgcctattcaagcctcagtaatggtggatgcaagctcgagggtcccaggttgacttcagactgctgtgctggcagtgataatttcaagccagtggatcttagcttgctggggtctgtaggggtttgacctgctgagtgagaccacttggcttcctggcttcagcttgctttaaaggggagtgaatggttctgtctcgctggggttccaggcaccactagggtatgaaaaaaaactcctgcagctagctcagtgtctgcccaaatggctgcccagttttgtgcttgaaacccagggccctggtggtgtaggcacctaagggaatttcctggcctgtgggttgcaaaaactgtgggaaaagcttagtatctgggccagagagcaccatccctcatggcacagtccttcacagctttccttggctaggggagggagttccctgaccccttgcacttcccaggtgagctgacgccccaccctgcttatgcttgctctccatgggctgtattcactgcctgaccagtcccagtgagatgaactgggtacctcagttggaaatgcagaactcacccaccttctgcattggtcttgttgggagctgcagactggagctgttcctattcggccatcttgccagatccccacatactatacatatcttatttttgcccatatgtaagagtttttccaggttaatagctattagatgaattttgagttgatatgtgcaagttctcttcttcaagttattgccaaactgttttccaaaatggtggtaccaatttatgctctcatccacagtgcataagagtttcccctattccctatccttgtcaattcttggaattgtcagatttcttaattttttttttttgagatggagtctcactctgtcaccaggctggagtgcagtggcacaatttgggctcactgcaacttccgcctcctggtttcaagcgattctcctgcctcagcctcctgagtagctgggactacaggtgcacgccaccacgcccagctaatttttgtatttttagtacagacggggtctcaccatgttggccaggatggtctcgatctcttgaccttgtgatccgcccacctcggcctcccaaagtgctgggattacaggtgtgagccactgtgcccagcccagatttcttaattttttaaatctagatgatataaaatagaatctcattctttgctcatcaattctttatgcatctcagctcgagaacacttttttttttcctttgtacttattctgagggtctaacagtaacacatctctttctctctttctctctctctctctctctctctctctctctttcccctttcctctctttggccttaagatgtctttattttgtgtgcttctcagagtgatagtttagatgactatagaattatagttctttgagtacattggaaattttccattgtcctctgccttccattgcactggaaggggagctagcataaagtttaacttgtattattttgaatgtaacatcttttctctataactgtttagatcatctctacattttttgctgtcctgaagtttcattcttctgtttttccatgtgggtttccttttatttaacattttggggtacgagggcttctcaaatagatgaattgatgtctttcatccgtctggaaatatctccaatttttttcttttgaaattttacctcattctccttttgtaactctagcaagatttatgtttgcttctctcactctctgcttatgtcccttaacctctcttttagagttactatctttttcctctctgagttgcattcttattaatcttaggtctgccttccaattccgtaattctctcttcagctttaatctgtcctttaactcaatcattgatttttaaatttcacttattgtattatttacttctagaagttttgttttgttctttaaaaatcttctagtcattttttcaatgtcttgcttcctatttatatttttattttttcaagacatatttgtcaagaactgtgaaggctatgagattttaattttttaaaatccacagttttgtggatgttgaaagaagacatgagactcttggctaagagcaaaagactttattactcacagcaagagcagcagccagagtgtcaacatgtttgttttggttttctatgttccaattcctagaaatgggcctagatagatacctgcacaggaagggaacattgaccttgggaaacttgccattttatagtaggtaataaacaagctggcattttgtttaagggggaagtattagctcatctctcaagttttcttgctacaagcccaatcctgaaaaataatctgggtaaagatcagccagggccttgaatttttggcatatatagcaagacatgtaggaacaagagagatccatgaagtagtgttgcctaacaatattaaatatagtgattttgtattctgagtgtggtaattctaaaaactgtgggtctcagtgtactatctgttgtttcttttggctcttgaacatggtgttttgtttctttgtgagttttgtgatttttgacagtgggttcattttttttttttcttggaaagaaggaaattttctccagagagaatttgcatttgtttctgggagcactaccaacgggaaactacttgaaaataaattcttatcttgatgtttttcagaccacttaatgtgtctacaggctagaaatctacagatgggcgtgcttgtggtagtaaattctaaggagaaaatgactccccctctctacccctcctcagcatcatatataaagatagtcaactttccttgtattgtcacagaagatatagtattactagctcaccttgatgctgagggaatcacattttagggtctcagttttatgcagtggggatttcctgttagattctctcccataagctaaccttgggctttgtatattgttccctacttgctttaaggtaacaagtcctatgttggttagagtaacattaatgctgtaacaaatacagtataaaatttaagtagcttaacataataaaagtttatttctcaatcatataatagtccaatttaggtgtttctggtgggagtgccccttttctccatgtgataatttagggaccaaggctactttcttcttgaagctccaccatcctctgggacctgggaatcttttgtattcacctggcaattcacaaaaaaagaggttgaagaagacacacccaattcttaactctctttgaccagacatgcattgtattagtttaccttctatgactgagaattagtcctgttgttccatacagatgtgagggatgtgtgatggggagatgtaatctctggctgagctgctacttaccagtgatgactcaatactatggaaagtgaaatacaaattgaattttggtgggcagttaagtgtcacagaaaacaaagtttaaatttacctggtttggccaatgacgtctgaatggaagctgacttcaatgcctatctgtgggttctgctttcatttaccttttggcttttaagagttcttaattttttgccagcctgtcatgtattaaaaaagatattttagttttattttatcaagtttttgtttgtttgtttgtttgttttagttatttgtagtgggagagtgaactagggtatttagtccactgtactgctggaactgagtcctacacactcctgtgagttatttagaaatgtgatcttaaaagttgaaagtctatttttttaaacttaccttttgaaaattacttcacttggtcagaaagtggcatctagataatgttgaatttctattttttggccatatttagttaattttttggccatatttagttaagtacctgcttgcacatgaatattcgtaactgacatcttgcaatcatttaaaagttttatgtagtcacaaatcagtttgtcaagtatatttaaaatgaaaatattattttcattttcaatgtagtgattaactgtaactattctatgcctttaaaattcaaatatttaaaatttaaatgataaataatacctatatgtagtagaaaataatgaaatctttattaaagggttaagtatgacaaatatctttatataatttcagtacctttttaaaaaaaaagagcaaggaagcaatgggagaattggacatgttttgtggtgatgtgttcaattttttgattggtgattacatgggtgtacgtatttgtcaaaactcattcaactatacatttaaaatggacatattttattatatgtaaatgatacctcaacaaagttgatcttaaaaaacggacaatgggatgagggaatagaattaaataaataaatcagtcattgccatacagtgtgctgtaataagtgtccacaggtatttcgagagcttagagcatgtaatccagcatgagtatgggcactcataggtgtgcatgtcaaggaaaggaagcttctcactgagctgatagttgagttcattctttttttttttttttttgacacagagttttgctcttgttgcccaggctggagtgcaatggcgcaatctcggctcactgcaacctctgcctcccgggttcaagcgagtctcctgcctcagtctcctgagtagctgggattacaggtgcctgccaccatgcccagctagttttttgtatttttagtaaagacggggtttcaccatgttggccaggctggtcttgaactcctgccctcaggtgaaccacccgtctcggcctcccaaagtgctgggaataaaggtgtgagccactgcgcctggcctgagttcatttttttttttttctttgagatggagtcttgctctgtcgtccaggctggagtgcaactttgacctccctggttcgcttaaaggaaaggtagaaactagcctggcaaatggaatttttgaaggggaattggatcaaatatttctggatcagggaaaactgtaaaggggagtgttagagagaatgtcctaccatttagagcatctgtagcagaagaggaatggcaagagatgaagccaagaggaaacaaataatgaaagtcttcacgtctcttacttagaaacttaggaagtatcctgtgggcactgtgcagtcaatgaaaggtttttggcaggctagtgacatgttcagatttgtttttagaaatgctagtctgtcagacatgtttaggatggccgaaaatacttcaaaacctctctagcccagattgctgtctctcttctctgtccacactatgctagccagtgctcaagtagtgattatttggggttgttctttttttcatgatagtaattcttcctctccaactagactgtctgtccttcagaccaggcctcttagtcttcttctttttaaaaaatttatattcccatattgataggtcacccccttagtcttaattctacttcacttatgactcccaaagcactggtactactagacacaggttgaaataaatatttgatgattgactgatgaattattttcattatttaatggtaataccctgtttctctaaattgtaacatcaagcagaatgttgtcatctttgggtactaaggtgattcatttgactcaccattggataacacttagttgggtggtttgtttgtttttttttttttgtattgctgattgaatttgcacggagtcatccactatgcactggacttatctatgttcaatgttttacaagaataccacaacgatatgcaatgttctctatggctatcgaacagagatgttctctacgtgaaattaaactggcgaatgtctgtatggagactggacatatgacctcttctctatccagctcaggaatggggcttcacattgtaaaatcacattcttggaggaggaaatagtaagtgttcatcatgcatgctttggagattaaatcatacacatctgagagacaggaagagagaagtttttaaaaactggatggcaatttaggcaagcagtgggagtgtattgtattaaactgtgaaaagccagctatttgctgaattgtggtttgatgacagagctagggtccttctttatgattctgaatgaatttctatttcactctgccacaaattttcatatgaggcaaagggatagaaatttactttctaggaagttattaatatataaaaatgctttgatatatgaatctctgagatgggtaaaatagacatatcagtagtgagaaatggaatattgagactgaataatattctgttgggtttacaagaaaaagaaaatatcatttattgagcatctattctgtgtcaggaactgcacttggtgctttcatatttattaatatatttgtcacagccataggtacattttcattttactcataaggattatgaagattagaggttaaggcacatgctcaaatatacatagctgtttggtggcagagtaagattgaaattcatttgtctctcatttgtctttgttctataatctcctcatgaagcaaactaccaaaattgttaaatcactctaattttacatttagttttcttgtccagaccataaccattcctggccagggcatcaacttcagctcaataactggtaccaatcttgctctgttagaccttggctctgcaatgcccatgtgaacaaataccagtgtgcccattgagtcataatcttcttccattcctcaaagtgctggctcagttggtgtggctaggcttctatctcagttctcctatatatcatctgtcttagccagttggactgccacaatgaaatagcacagactgggtggcttataaacgatagaattttttttttttttttgagacggagtctcgctctgtcgcccaggctggagtgcagtggcacgatcttggttcactgcaagctctgcctcctgggttcacaccattctcctgcctcagcctccagagtagctgggactacgggcgcctgccaccatgcctggctaactttatatatattttagtagagacggggtttcaccgtgttagccaggatggtctcgatctcctgaccttgtgatccacccgccttggcctcccaaagtgctaggattacaggcatgagccaccgtgcccagccaacaatagaaatttctctctcacagctctggaggctgggagtctgacatcaggatgccagcatgtttgggttctggtgaggttccttctctgagttacagatggtgtcttctcaatgggtcctcatgtggcagaaaaagttggagagctctttggggtcccttttataagggcatgaatcccattcatgaagactctaccctcatgaccttattgcctccccaaagctctgcctcctaatatcatcacactgagggggttctgttttcaacctaacaaagtttgggaacacaaacattcagtccatagtaggacccagtttctcagagagactgtacctatttaaatggtgcccttaactccatcctatttaaatagaacttagaactctgttaggctccatgtagctctgtcttctgcataattgagctctgttccacttaccccaagctattaattggggtctaattgtaaacagtctgtttggaacctggctatttttacccaatccctgaactcctgttgctttcttggatatgaaagcttgccagaatcacatcagagttttcctatgcccttgttttgtgttccttctgagcttggttagtcacgtgcagccataagagatacaagagaggctcaggaaaaaacaaaggttattacacttgcaggtcctagagagaggagatattctgcatgggaagacacgattgtggtcatgaggcagaagacaagagtgagtgggaagcttagattacttctgtattggggtttttgaggaaaaggcatgccacggcagggagaatgtttgggattggttagtttgaacacttttggtgggttttctgctataggagtagtttctagttgcctagtacctggccctgggatgattaaggcagataaatactgtctcctgaagtatccaggccaaacagaggagataaggcttttgcttggttaatttgcacatcaaaggtatgctctctgacttttgttatctttaagaattagctagcccagggaaggcagtctctcccagttgtaaagtttttaaagacatcaaaacatcataatatacagaaaattaaaaaatatttacaatacagtccttgggacacatcttaccaaacagcctgctactaccatgggacacatacctctagtcagggaagtctctccagctccagtttgtcaactgtcttattcttttccattggcccttgttgccagtctcaagattccttgtgattaagaccacctgaatatgacatgatgcatttaataagtttcttagtctaaactaaaggtggatactgaggatattaaagctttcattatggttaaatttcactgttggtattagaatgtgctcaagtatcacctcttccaggaagacatccttgatttttctggtcagggttagtgaccctcctgtgtggtactgtaatatctctgcatatctatcttataagactcatcacattaatggtacacacatacctcgtggatacctggtttgtttccagaccacctcagtaaagcaaatattgcacaaagtaagtcacataaatttttttttgttttcccagtgcatataaaagtgatgtctacattatactgtaggctattaagtgtgcaagagcattatatctaaaaagtacatatcttaatttaaaaatactgtatttctaaaaaatgctaatgatcatttgagccttcagcaagtcataatctttttgctggcagagggtcttgcctcaatgttgatggctgctggctgatcagagtggttggctgctgaaggttgcagtggctgtgtttcttaaaataagacattaatgaagtttgtcatatccattgactcttcttttcttgaaagatttctctgtagcatgcaatgttgtttgatagcattttactcacagtagaacttctttcaaaaccaaagtcaggctgagcatggtggctcccaccagtcatcccagcgctgtgggaggctgaggtaggaggattgcttgaggccaggaatttgagactagcctgggccatatagcaagatccagtctctgcaaaaaaaaaaaaaaaaaaaaaaaaacaaacctgggtgtggtggtgtgtgcatgtagtcccagctactcaggaggctgaggtgagaggcttgcatgaacctcagcaatcctcactcaggaggctgtagtgaggtatgattgcaccactgcactccagcctgagcaagagagcaagaccctatctttaaaaaacaaacaaaaaatgaagtcagtgctcccaaaccctgctgctactttatcaactaagtttatgtaatatctaaatcctttgttgtcatttcaccacattcgcagcccattcctcaggagtagattccatctcatctcaagaaaccacagtctttgcttatctataagaagtcactcgttgtccattcaagcttactgtgagattgcagcaatttagcctatctttgggctccacttctaattctagttctcttgctatttccattgcactggcagttgcttcatccattgaagtcttgcacccctcaaagtcattcatgagggttgaaatcaacctcttttaaacttctgttaatgttgatattttgaccttctctcatgaattatgaatgttcttaatgacatctagaatggtgaatcctttccaaaagattttcaatttactttcctagatccatcagaggaatcattatctatggcagctatagccttatgaaatatatttcttaactaatcaaacttgaaagacaaaattactctctgacctatgaaatgatattgtgttatgaaatgctgtgaaatggatattgtgttagcaggcatgaaaacaacaatctccttgcacatctctggctcttgggtgaccagccacattgtcaatgagcagtaatattttgaaaggaatatctttttttctaagcagtagtctcaatagtgggcttaaaatattcagtaagctgtatatgctgtaaatagatgtgctatcatctaggctttattgctccatttatagagcacagccagaatagatgtagcataattcctaagggctctaggattttcagaatggtgagtatttgctttaacttaaagtaagcagctgcattagcccctagcaagagaatcaacctcttctttgaagctttgaagtcaggcattgacttttcctctctagctatgatagtccaaaacggcatcttcttccaatataagactattttgtctacattgaaaatctgttgtttagtgtagacaccttcatcaatgatcttaactagatcttctggataactttctcttgctgtagcttctgtatcagcatttactgcttcaccttgcacttttaagttatggagatgtcttcttctcttaaacatcatgaaccaaccgctgcaagcttcaaacttttcttctgtagcttcttcacctctcacagccttcatagaactgaagaaagttagggctttgctctggattaggccttgttaaagggaattttgtggctagtttgatcttctgccagaccactaaaactttctgcatatcagcattaaggctgttttgctttatcattcatctactcactggagtagcattttaaatttccttcaagaacttttcctttgcattaacagcttggctaaccatttggcacaagaggcttagcttttggcctgtctcagcttttgacatgccttcctcactaagtgtaatcatttctaggttttgatttaaagcaagagatgtgtaactcttcctttcatttgaacacttagaggccattgtagggttattaattggcctgatttcaatattgtcatgtctcagggaatagaaaggcatgaggagagggagagagacaagggaacagccagtcagtggagcagtgagaacacacacagctttgatcaatttttttccagcctacatcatgctttgaatacataatagtaatttaaaagtttgaaatattgcgagaaaattaccaaaatgtccagagacatgaagtgatcacatactgttgaaaaaatggcaagacctgcttgatgcggggttgccacaaaccttcaatttattatgcagccaacaaacatatgaaaagaagctcatcatcactggtcattagagaaatacaaatcaaaaccacaatgagatgccttctcacaccagttagaatgaccatcattaaaaagtcaagaaacaacagatgctggagagggtgtggagaaataggaatgcttttacactgttggtgggagtgtaaattagttcaaccattgtggaagacagtatggcaattcctcaaggatctagaaccagaaatgccatttgacccagaaatcccattactgggtataaacccaaaggatcataaatcattctactataaagatacatgcacatgtatgtttatcatggcactgttcacaatagcaaagacctgaaaccaatccaaatgcccatcaatgatagactggataaagaaaatgtgtcacacatataccatggaatactatgcagccataaaaaagatgagttcatgtcctttgcagggacatggatgaagctggaagccatcattctaagcaaactaacacaagaacagaaaaccagacaccacatattctcactcataagtgggagctgaacaatgagaacacagggacacagggaggggaacatcacacactgggacctgtcaggacatggggactaggggagaaatagcattaggagaaatacctaatgtagatgacgggttgatgggtgcagtaaaccactatggcacatgtatacctatataacaaacctgcacgttctgcacatgtaccccagaacttaaaatatatatatataaaaaaacacagtatctactaagtgctataaagtgaagcacaagaaaacaagctgcctatacttttatatttacatattgttgtctctcaaactaaaatgtaagctcctcaagggcagggcctctgtcataatccatctttatgtgcccaatattattcacagtatctggcacatagtgagaacctaacaagtacttattaaatagagaaaatgtgtagagggactaagaggttggtctccagagacagactggccatgatgtgcaaattccttaatctgtatttccgtttctttatctataaagtgggtacactaataggattgttatgagaattaattgagttataatatgtaaattgcttagaatatagcttggtacataataagcaatagatgtagacttttattgttattgagtgaatcagtggggaaagagtacaaaatgttacaccacatgggcccaccaattgtacaatagttgcttttgactcctgctgcctgaattcaagatttccctcacattctggaaagccccacactccaggatcctttgtttttaagtgcctgcagaatttgtactgggtgacacagttgtttggctccaatgagactaccctgctaatatttgtaaagggtgacctttcacaaaggaagacaattggcctgaactaaatagcattgtgttgagatacaaaaattatttgcaggggagaccagatatgggtgtattattaccacaacaccaggacttcagtccagggttctcctgctcaccacacagaaagccaatcactgagataatgagcattgccagggaagaagggtttgagtgcttcagccaaggagatgagagaccagtctcaaatctgtctcctcaactgcctaaaattaggggctcatgtggcagggaagaaatgtaaccatgtatgggaaaacaggaatcagggaggagtaaggaagaggaactgatcaataggaagtagatggtcagtgggcagttattatgggtgaggggtctggcatcccattgtccagatgtggtgatctggtaagtttcagttccttgatactatctgggagccctaatggtttcctgagaaaggaactcagataatacaaatataagtttttcaagttttaatactgagagggtcaatttctatatttattcaaaagaaaccataaacatcacttctatgggacaattgggctggttccagtcctgatctttctatttatcagttcctcaatcatggagaatatggttgtcgatctttcgggctgcttcatgctaaaaagggggcattgtgagcagctccataccatgggtaaccacgtggccacccaggaatcaaacgttaatttaataccatagttttcttctgtgatacaatctttatgtctccaatccactacttccaccaaagacaaatcatagcaggactaacctacctgaaaaataagcatcagtcccactatacttggcctgattacccatataaagtgcagcaagaatcattgtccatataggctcttctacattggctttgctggaacctctcacaaggaatcagattcaacctccaaaggcctctcaagcctagccaaggatccatctgtgtctacagatatttacatgaattgggtgaactcctctctttccaaggccccaaaagaacttgtggttcctgggcctgccaggaaggtgactctctacttaccacaggccaggaaccctgcaaaggaactgcatagacaaggtatgaggcatctttctaaggggttctcattggctctataaaatcaatgtgaattcctcaaagctgtgtgctcatatcccaaaacatgccattttagtccaagtcctagaaaataaccagtgcctccaattgtttccaaatataagagaaaacagattcttactgatcttgcaaacaaccacattgcaatgaattaagaacattcacaaagtttctgaattctggataaatctggcagagagggagaaatatgcctcatttctgtatactcaattgttaaaggctataaacagctcaaaagaaaaaaattctgaagactctgagaaacaaaacaaaaagaatcagtaatgtttcaaacaaaaaagagccatgaaaattatttcaatcctcctgtagttcaatccatgcaatcagctcttgttctgctttatattaggttagcagtctttatgaacacatcagcctttcaattagtgttctggaagttttctctctggtccaatggcacaatctccaaagttatcagaaacctgcaatcaggagtccttttcatgaactctcccaaggaagccctgggttgtagctgattataagctgctttttgagaagaatcaaagcaaaacaacaattgtggatgataaaaatcttaggatagctatagtcaaagacacaattgacaagaaagtttgattatttctgtggcatccaacaatttaacataaaaatcataatttttactaataacatattgagacatatcagaatttcaggaatctcatacaatcctagaacatgtctatataaatataacccaaagaaataatgctaaatgatgagttaatgggtgcagcacaccaacatggcacatgtatacatatgtaacaaacctgcacgttgtgcatatgtaccctaaaacttaaagtataataataataaaattaaaaaaaaaaaagaaagttaaacaccatcttggccaggtgtggtggctcacacctgtaatcccagcactttggtaggccgaggcgggcggatcatgaggtcaggagttcgagaccagcctggctaacatggttaccactagaatcttcaaaccagtacaacacttgtacatactttgttttcaagtacacacatgaaggcccaacaatgataaggtttgggatcaaaaatcactagaatgtctcactttttttttttactactacttaattcaagtgactgtcacttaatatgaataatggtaaacacagctaaagtaatttgagagaaactccagtcaatataattttctaaaggacaaggtcaatctttcctgaacattaaaactttgtacccatatcaagtttttcctcattttctaaaggaaaagatctgaaaccaactcaaattattgactaaattgaattaccttggaaataaacaccatttaaacatatccactcccatctacttttccaaataacaaaatattgtactatttctgttcagaacttataaaagtaagtcttttaattttgtccaagagctttataaactcttatagatcattaaaggaaagcataaccaatgctaatgatcctatagatcattagaggagagcaaaaccaatccaagtttaaaaggctggtgtgctctatcatttttttttttgaggcttgacaaaggtagcttaggaattttagatagatagagcaaatgatgaatgttggaaaaacatgggaaaccaaatggctatccatagaaccaaatgcaagcttttcattaggaactgaaaactcatggctgggtatagtggctcacccctgtaatcctagcactttggaaagccaaggtgggaggattgcttgagaccaggagtttgagaccagcctgggcaatataatgagaacttgtgtctactaaaaattaaaaaaaaaattagccagatgtggtagcatgcatttatagtcccagctactcgggaggctgcagtgggaagatagcttgagcccaggagtttgaagttgcagtgagctatgatcatggcattgccctccagtctattcagcctgggcagcagagcaagaccctgtctcaaaaaaaaaaaaaaaaaagaaactaaagaacatcaatgtatatataagtaatatgtatatataagtaaaacccaaaggagaacaaacagcaaataaatgaaaattaaaagcaaaaacagataaataggaagccccaaatttttctcttactcagataaccttggaggctacagtgttacccacagcctaaaatacaaaagcacgtgacggatattttgctcctgatatgcaaatgaatgttcttaagtccaccaacgcccctatacattttgtgcaattaagaaattcacttcagggatgtgaccagttaagtactttagtgctagtactatctatgcagaatagaaaatatagtgtgaaacaaatcagtgcaagcatttagtgaaatttggctccatgctaaatctggcttcgtgctcaacaatattaaaaaagaattgctggccgggtatggtggctcacacctgtaatcccagcactttgtgaggccgaggtgggcagatcacctgaggtcagaagttggagaccagcctggccaacatagtgaaaccccatctctactaaaaatacaaaaattagctgggtgtggtggtgtacacctggaatcccagctactcaggaggccaaggcaggagaatcgcttgaacccaggaggcagaagttgcagtgagctgagacagtgccactgcactgcagcctggatggcagagtgagactccgtctcaaagaaaaaaaaaattgcccaactgccatgtatttctttaaaatatttcttgttttactttatcaagactaagagctttaactatgagcaatgttaattagcccaatatctcaaattttctctcaggttttaaagaatattttactgtctaaacttccgtcttctctgtatgtgcatgaaggtagacacacagagaaacagaaaaaaaaaaaactacatatgacttacacagaacaacagaaggaccatgcatggactttctgttttgtcttaaattctctttatttttaaatagccagttattttattttaggacaaaaatttaccgttccaagattctttctcatacaaaattcttttttactttataaccttttttaaaaaaccgaaaatacatcttcatatccataactttcttcacatctctctcccctacttaccagttctattctaccttatttcataaataaccttttcaagcccataatttgaactaacctttagataactttttttttttttttttttttttggagacagggcctttgctctgttgtgcagtctgaagtgcagtggtgtgatcacagctcactgcagccttgacctcctggactcaagcaatcctcccaacttagcctcccgagtagctgggactacaggcatgtgccaccacacctggctaattaggaaaaaaaaaattgtagagatgaggtcttactatggtgcccaggctggtctcaaacccatgggttcaacttatcctcctgccttggcctcccaaagtgctgggattataggcatgagccagccagtaacttctgaattaaacaaaattattctttttctcagcaattttatatacggaattacatattacatattaactacaattcttattcttagtatccttaagttttagtgaaaacctaggaagcaagaatcctgaactgtcatataagatattagcattttatagataaggaccattccacaatttttggaaatatgtttccctgtatcataaccttttcttaattgggaattacctagacatctaatgaacatcaaaaatgattttaagattttaaattacatcatgccatttctatttcattcagttttttcatttttaacagttttacctagattacttatgagaactgagatattagacaaagctagttgtcatttccttgttaacaattttgtaacctgtgaatagcagtaaggtccttaaagttaactacatgggtattttcaccaatactcagaagactcagctatattcattaaaccaacaacattaaattagtcttatttggcaaaaattgcacaaagatcattttgttttggctgagtttatagctttataatcttctgtgccaaaccctgacacctcaaaatatctacagagacaaatacaaaacccagacaaaaatgtatgctgacaattccaaagtcacatctacttttatcttaccaataattttaaagctagattgcttattaaagatttacataagtcacatgaacttgaaacatgcttggatagatttaattatgagctttcttttatttataagccaatttggtagacacaacatataacataataaatgttacacaatacataaacatgtaaacatgatacacaaacataaagctccaatagcttttactttggaactctgtagccatgagatagtaatacaaactcaccagtttacaaacacgttcacgtggctacactttgtttaccctgataggtaatctaatgaaggctgagacccaaaattttgggtaaggtcgtttccatggcagtttgatttttaaaggccaaacctcctcatactccaaagaacactgaggtcaaacagcaccataaaacatcatgtattaaccaggcccgacccagcttagaacagcagcataaaagtctggatacatgaaattccatcccactttttctttaaacatcaaaatgaggcccatggaaaggccacacttctctagattgcaaagaatattggggcaaaatagtattacaaaagatcagtttataaaattctgatttcccatgactttattaacacacatatgtagacaatcatcaaaacaccatccaactgctgcagcaacaagccccaagcatgtccagactgaaacagtccaggtgcttttctctctcaattggttgggcttgtttaacctgcaaaaggaaactccttcagaattcccctaattgagaggagcagatcctgctgtctgttacccacgaaagacatcatctgtccagatgcagatgacaaatttcaaaggctgttcttcctaggtgatcaggaatgaagttggagccagcagtgatagtaccagagagacagagagagagagactgaaacccatctctggccaaaaaaggggttaggcagctgcctaggagggcttctgaaactcctggcccatgcattcccaataagggaaccaaaatctgttaccaaaacaccaggggttcagtctaggtcatgctgctcaccacacagaaagccaattactgaaatattgccagggaagaaggctttaattgggtgcttcgcttgaggggagaggagaccagtctcaaatccgtctcctcaactaaaattaggggtttatgtggcaaggaagaaatgtaaccatatgtgggaaaacaggaattagggagggaaaaggagtagttgggcaacaggaaataggaagtcaggcgatcatgacgggtgaggggtgtggcatctcattgtccagatgtgttgatctggtaagtttcagttccttgatactttctgggaggtcttatggttggtttcctgagaaaggaacccagatcagacaaactttttcaaattttaagcctggaagcttcaattctatgcttagtcaaaagaaaccataaagatcagttctatgagacaattgggctggtttcagtgttagaaccactcatctctactccctccctcccctgtggatgaggtggtaccatactgcagtaagcattgtgcttctcagaggaagtgttcctgaacccaagtggaaggctgggttataaaccttaccttatcctggctgctcagctgatggttatttgaatgggaaaaggcaaaacttctccaagaggataaaatgagataggacttatttctagagtgcttggtcctgtaaaaatctactggacatttgcagccaatttagccctctctgtttggctccgaggcctagaatgagtcctgctttcactataccagacatgaacatttctttacattttagtgtagagagctaaggaaactccagtggaatttagtaaacaaagaaaaaaaaaaaacaagaaaaaaaatgaccagttttttcagggcctggaaattattcattcttggggccttaggtctctaagaaaaagtttgcaaagcagttgttttagcctattgtttcccaaaatatgttcactgtctcctttttattcctttgaaaacttgggagtctcctttttattcctttgaaaactccgtatgtcaagagaagcttgacatcaggcaataaacaggtaggggatggggtaagaacttaaacgctgaaatgtttcccatgaaagggaatagaagcatcttctgttctttaaactcatccttccttttgatacgtgagtgctgggaagggaagagcgtggttcctttaaatgatatggaagcgggaagggaagtgttggatagcggaggacatggtccctggctagggctccacccccacggacctaggtgaggacaggcacttgtgccttcactcctaaatgttgcgtttcccaacaccaccctggcctgccatgcccccatcctgggcctataaaaacccgagaccctagcaaggcagagacagaagtggctggacgtggagcagagcagataggcggaggaagacacaagtggctggacggtgagaggacacggaggggaacacgccggcggaagagcattttgacagacacaggcactcaagcaggctattgaccagcaggtttaggcggagtttggccagggcagtcggaggagagcgcccgctgcccagcggcccaactccagggataaaccatctcccttctggctcccccatcggtggacagctgcttccactcaataaaactttgcacttattctccaagcccacgattcttccaaggcaggaacctgggatacagaaagccgtctgttcttgtgacaaggtggagggtctgattgagctggttaacacaagccgcctatagatggcaaactaagagagcaccttgtaacacacgcccactggggcttcaggaactgtaaactctgctgtggggtgcccaagtctgtatgctcccctagaggtttgagcagcaggacactgaagaagcgagccacacctccgtcacgtcctgggagggggacaagggaacctttcctatttcactttaagcgggcagaaatgagaaagaaatgacattttttaaatttttccttagctaacaaatgtagggtgtctgggaaagttagtagttcttcctacagtagtagaaattgaaaaaccttcactggaaactctactcccatgtcctggcatctgagaaagttacctgctttacttgatgggaaaccttggtctacaggaaagtttgctgatgaagaaaatttcagaaagggggagattttggggttggcaggctcctgtgtaggaaacagttaacattctttaaaaaaaatttcactctgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgtgccactgcagtccgcagtccggcctgggcgacagagcaagactccgtctcaaaaaaaaaaaaaaaaaaaaaaaaaaaaaaaaaatttcactctgatatctataatcccaatgcctttgtacattatattgttctctcacaacacctagctcttactcatccttcagactctggaaattttccctgatctctctgcagaccacattatgtgcccttatcatttttttccttcctccctcccttctttccttctttctctcctttattttttcctttctttctgcatttcctttatgtacacttatcacattatatggcagttatttgttttatattcttttctagtagactatgagcttctaacacaaggaactgcacctatcctgttcaatttataccactgcaatgttgagatgtttgttgaatgaatggattaattaatgaacaaataaaggaatggacatataaccatctttgcctgtttgtgtttcgccctgagatgagcatgtgagtgacaggatttctgggaattagtggtgttttctctgatgtaatagaagagcagacccaaggctcagaatggcacgttttattctgtgacttgtacttgccaacaataggaaccattataattttactggatttctgagaatcagcaacatatgtgtgtagtaaaaataatgacaacaaaagcaaatagcctgatgaaaagagtccttagcatgcaggagtcttcccactctgatttacccttgtggtcaggtcacgcttccaaactaactcattgttgcctcaaaacattcatcttaagtagtatggatacaatgcaagaacaaatctgaatttcttcaaagtaaaaatgttgatcaaggaataaaaaaatggcaaacaaagagacttgaaacattgtgatggaagaatcatactgtatcaaggtgggaggggaagttatttttaaggaataattgagggtggtagagacttgggaaagaaaaaaaaaaagccaggatttcacatgggagtgcagacaaattataatttactaagagaagttcaaactgctgacagtattgtcacaacaaaagtgagtgattgccatatgcacagaacttaccggaagaagtgtagcaagccccttgatacaaagtatgcatatgaggacaagtaatccttttggacagggaacatggtgtcttccattttctgaagggatgcagggaccacagggaagaaagtgcagaggcttcactgtcccagacctgaactacagaaccaagcaggtgctggccactaagcagacataagaatgtgaactgagaactgagaagacatataaataaatgtttcctaattttttgtttgttttgttatgaaagcaaaaagggcactgcagaaatgataagggacagatgatttttaaacatctagtctcgttataaaatcttgtcacaccacaatcacaatgactgtgggactgggagaaacttgtcatttgccatctttaactgaaagcgatccaatagtcccatagacagttcttatggataaacatagaaattaacccttctggtcttaaagcttgaaacttacatttgttatttcttttttccttttttttttttttttttttgagatggagtcttgctgtgtttcccaggctggagtgcactggcatgatctcggttcacacaacctctgcctcctgggtttaagtgattcttctgcttcagcctcccgagtagctgggagtacaggcgcatgccaccatgcccggctaatttttgtatctttagtagagacggggtgtcaccaaattggccaggctggtctcaaactcctgacctcgtaatccgcccgcctcaggctcccaaagtactgggattacagatgtgagccaccacgcctggcctacatttgttatttctgagttcctcaggagaggacctccagtcttctcagaaggtatcaaataactgaaactcaccagatcacagcatccagacaatgagacgtcaggcccttcattcattatgattgcttccttacccctcctgactttgttttctcatacattattacattttttccttgctatataaacccctaattttagtccctcaggtagatggatttaagactgatttcccatctcctcagctgcagcacccgattaaagccttcttccttggcaatactcactgtctcagtgattgactttctgtgctgtgagcaacagaatctagactgaacccctggtgtttcggtaacatattccatcttctaatgctatttcttctatatgccttaatggttacatgtttcttgtacagtagagaaacttctatggtgtatatcaccacttaacttcttattttttcagctaaattaaccagaatgcttgtgaatgcagtgcactgatttaattttctgcacacttatgagatagtagcacacagcccataggaagcacttaattgatgtttgttaaatgaatggatgagtaacttatgtgaaagcacattctctggctcaagtagttcaagttacttccaaatataggcagaatttgaggatataggcaatgaagagaaaagcccatggattttggatgtaaacaatttagtttgaacatgggtctgacatttactggctatattaccttgggcaagagttaattctctaagtctcagtcttttcatctataaaatgtgtataataatatccttatgggaagattgaatatacaatttatatgaaccatttagcacaatgattggcatatagcaaggacttgatattatttccgtttttcttcactttagttaactcaggattgtcaaaaccacttgagatttggctctttgaaaatagtcttgaatagactggaagtaatatggaaaattgttaacatatgttaattccaggtggtagtaatagtaccatgattatatatatttgtgcttttctatgtctttaacagttctaaaaattaaacacataaaaaacaaagcattaaataaaatgacagatattattaaataaaacatcaaaaataaattgattcctacctttataaatatagaatagggaattgagtcattcagttgagttacatttgttgagtaactactataaacaagactgatgtggagcttacagttcagtggggaatacagatttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccagattttttttttaaaacatgtgatcagagcaattgaaaggaaatacaaggttgtaacagcacattatgcggcacattttacctggatttaggagattcggaaaagctaagaggaattaatgatgtgtaggagtaagtgatgtataaactggcaggcagagaatgaacaggagtgagggatggaggcggggagtgtcccatggacaagaaaaagcacatactagagactacagggaatggagaatgaagaatagttcaatatggatggagcatagggttcaagatagaaggtgggggacagacaaggcttgcgaagagggcaggggtctgatcatgaaaggccatgaagctttgtacctcctggggagagttcatccacaaaaacatgacccccatctgtcactgttagcgaggtctccattttttgtactaatgttgtggtgcttaggaagcaataattcagtgcttgaagtctgatggaatgctgtggtttctggggagcccagaatcatggtgctgctatttttaatggacagaaacttactgtatttcaagtgaataaaatgagcatagaggttttgtctcctacacattttcaacctaaggacttttatagatggatcgaagctgtcctgagccaaagtgtatcagttctgcctaccatcagcagaagatattagcagtggtttgtttaatttctttttggactttcagagaaacagacttgaagatagcctttgggaagctaacttgtaagtacataagctttgtaatacaaagttaactttatcttaattttcgtatactgctgacattttcttgcatcagatggattatgtttgtgtcccggatcttgaggttagccagagtttgtaaaactaataaataattttacaatctggaagatttttcttttaacaaaaccaatggcatgtgtccattatcctatggagctaggacaacttgagtttggtttggagaatctagaacacagttgctctggggcagggatgaaggaggattacattctaatgacagtcatttgcaatgtctcatcgtgttcaaacataggacgattacacaaggtttcataatggaaaataagcggtccagataattcagaatacacaaaccatttggtgaccttgcctgtgactcctcagggagggagctcataggaaaactgatgatctgagattgtgatttgcccaaagttgcagaataacattatactctaattcccaactgttgctctatggacttggtttttacaattatctaagattttcaaagactctaagctttgcaaactctaattacatgacaaagttcctggccattagcttttaattttagagtatactttttattgtcgtttgagttttatgtactttttattgtcatttgaattctgcatgatgatagtcttcctttccttcactccctaccctgatcttcctttctccccaaccctattgatactgagaaaattaacatctcatttggaagtgggatgtttgaagggatagattatctttacagtttgtttcatgtgtccaagaaaatttttaagctgcagctcggggtagcatttttctttcctccagctctgtatttttttcttatttaatgtgatcagtagttcaaagcaggatctatttatttttggctcactttccacctcactggttgtgacttttagatgtgtatgtggattttgttctcacaggaagatctaaggagaccctgttataagcatgggttaaccgccataaggcacagctggtgcaaatcagcatgatgcagcatagcttagggttattggcagcgcttgtgtttagaattatacagtaaagaagaaaaggggctctgtactataggataggaaagaaggaaaaatctagcgggggagaagggaggatatcaaacataaacaggagagggaagacataaaagagtaggggttttcctagtgacctcataaacaagtagtatggggaaaactgtatactatgtaaagttttactaaataaaatgatgtttatatataatcctttatggtttcagggatttgggacaccttattttatatgatatgtttctgtcctttatgggggtaaacagagaaactgtggggaggcttgatagcccatggagaactgggagggttctttaaagaagttggggagaatggaaaatctaggatgggaaaaagggtctggattctatattccaaattctctgtcctcagtctgatttgatgtatgtcatctatggttcagctacatgtctcaggttttggatcaaaatatacatggtcagcataagtctctctgagcagattgacatattttcccagatcattacaaaagagggctcatcctttagggaattgtctgcatctttcctgaggcctggattcagtgctcctttgaagacaaatgggccgtgataggtggagcagtttctgtaagagatggtcctgtgccaaccccctggcagaattgtacacctggcactggtacaactggtgctccgcttagacttttctctcagtctttcatggacacctattaggtggctgggaggaagaaagaaggggaaacttcctcctcccctggaggacagactgctatcagtaaggaagctgtgtagctgttcattagaagtggtgattcttatttggagcattgcaaaatttcaaaattttcccttccttccttccttccttccttccttccttccttccttccttccttccttccttccttccttccttccctccctcccaccttccttcctcttctttctttcttatagtcttgctttgtcgtccaggctggaatgcaatgtcacccaggctggatcttggctcactgcaacctctgcctcctgggttcaagaaattctcctgcctcagcctccttagtagctgggatttcaggcatgtgccacctcgcccagctaatttttgtatatttagtaaagatgaagtttcaccatgttggccaggctggtcttgaactcctgacctcaagtgatctacccacctcagcctcccaaagttgctgggattacaggcatgagccaccgtgcctggccaaaatttctttttattatcttgagatcaagacgtgctcaggtttcacgatgagtgtgtaagatgactctcgatgctaattctaggacagtgtgtgaggtagcccccacagttaattctgggtcaaggtgagtgtgtgagatagccccaaagtttgctctaggtctgggtttgtggattgtgttggaaactttaaaaaacaaggacttgtgtagaagtttgaggaaagatagtttgtaaatttgtatctttttttttttgaatgataggaaagcatcagtgttgagttctgcaagccaattgaaaacagaaggtattttatgcatagtgtgtgggtgaagaatgtatttgtgaaggaggaaatgggtcaattgaaataactatcaattcataaaagagaaaatcagtatctaattagcatgaagaatgctcagatcaaatagtgtctaaaatgttgattcagtttagttttatataaaatacttagtgagatataaaggatatagaatttgataaaactcaccttgattccagtttcctccctgggagaatacctgtgaatgggtgcaacattcttaatgtgctgggtgacttgattttttgcaaataattattttggtggaaatgtgggttcataatgtttctaatatgctttgcgtcatttttcaggagcatgataaatttgaactgttacatctattttactttggagcagtcctccttgtcgtcaagggcatccatttttgaaacagctgtttggattgagggatacaggatgtggccataaagtagatcaaagttaattggccctcagggtaaacaagctcatgaccttggcctcattagccctgtgctgtaactagctgaagtaacctgccctgggcaggaagtttgcttccctgaagaagcttcagcatttagaaattatccaataagtcttctcattttgccaacctgccctcttctgccccagcactgaatgcttggatggtgagtgagaagagggggagattcagtgctttatgggattaccatcaggtaggaaaaaaaatgttaaagtcatgcttattttataggatttgtatacaggcttgaggataggttttggccaatagaaagcctctacatgtgtcacaacaaaaggtgtatgataggtgatactttcagcgcggtggactcttttgagtctcagttttgccttacctcttcatactgtctggataaataatgaaatatgccacaatagccctgaccatgaaatggattaatgaagctgcagttcaagactgtacacaagagtaaaagacatttttcctttcccaggcccaagaaaacaaaggagtcatgctgttccgtggcaatggagccaccagcagctcctgaaggccagttctctgcagctggtttatattcctcacacttcagggcctattgctaagtaggtttgtcaacatttcctccaagcacctcttttctagcctttccattggccagagggatggggcagggataagagtgatccttccgactttatggatagctaggacattttggttcttcatactctcaggcatggactagttcctcttatcaaaatctcttttctgaagtaaaataagtagaaaaaaatcaaattcaattgaaaacccagatgaagcaattattactcttcttttttccacttccttctccttcctaacacacacagtaaacatttttttggagagatcaatttcttctatgtagactggaatacttcccccttaccttagctggctgaaagtattatggattgctctgctaagaactctctttttcttccctctttggccacatacccagttgctattgaaaacactaacttagaaacccattaaaatagttatggaatatttattaagttttttaatactgtggagtataagaaacctaaactaggccccggtttttctcccaaatgccactccactctgttaagctatttctccaccccatctgatccatttactgaaagttaaccactgttaaccatttctcgagattctttacagaagaaaaaaatcatgcatgtacctgaatgtatatatgtacccatctctacatatatgtgtgtgttttaacatataaggtatcatagtgtacatgtcattctatacctggcatttttcctttaatgatgtgtcttagaaatcttttcatgttggcacacacagatccatctcattctaactacacagtaatccattacatggatgtgccattttcatttaacagtctctatactgatggacatattgatgtatttttaaaaccacaacaaactgtgctctaaaaaggttatgcccatttgcactctcaagagtataaaaatccattttgaatagatagaaaaataatattttcccagactcatgtagctggtttctgattttattcctaaagtgttttctgtgttctagtttatgaacacctgatacataaataagtgatgttcctatctagctcttaagctaatcaatagaataaatcttctttcacaccttacaagttaatgttcaccctgtgcttggccagaaaaggatgtgggttctatgaggattgtccaccgatggcactctgtccccagatacctgccacaaagataccagggctccaattccagaaaacatagcccaggaaacaggactttactattccatctccacccagacacgtggtattttgagaggttattgccaactctgctgcctttacacagacccatcaaatttgtgaggcaagatagaatcttttttgctacttctaaaggaaactcagtgcgttcatcagggaaatggagctcattacatggacagggaagctgggaggaataaccacttaaaagcactttgaagcgtgttcaatcacagttaaatgcttcttcataaaacttgatttttgaggtctgtttggcatcatagaacttgcaactattgtgtcttcataactcatggcctgggatttggcactacatatttttatggctgaacaggaatagtataatacacatgagagctactcagatatctaatattacagaataatgcagaagacagaatagatattgtggtgggtggattataattattttatttttgttggtaatgtgctctaggtaccatgcagggatttggtgagattgctgtcatattttctaaagtatctggaattcctaagaggaaagctggaaaatgagtgcaaagtaatgatgcacagtctccttaactctcctagtgccatgggggtgtagacaatggcaaaatgagagggtagtcagacgtccatgtgtagatctcactgctttacagggaacaagaggctgagtattgtactggatgcaagaatcaactttgcccaccttaatcataaacagaaatatctagttctccggcctgaaccttttccactggtactgaatttctaaagataactgaatttctaaaagataaccgggggagggtagagctgcattcccaggatccttgagtttcctatcaatgaggaaagctgctgcttatttgtggacccagtgggtgccaaaaggaagaactgaagggatttctactgggttactgaatttattccagctccgttttggggaactctcaaaccttggggtgaggagtgggggttcccagatgaattcaacaagagagagagggagggggagatgggaagagataagttcaaatagacaggcaaagggaagaaaataaggaacacacacacatacatatatataatgatacttagattggcacaaaagtaactgtggttttgcattgaaagtatagcaaaaaccacaattacttttgcaccaatccaatattattacctaaggactcacagagatttccttaagtccatagggacaggagcccttgccctccatgcttcaggaatgatttgattaaggatactaaacaggcatgtgacaatgtgagcttgctcaataataatccttgatggactattactcattttgtgaaattgagccaagtctctctttcctgctccccctttctccttatttccctttcccccagctactttgctttgctaagtaatcagacatggatcttattcccaagatatttatattcttagggaaataagacatttaaaataaggaagaatgcaataaaatctataatggaaacccagctaatgagccacaggagttcagaggagggagatgtaaccagttggagtggggaggagattatggattgtcatatttttgaatttaatatttattgtgaatgcctaagttaaataggaatggaatgggaaaaagacttttccagggtgtggagttgtcaggaataaatcagggaggtctgcagtcttggggcatgaatagcatacaatgatgagattattctgagtggagtgaagggtacacaagcatattaaggaagaagtttcaatggtgtggtggggctctaatctgcagggccttgaatgttcattgtcatagctacagataattgttagaaatagcctggtttgctgcaaaagacagggcaaactgggagggaccagatctgccctcgaggattgatcaggaactgtgaggaagtctaggctggcagacaaggcattagaagagatgtgcagaagaatatggcgatagatgacaagcggtcacccagacaagttggtactgagaggtaggagacaagtctcaaggagggaaggtgcctgatactgggaaatacaggaacaggtggcacttagaagtgtaatcaagactgagggaataagaaagtctgtcagcagttagcaggctccagccgctatgctcaggttcatgggcagacttccaagctctgggaggaaacagcagaatggaaagcaagaagctgggccccagccccagagggaccaggcagatttccaagccaggagtcagacctggaacatgggcctgactagcagtaagaatggttcaatactccattccagagtgctgagccaaagtcttttaatgccttctgcttaaggttatgactgaccttcgacgctgggtttacaggtgggagcagagcggtccagctgtttggaggggaggatgcagatactggagaaacagtcagggttcactgctggctaaagagtctaggccttatttagtgggcaaaaggagaacaatggaaaaattaaaacagaggaatatcttaattggagctgtatttcaggaagatcaatttgatcctagtgtgtaaaaggaaccagagttaagtgagtcctcacctgtaacaaatttcggccattctccttcctaagcacttctccagtgtgttcacttctctgcaggcccccttctaatactgtggcataaactatatgagtaaaattcatacaattaataaactaataaaacattaatttcacgtgtttcttttcattcttttcatgtggcttctggaaaaagttaaaatttataagcggctcacattatttttcagtggggcagtgctgctctaatcctttctccatattgcggttagaactttttaaaatgcaagtcttctcatgtagctctactgcatgaaatctccccataatctccattgccccaggataaagtctaaattccttagcatggcccccaccctctttgtcatctggccttagcccatctcccattgcactaatccttcaggtgtatcaaactattttcggtccacccgtgaaattactttgtattctttggcatccatgcctttgctcctgccattccttcgcttgaactgaatatttctcccctttttcatgtgttaacttttgcctcctattaaggtctcagctgtaggcatacctgactccttgactgtggattaggtgcttctccttgatgctaagggccacatcctgtgcctgctctactatagcatttctcgcattatttttgaggtcctattatctttatcctctacctagactgcatgttctttgaaaataggaactctgtattgatctttatgtcatgtccagcacccagcacagtacctggagcataatagctgcttgcatgattgtatgaatgaatgaatggggcagatgtgctaggtgaaatgaacctgaaccagcatagtggcattgggaatgaaaaggataagacactcatcaagaacgtaatttgtgagtgctggcaaccatgtaaattgacctctaattactggttgggtatcctttattcaaaatgcttttggccaggtacagtggcttacacctgtaatcctaacactttgggaggataaggctagaggatctctggaggccaggagtttgagaccagcctgggcaacagagtgtgaccccatctctacagaaaacttagctggggatggtggtgtgtgcctgtagacacagctacttgggaggttaaggcaggaggatcgcttgagcccaggagtttgatgctgcagcgagctgtgattgcactactctactccagcctgggcaacagagccagaccctttcaatcaatcaatcaatcaatgaaacaaaatatggaaaatgcttttgtctaggcacagtggctcacacctgtaatcccagcactttgagaggccaaggcaggaggattacttgagcccagaagtttgagaccagcctgggcaacatagcaagatcccatctctaaaaaaatattttaaaaattaactgagcatcgggatgtatgcctgtaattctagttattcaggagactgaggtgggaaggtcttttgagtccaggaatttgaggatacagtgaactatgccactgaactccaacctgggtgacagactaaaatcctgtctctaaacaaacaaacaacacacaaaaaaactgcttgagaccagaaatgtttcagatttcagatttttaaaatattttggaatatttgcattataccagttgaacatccctaatcctaaaatctgaaatctaaaatgttccaatgagcattccctttgagtgtcacattggcactcaaaaagtttcagattttgtagcaatttgggtgccagaatagggatgctcaatctctactaatgagtatgaagaactaatgcaattcataaaatgccctaagtcctaaataatattaaaaatagcaatgatgtggacaaatgttctaaggaaaaaagaaacattctttttaaagtattctgatacttggagtcaaaagacaggtttaagactttggtccagcatttatgttgtctgtagtcttgatatttcagttttttaggtcataaaatggagacagtaatacctctacatttggggctcattgtgagtattaggggaatatatgtagaagcatcttgcaaattgaaaagtgacagaaaacactagttattgccaatacaaaaatatttatacctgcaagtaggtgataaacatgctgtagtgattaaattgtacataatcgggacctgctcaaataatgtaaatctcaaacaaaccatcctagcacagaggaacgtggacaatttacactttgtcacatgacattccatcaatacaactcatggaatgagctaatgagagagtgagcaagaggtggcttgattgggcgccctccttcccagtgcccggtctgtgatggcctcacatttgacctctaactgtggctcacactattcactctgcttgcattgctctcttcttcactcctgcattgcttcactaaaccccagccctaccaccttaaaactctactcacattttaagtctccttcaggatgccttaatggggtacgagttctttgtctgaaggctcacagcattcagtacttctaaagttgtcttttttcctctctcaagagagatcccaatatcgtcttctcttccatttcctggtcaaggatagcactaacacctaagtatttccaaggtgggaattgaaagaggcctttccatccagcctgtattcctgtccccagacatgtgccagacctgtgctaggatggctgaattaaatggaacaaatgataacattagcatttgaatttggaatttagggtcaggatggttccatagaagctgctatagtttggatgtttgtcccctccaaacttcatgttgaaatttgatccctagtgttggaggtgaggcttaacagggggtgtttgggtcatgggggcagatctcttgtgaatggcttagtgtcatccttgctgtagtgagtgagttcttgctttattagttcccacaagagctgattgttaaaaaaaacaaaaacaaaaaaaaaagagcctggcacctccccgctgtctctcttgcttcctctctcaccacgtgatctcttacagctccccttcaccttccactatgagtggaagtagcctgaagccctcagcagatgcagatgctggtggtgcatctgcagagccatgagtcaaataagccttttcttcataaattacccagtctcaggtattcctttatagcaacacaaaatggactaggaaagaagcccacactcacttgcttcccttttacctgcttactttgttcattcccttgtttgtctcctgtactagtcagggttcactacagatacagaaataataggaatatatttaattgggaattggcttacatgatcatggaggctgagaagtcacatatctgctgtctgcaaccagcagcgaaattcagtctaagggcctgtgaatcaggagagccaatgatgtaaatcccagtccaagcacattaaaagatgagatgagatgtcccagctcaagcagtgaggcagggaaaaatgggacaaattcctccctcctctcttctgttctattcagtctctcaatggattagatgatatccacttccattggggagagcaatctattttacagaatttactgattcaaatgctgacctaaatccagagacatacctagaaacaatgcttaatctggacactcattggctcagtcaagttgacacataaaattaaccatcacacctcccttactttagatccaggagcagtatgtatcatttagtactttatgcacagtacatgttctgttgaggtcactaaaatagttatttatttacctggcccttgacagaggattatttgaaggattatgggattacataaaataaaacaaaaacaagggacatacacacagtatattatactattaaaacaaattagtgctcaagaagagaagatgtagtgctattcttatttaggaaaaatatacagtattagcctatttgacatgtgtgtgaactaggggggcacgtccaggattctttttaatctgtgctccctctaactctccaattctgtcttctctgcctagattgctctcttcccctacccaccccttccactacaacttctgattaattctgcctcatcttttggatgtcacctaagagattgttttctttgggaagtctttcttgaattctatgggcttagcctgtatactgtaataggaggttttctctcaacatttatcatatggtagtgtaagtgctttgtctgtttctccctctaatccattagcaccatgaggcaggtaccatgtctgtcatgtagaaagttagttctaccagctgggcatggtggctcatgcctataatcccagcactttgggaggccgaggcgggtggatcacctgagatcaggagttcgagagcagcctggccaacatagtgaaatcctgtctctactaaaaatacaaaaaaaaaagttagctgggcatggtggcaggtgcctgtaatcccagctacttgggaggctaaggcaggagaattgctcgaacccgggaggtggaggttgtagtgagccgagattgtgccattgcactccagcctgggcaacgagtgaaactctgtctcaaaaaacaaaaaacaaaaaaacaaaaaacaataacaaaaacaaaaaggaagctctaccatgtgtagcacagtgtctggtatatagtggtcacaaaataaatattcattacataataagtaggcaaaagccagagcaatttggaatcagagtatatcagagtaagtcttagtatattattataagcaaggctttggctaaatggctcctttacctctactgatttctgctctatttaaccaggtatattaattggaatataggtttggctgcttgtcacagatctatgccagtttaaacaagaaggaattttctttgtcacaaaacaatccagagataggcagtcatggacaggtatggcagctttgttctttaggatattaggttggtcaaatgtaattgtggtttttgccattaaaagtgatagcaaaaaccgcaattacatttgcaccaacctaatagtcagaagcaggcttttacttattttttttttgagacggagtctcactcttgcccaggctggagtgcagtggcatgatcttggctcactgcagcctccacctcccgggttcaagcgattctcctgcctcagcctcccgagtagctgggattacaggcacccgccaccacacccagctaattttttttttaattttttggtagaggtggggtttcaccatgttggtcatagctggtctcgaactcctgacatcaagtgatgcacctgcctcagcctcccaaagtgttgggattagaggcgtgagccactgtgcctgggctccaggctttttctatcttgatgctccaatatcctatgatgatgccctcgttcccatggttcacagccatgacacaatcccagtaggtccacttttgtcctggaatccttggaacctacacccaaagccagtttaatttcttttgggtacctgaactgatttgaggaccttctggaccatgtaaggcagcttgagtctggtatggatttatagaattaatcaagttgaacaatttctcactgcttgtctaatccatgccttaccctcaagccttctcaagtgggaaagactaataacttagccttagttgggtatgtatgacaagaatgccagctggttcttatgccaaggtcaagcagccttcaaacagggtggtatggtttcctgaggcacaggatacaataagttaacagaagggcattctaacaagttataaaagagaaattgcttggaacaatgttaactatattatctagttagctatcaggaaaagtatagtacttatttggctataaggttgccacaaaataccattgcaccattatttctttacaatgcctttctgttgggtttatgttattctggaaataagtcattaattcttattacagaagtttgaaatgaaggccagcccactctatcagttctcccctcccacgatatatacacacatagcacagatagcacatgtatgtgtacacacacacacacacacacaatctctggagggaaggagagaagagagaggaaaatgggagaagaatcagggtaggggtgagagctgggtgcagctttctagagcattagctattcactcatctagaagacgctgaataaacaaaagtaactactccttcccttccccctccccaaactaaacattttcattctgtagacctcactttgtgtcctagacaaaacaggatcagtgtgggtcattatgagatgattctgccagtttaataggaaaataacaaaaagcaaagatctgtctaaatttgttcttggcaaaggcaacatatgagatattatctgatttttaaaaagacgttatctaattgatatacaatccacagttgattttctaaagtggtaaaattcacttttctttgtgttttggtgtgtctctgtgtgagtagttatatttgtagaattttggttaatttttgttacaattatatttccattatatatgtttttcttttctttccaccttctcaaaagttctcctttaaagcagaaactttccattcttggtttcatccaaaagacaaatatttctgggaaaacactgtgtttaagctattcagcaattctagtgttatgtaactgaccacactaagacttccaattaactttggttgtgttttattgaagagtgtcatagaacagaataactggtgataattttttaaaacttttctatgtttttaaacagggaaagctctcttaaaatatatgcagcatcttttgataagtgtggaaggtaaatctcctgtctgaagtattctaaagtccattgactgtattccaagactgatgctaatctgtctgacattgaggcattaattttcataactcaagttcttcttgctcttctttccctcttgctcgtttccctgattatttttgtttttccttcttcaatgatgagtgcatcttgagactctttttagactgcttctcttcaaaataagaatcatgtgaattcatggtttcaaataatttcccatgtatatgtatgtactaacttagaagtcgctttcttcatttttaatctttatctctcctttctaccactcttcaatatatccaatttctttatccccagaactgagctgatattttttccaaaagcctcataccttcccattttctctttatttttatgtcctcaccacaatcccagtggtctagtcttaaaaccttgcagttttgtggggttttttttttgtttgttttgctttactctgtcatttacttgcaacatgctgcctattatcaagttgtgatgtttatttttcctaaatatcactcggattcatttctttatttcaaaaccctgatattgcctcactcagcctaggtgataattatttggtgtgtacattactgtaatatcctcttttatgtcctttttctactctaagctaacctatggataagtatgagaatcgtcttgttcacagatgaggatactaattttcaccacttttattcaacgtagtagtggaagtcccagccagaacaatcaggcaaaagaaagaaataaaaggaaccaaactggaaaagaggaagtcagattctccctctttgcagacaacatgatcttatatatacataaaccaaaaaagaattcttagaactgataagagaattcagtaaagtttcaggatacaaaatcaacatacaaaaatcagttgtatctctatatgctaataataaactagctgaaaaagaaataaagcaaccccatttatgatagctacaaaaaatacctaggaataaatttactgaaggaggtgaaagatctctgcaatgaaaattacaaaacactgatgacagaaattgaagagaacacaaacaaaggaaagacattccatgctcatgtattggaagaattaatattgttaaaataataatactacccaaagcaatttatagattcaatgtaatccctaccaaaataccaatttttcttccaagaaatagaaaaaacagtcctaaaatttgtatgtaacaacaaaagagccagaatagccaaagcaaaaagaacaaagctggaggcctcacactacctgactttgaaatatactacaaacctatagtaaccaaaacagtatggtattggtttaaaaacagacatatacaccaatggaacagaatagagaaatcagaaataaatccttgtccctacagccaactggcttttgacaaaagcacaaagaacatacaatggggaaaggatacgctcttcagtaatgtgctgtgaaaactggatgttcatatgcagaagaatgaaaccagaccccatctctcaccgtgtataaaaatcaacttcaaatggattaaagacttaaacataattcctaagactataaaactactagaaatgctttaggacattagtctgggcaaagattttatggctaagacttcaaaagcacaggcaacagaaacaaaaatagataagtgggactatattaaactaaaaacctctgtacagcaaagaaaacaatccacagagtgaagagacaacctgtagaatatgagaaagtatttgcaaactattcaactgacaagggactaatatccagaatatataaggaactcaaagaactcaacaggaaaaaacaaaacaaaacaatcccattgaaaagtgggcaaaggctctgaacagacatttctcaaaaaaagacatacaatttgccaacaggtatatgaaaaaaaaatgctcaacatcactaatcatcagggaaagacaaaaaagaatgactattatcaaaaagacaaaaaataataaatgctggtgaggatgcagaggaaaagaaactctaatacagtgtaatggaagtgtaaattaggataaccattatggaaaacagcatggagtttgtaaaaaaaacaactaaagaaagaattaccatgcgatccagcaatgtcactactgggtatttatccaaaggaaaggaaatcagtatatcaaaggaaattagtatatcgaagggctacctggacctccatgtatatttcagcactattcataatagccacgatatagaatcaacctaagtgtacatcagtggatgaatgggtaaagaaaatgtggacacacacacacacacacacacacacacacacacacacgaatactattcagccataaaaaaatgaaattctgttatttgcagcaatgtggatggaactagaggtcagtatgttaagtgaaatgagccaggcacagaaagacaaatattgcatgttctcactcatgtgggagctaaaaaaaagttaatctcatggaaaagaatagaatgatgtttaccagagaggctggaaaaggtggagagggggatgaagaagaggttgcttaataggtgcaaaggtacagttggaaggattaagttttagtgtttgataacacagtaaggtgactatagttaacagtaatttattatatatttcaaaatagctaaaagattatttgaaatgttcccaacacaaataaatgttaaatgtttgaaatgatggatatcctaattaccctgatttgctcactgcacattgtatgcatttatcaaactatcacatgtacctcacaaacatgtatcaataaaaaagtcctcttgttcacactgttcatttatcttttaagaaaattttttaaaaatctgccaactggctactttattcccacctcatttacctgaactatatggtccacttctccaaacaaatatcatctctttccatctcctttcaacatgccatttggaagactcctctttcttcctccccaaacatatttctctatttcttcaaaggtggtggttaacacagccttaataaaagctgaaattacctggtcctttaagagcgagtaccacctgactcattttctcagtgtctcagggctacattgttagtctgccctgctctctttatctgtacttgctgatgtgtggctttgtaacatcatgtagtcattttctttatgccttttctctgcttttagagtacaagcaactttaaggtagagacaatatctaagatttatttatatcattcaactataattactaagtacttgctgattttgtttttttgagacagggtcttgctgcattgcccaggctggtgttgaattcctgggctcaagtgatcctcctgcctcagcctccctaagtgctgggattacaggcatgagccaccatgtccagccacacttactgagtttatagcatggtatctatctatatcaaattatttattgagcatctgctatgtgctaggcacagtgtgaggtgctagaaatacagtgatgagaaaaaactgacattacccatgctttgatagagttaacagtctaatgggagaaacgggagaaacagacatttatcaaataatcatacaattaagtgtaaaattacaactgtgatagagctacaaagagaggaatatggtactatgagagcacataataggggtatttaactgaggtgggagaggagaacagggaaggatgtcccaaagatggagaaccacatgagcaaaggctgtgtgaagggagggagccagatatgttcaagacattgaaagaagactggggtggctggagcccagagagcataggtagattagaggaaggaagctgaagaggcaggcaggggctaacctgggcaaggccctgtggcatatgaaaaggctttaggcttttatactgagcaatgaggagccactggagggatttaagaacaggaaaggatagtatggggttttgagaagatcactgtggtcactgtgtggaggataaattaaagtgggcaggaaaatcaagcttggtgtttttctatgttgtgtagcgactcagtaaatgttgctcattgactgaacagtttgtggggcttatagttcttgctgtaatctctatattatgacgtttggcttcaagctaaaaaatcttgagctactcaaaatacgggtctaatttttaacatagtctcctaagcatttgcaattcattgacctaacatgtagtagtaacagataataacaatgatgatgatagacaacattatctagtatctagagtttagtatctagtgtctagataatagaaaacattatgtatgctcctgagcactgtgctaaaggcatgatgtcaattatcttaattaattcctactataagccaatgaggaaggtgtttgtattcctatttttttttttttttttttgagatggagtctcgctctgccaccaggctggagtgcagtggcgcgatctcggctcactgcaacctctgcctcctgggttcaagcaattctcctgccccagcttcccgagtagctgggatacaggcacatgccaccacacccagctaatttttgtatttttagtagagacaggttttcaccatgttggccaggatggtctgaatcttttgaccttgtgatccacctgcctccgcctcccaaagtgctgggattacaggcgtgagcctctgtgcccggcctgtatccctattttcttagaaatacgttgtgcacgtgtaccctagaacttaaaatataattaaaaaaagaagaaataggcttagaggtgttaaagaccttgcctcagagagaagtggtgggactaggactcaaatctagttgtctctaactgcagagccttcactcttagctactttgttatagaagttctagtttatcttggttttcagtaccatttcaataccactattatgaaaaaggagattccttcagtcccacaaagagatatgatttagctaattgcccagtaactccttcctcaattttggtcaaagcctccatggcatcagctcacccagctcccattctgcagatgttttattacatgtcacacaacctggcattatttctgagttgatggttgtatgttttgatcttttcaaacatgtggacaaatttctggctggctgtccttttttcttttacagaaatatataattagatgaggtaataatgctcattagcccaagttacaaatagtatttcagtatccaacttcctccttaggagagcatcatcactgattaagaataattgccaacaattggccgggcacggtggctcacacatgtaatcctagcactttgggaggccaaggtgggtggatcactggaggtcaggagtttgagaccagcctggccaacatggcgaaaccccgtctctataaaaaatacaaaattagccgggcgtggtggtgggcacatgtgatcccagctacttgggaagctgcggcaggagaatcgcttgaacccaggagccggcagttgcagtgagctgggatggcgccacggcactccagcctgggtgagagagcaagactccatctcaaaaaaaaattattgccaacaattggtaaactattagttgaaaaatgtttgccatcatggccggaggagctctctgcctttggcctaccatctgctaagtgctatttgcttgtttcttctgtcttcattttctataccctagggcagcctcttctttagttgtaatacgtctgcctaaagtgggcttgtaatttgcttgcctaaatataaaaacgtaataacagagcattgagaatttttcactcataccttatagtatttctgtgataactaataaaatcagcttggtccctcagaaaatggaagcaacggcttactggttaaggagttttcagaggactggtcatctttaaccaaacatgactggctctttaccctttgcaaaggaaggttgaaagttcaagcaaaaagcaggtgaaaccacagttatcatagctaggaacaaccatagcagaatgcccaactgatagtggaaagctgaagatggaaagttgattggtaagcaacacaggctgcaaacctaaagaatagggagaagcatttcatagggatattggaagaaataaatagctttcatattgttggaggaaggaatcaagaaataccagatttatttgcttatgtcctccaaaaggttttatggatctataatctttattatagtttatgagtaaattattgcaaaagggcaattatcagttttgttcaaaagtccactaccagtgagtgggagaagtttcacattagtctgcttaggtagtggttataggtaagtagaggcaatttgtgctcagtagtactaaggtgtggaatggaaatcctgccctctcacttatttatttttcttcgcatggtattattattattattgccctctcaggactgctttcttctaaacttttgactgggcataggacattatagtgcagcattcagtttgaggatgacaaagccaaggccttctcatttcttaccattttatgttgatattgccatcttcaaggcaagtttttttaaaaaacaactttattgaggtatgactgagatgcagaatgctgtacatatctaatgtatacaacttgatgagtttggggataagtatattcccatgaaaccatcaccaccatcaaagccacagatatatcatcacctcccaaagcttcctccttcctcctttattattattattagtatattcttattattttgtgtgtgtatgtgaagatcacttaacataagatctaccctctcagaaaattttaagtatataatagagtattggtagctattaggcactgtgttatagacctgtagtagatccctagaaggtattcatcttgtataattgaaacttggcaccctttgaccatcaccaccacatttctcccaccccctcaccctgccaatcaccatgctactctgcttctatgagttcgactattttagattccacatgtgagaccatacagtatttgtctttctgtatttggtttatttcacttagtatgtatttcaggtccatttatgtagccacagatggcaggatttccttttttttttttttttttttttgacggagtcttgctctgtcgcccaggctgagtcttgctctgtcgcccaggctggagtgcagtggcaccatctcagctcactgcaagctccgcctcccgggtttgccattctcctgcctcagcctcccaagtagctggaattacaggcgcccgccaccatgcctggctaattttttgtatttttactacaggcagggtttcaccgtgttagccaggatggtctcgatctcccaacctcgtgatctgcctgcctcggcctcccaaagtgctgggattacaggcatgagccaccatgcctggcctccttttttaaggttgaataataattgtatctgcaatattttgactattgtgaataatgctgcaattaatatgggagcgcaggtatctctttgagatactgatttaaattcttttggataaatacccagaactaggattgctggatcatatggtagttctatttttaattttttaggaatcaccatactgttttccatagtggctgtaccaatttactttcccaacaatagcatatcagggttcctttttgtctgcatcctcaccaacacttgtttgttttttgataatggccatccccacaggtatgtgttgatatctcattctggttttgttgcattttcctgatgattagtgatattaagcatcttttcatacacctgttggccatttgtcagtcttctttggaaaattgcctgttcaagtcccctgtctcatttttaaaatcaggttggttcgtttgctgttgagttgtatgcgttccttatatattttggatattaaccgcttatcagatatatggtttgtaagacaagtttttattacatacttatttcgaagtacagtgtccattatactttcactgtccttacttttctgttatgcaatataatatcttgcccaggtaaaagtataaagaatactcaggttacaaaccaaaagcagtaaacaaatacaaaattacattaaagggaaatggtgtgaaagtagagagaggagatacatttttattcaatgcctcctatgttccaagtactctatcagatactttacatagtatatttcgtgtaatcctcatgataagcatgacaagagacaaatgagaaaaataaggctgtgagaagtgagggtcagactcttggttggcaagtcatccagagctggaatttaaactcatatgccatatgtcccatcatttacccagacacataaatatcactccatatcatcctacataagtacatgctgtcataatttttatattttttaattcttcttgcagccagagaggtagaataaaatgtagaaaaatgtggtgtcatagagaccaatgaatacataaataaatgaatgaatggggtatatatattgtatacttccatttctagacagactctattaaagaatcagcacaccagctgcttgcatttgctctttatctattggctctggtaaaactgtaaagcaagaaattttttttttctcccgtttgttgctcttccatacctctttcctcttatatgctagaacttttctgttgttactgtcagtgtacaccaaatatggcaacacaaaactattcctagaacatactaatgcttaaatatagatcttcccctatttagcagattttcgtgtgtacagtacattattgttaactataagcacaaagatctctagaacttattcatcttgcataactgaaactctgtacacactgaacaggaattcctcatctgcccctctctccagccccaggcaatcaccattctacttcctgcttctaagagtttggctattttagataccttatataagtgggatcatgtagtatttgtccttctgtaagtggcttagttcacttagagtaatgtcctcaaggttcatccatgttgttgcatatgacaggattttctttctttttaatacttaataataccacattttctttatccattcatctgttgatggacatttaggtcgcttccacctcttggctattgtgaataatgctgcaatgaacatggaagtgcaagtatcgctttcagatcttgatttattttggttaaatacccagaattgagattgctagactatatggtagttctctttaattttttgaggaaccatactgttttccatagtggctgcaccattttacattcctactaacagtgcacaagggttccaatttctccccattctcaccaacacttgttattttgtgtgtgtgtgtgtgtgtgtgtgtgtgtgtgtgtttaataatggccaccttaacaggtttgaggttacatctcattatggttttggtgtgcattttcctgatgattagtgatgttgagcactttctcatatatgtgttggtcgtttgtatgtcttcttaggaaaaatatctattcgggtgttttgcccatttttaaattgggtttttttttctattcagttgtagaagctcttaaaatattgtgggtattaaccccttattagatacatgatttgcaaatattttctcccattccataggtcatttattcactctattgattgtttcatttgctgcacagaagctttttagtttgatgtactttcacttctctaattttaattttcttgcctgtgcttttggtgtgatatccaagaaatcattgccaaggccaatataataaagctttccccctatatttttatctaagtcctttgtgttgctataaaggaatacctgagagcaggtactttataaagaaaagaagtttatttggctcatggttctgcaagctgtacacaagaagcatgacgccaacatctgcatctgttgagggcctcaagccactttagttcatggcagaaggggaaggtgaggcagcgcatgcagagatcacatggtgagagaggaggcaagagagagatgggggtcatactccttgtaacaatcagctctcactggaactaataaagtgagaactcacacaataccttgaggatggtaccaagctattaatgggggatttgcctccatgatccagacacctcccattaggccctacctccaacactggggattaaatttcaacataagattatgaggggtcaaacaaaccaaactatagcaattttctttaaggagttttatagtttcaggtcttatgtttaagtctgcaatccattttgaattgatttttgtgtatggtgtaaaataaatgtccaatttcattcttttacatgtgatctagtttttgtacaaatgttttcccagcaccatttgttggagagattatcttttccttgttgtatattcttggcatccttattgaagatcagttgaccacatatgcttgggtttatttctgggctttctgttctgttccattgatctgtgtgtctgtctttatgccggtaccataaagttttgattactgtggctttgtaatatgttttcaaatcaagaagcatgagatctccagctttactcttctttttcaagattgctttgattattcaggatccttcgtagttccatttgaattttaaggttatttttgctatttctgtcaaaaatacacttgggatttcggaagggattgcattgaatatgcagaaagttttggataatatggacattttaacatattaagtctttcaacccgtaaacacgggatgtctttctatttaggtgtatcagcaaaaaaaaaaaaaaaaaaaaacccttataaactaataaacaaattcagtcaattgcaaaataaagaattaatgtgtttctatatactaacaacaaacaatctaaaagtgaaatttacaaagcaatcccatttacaatagtatcagaataaagtaccttggaataaactgaaccaaagagatgcaagtcttgctctctaaaaactacaaaacattcctgatcttttaacaaaacttaacctatcctctcaggactctgttaggtcacgggaaggctaatgtggtaaataaacaccaactgagttataaatggcttactggtttgtcttcccacatattgaccaggagtactttaacccaaaggtacaggtaataaggtaatatggactgaactgcctactgatgaaatatttttaaatgaatattaaaaaatttgtaaactgcaacacacaattgctctatctagcataaagtctgcctctttttttgcagaacagcatttgtacaaaattacatacattgtgaggtgtaaatacaaatagttattcttggaaaacctctctgaaattttaaagtaattccatgagaagacatcatttcagatttcctagtgttgcatacataacacgcttttcactgagtctggataaatatggtttgggaggaagtacaataaggaggcagtggaatttttttggatcacttaccatgtgcttgatgatttgcatgcattatttcatttgatctctttcaaactctttcaggtagatggttgtcccattttgcagatgaggaaattaaggctcagggtagtagcattcaggttcactcactgcaaggctggatgtgaagctgtatccacttggcttgaagctagttcttttccctttacacactaggtggccagccagggaattggagtacagagaaaggtgagtagctctgaaacctgagtggggccttgtgaatttaagccgccctgtccaggaaggtttcctgggagagtgaggttgaagaaactgcttaatatccctgaaatggaaatatttcagttactgccaaatgtgtagccaaaaatcaggttaaagtagtggtgaagttaatcttacaggttgtttaactgtcctcagttgcatttcgtggtgtccaagatcacctaataggtcctctagaggtgggcctgggttcctgaggatggcttaacaagcagggaggtagggccttcacatgattttcctctggttcccagcaacattctgccctgatcatcatagaaggatttagtctatgtgtttttcgttcgtttgttttttaaattatagaacaaccacttcagcttgctaaaagggcatctcctctctatacagtgatggtgcccttaggttctggttgtatggggataacctggctgaatgacttgtagatgttctcaagtgtccacagatccttttgtttttgcttaatgtgcccttgctgtcatttattctgctctcctgggaacatcagtacacttgatttgctaaattgtcagctcatgatatatttaccattaaccaaaacccaggcttatgtcatagtatggcaattagtgggagacctatttttttttttatttgaaggtgattaaattcatttagggtgaatagtatgaaagacatgagccctaaaggtatttgcaatttgcatggaattctggcaggtgtcaagtttgactgcattatctggtatctcttgctgttgacttgttaaaactggatctaaaaaaatgtaataatcttttatccctatagcagatctttccattatgataaaactcctgctggtagtcatctgatgaagaacttttccctgtggctatgatcctactgtgtccctacagtacaggcaactcaacccatggtggctactcacaaagactcacagaacctccaggacactgtcagtcctagcaaaaccttaccctgctttgttcccttcccacccccaatggccagttactgggtaattggggtggtgaaaagcccagcgcgatttcctgttggcagtgtgctgatgcaggagagggtatagcccctgggcatggttttggaatacccgggtgtcctctgaccttatcctctgtcctaatgaaaaacttcctggcgtctagtattgcggctctcactggggtcattctgacttaattattctaaaatcaaaatagataataggcagataatggaagttttttggactttctccttccattgttttagcgaaggaagaagacacacacaaatcctccatcccacactcagttctattttggcacctggtgaccgtcaggaaaacctgataaacttgaaagtgttgtttcccaatcaccttcagaactggagaaacgctttcatgctgactttatccatgggactgaagaaagggagagtgtgctcacaagcacaaacaggaaagccttacatcacggagtggcgtggggaggagtctgctcctcgcttgctcgctcgctcgccgcgctccctttgtggcccgagtcgcgcgcaccggcggcggcgggggcagcgcggcgcgtgtctgtgcgctgcggtcgctcgggaccgggaccggggcgaggcgccgcggggctgagcccagcagacattgcgttggcctccgagcagggcgcatcatgcagcgttcgcgcaccggagagaaaactgagaatgaaattgctttggcaagctaaaatggtaacgagagctctctgccttctcccgaggcttctctggtggggaatcttctcccgctttcgctgggcgtgttttggactccctcggagtgaacggagcaatccgattccatacttgtgagctaaagctctctcactccgctttgtattcctctctctctgcgtgtcttctccctttcaaccgtacctactttctcagcaattgcctgtggtgtgtctggggcagatgcatgtcaggaggggagaactttgaaggaaaaagaactgttagtgtgggtgaaccgcggagcgcttctgcgtcccagcggctctttaacacaaacctcaggtttagctggggacatggaaatccagggggtcgctgcacagattttagtagaagctgcctgatgatgtgttgctttttctgcacttgccagattattttacggaaataaaaactttccacccccgctaactttgtgggctccaaaacaatgaggagaaaagacaagcaaaccacttcacttccaaaggagtgaggactcttggcgttttaaacacttgtttgtgtctgagtttaaaatctggtttcttcaatgaccgagccactctaaaaagtacagacttattcttttctttttttctttttctttttcttttcttttcttttttttttttttttttttttttttttttttttttttttacaaagaattatttttcctttcacttaagggggacaagttaatcaggactaatctagtttctttgtaaagaaaaagaaagacttcaaaacaaaactatttaagatatgtgagcaagtctaggagaaataactaaatggaaaagtcaggggatcctgataccacaggaagggactgcaagccaagaaaatctcagcattccctctatcaaaatgtgtcttgtattgcggattgtaatatttattttgaacagcccatcttgtgccctgagtgctgttgtaagcagcaaggcagctgggatagattgtggttagcagagaggaaaaaaatactctttttctttctctttatcccgtccctggcagagctcgattcaggactggggtgaagaggtagaggaaggagctgtttaccatgtcaccctcaaaagagtccagattcaacaggctgccaataaaggagcaagatggctaggggtgagtaaagctggcgagatggtgaactttggaatttcagtgtctgtcgttctgtgaatatcattattatttaacagaggcaggcttttttttttttcctcttttcgctttaaaaaggaaaatgctaatgaccaagtgtttgcactagctgaacaggtctctttttgtatttaatgttttcaaaagcatcttccctaggtttgtcaataattcagaacctcttagaaacatcttgaggtctttggcaaatagattgggggtggagtggcagaaaatgacacacagaatacaggcccagagagcagcactctcttagacaagagccataagcagctttgcccagaagccacccttgtctctctctgccctcccccaattgatgctgtcagcgtctgccttgctcctatatctctaggaggtacccagattgctcaggagacagagcattccaagtctgcatcctttgaggggtggtagatttcctattgtgatctcttttctatatcttgggaggaggcaaatggatgcttagtacccactactttgtgtgtagagtggtgggcctttggaaaaatgctgcttctgtaaacaggactcttttccactgagattgtaaaatattgggtgaggtcatgcaagtttgtaggtatcacctagtagatccttcaacacatcccaaataaagcgaatatgagaaatggaaagctcagcgacaggatcactacttgggcaaatgtcaaacatgtggaagaatgaagggattcttgatctggaaggagaagtagttctcagaccaggcggtgagaggcgacccaaaaagccttgagaaagaaaataatggttggctgaatagagggggtggagtgtgatttcacctggctggccttattttagccgatgggcttcagagtgttgaagatttatgcacttgcatcccatctttagcggcttggagtctctgaaaattcagaatattttgagcagcattcaaaggtggagtgtgaaggaggataggacacaaaattgcacagggcctcctgttaagagtagtggtaacgtgtgacttgtaactccagggagtttaaggcaggatggtggcccatggccggcagcaatcacttcctctgccatgagtctgctgacacaggcattcattgctttgggcttccccagctgcttcagctcaggcctttcctgctactgtactttgggccaaggtatcacccatgagggccagaaattgttaatgacatctgcaggtgtggtctggaaagataggagctttccagtgagaactagaggtcttcacttaccaagtacctaccttactcagaatatgattttaaaattaattatgtatatcactagcagacctgatagggaaagcagaactagagttctgacaagtcatcactttgtttttggtggttgtgtgtatgtattttatttaaatgtggcgtccatgtggtttggcctctagctatttcagaatgattcacaacttctgaaccagttgtcttcaaaagggtcattacatttttttggtatcaggttattcctctctttctaatgagactgactttgcttgggtgactgttttagttttcagccatatacaacattagttatgagtaagtcattggaaatggaggggttcactctgtaggccccacatctacaaactgtcatgtatttagatgctcagagttatttagtaatccccactgactgttctcttcactagacttcacttcttttcttctctctcccttctctcagtgttctcaaatttatacagagttcagagttaattcaccctggattcaacagtagatatgaaatactgagaaggaggataatgtgaaaagattggctctagttgatggaggaatctgtccccctcgcccccatttcaacaaagtgtgatttactgctaccagcctactcctttattgcaagttcctaggggctctccagctctaatctacgtgttttcttgtcttaggtgtcctgttgggaagttctgtttttgtccttgaaaattccagacttaattaaatgtgactcaacccattgagccatagcaattacaaacctttctctttagaactgagtggcttccccatgtttgttttcctgtattccagtaccctttcaaaattcttcaaagtaactagtttcagagttactagagagtggggtcaggtgaggaaattattgcaatatgacaacaaccttctgaggaaggtggtgttgtgatgatctctctctctctcttttttttttttttaacatgaggagactaatgcccagagaggttaaattgtttgccagggtcacacagctatgaagtggtaaacaccagattcaaatccagatggttggctctttgttgtgaagaatttcctgggaccttaaggctgtttccatagtagtagaaaagaacattggctcaaaagactgaggatgctttgggtgtgcttttccctaatgttgcaagactggagagatgtaactttcttttcttcatgtctagaatgataacttgagctgcaaattgagatatttgttgcgaagctatgatctcactgataaactccccattttggaggtttaaagcagggtgcattgaagatatgaagatacgtatgaggttatgtagcatgtgaggataggcatagctttgttacgtgtctgtaatgcttattccagatgcctaaaagatggaacataatttttgtattttctagtattcagatctcaaaacataattaagattcaattttggggaggagagcaaaataattacatatcctcagatgtgaagtattatacagtccaaaacatttaggtcattcttttttattttgtctgttaaattctgtgttcagttgatcttttaaagtaaaactctgtgtttggaaaactacaaccaagtatgtcccaggcccagtttacttgtacgtgcagctgcatccttgcccattgacggtgagattatattggcaactttgaaaaaccaaatattattgaaatactgacccattttccctttacaataacatctttggctgggataattttacccacctataattctcgaagaaaaatgacttcaattatgtcacaaaatttaaaaaatcttaggattggaagagacattaaagagcaattccgagcctagcacagtggctcattcttgtaatcccagcactttgagaggccaaggcaggctaatttgcttgaggctgggagctcaagaccagcctgggcaacatagcaagaccctgtctctactaaaaataaaaataaaattaaaaaattagctgagtgtggtggtgtgtgcctgtagtcccagctacttgggaggctgaggtgggaggatcgcgtgagccagggtggtcaaggctgtagcgagccatgattgcaccactgcactctagcctgagtgagagagtgagactctgtctcttaaaaaaagaagtaatttcacccagacattcacttatcttgtgatttttggaagagcaaagtgtcaaaacttgttatttgtctttggtcccagtgttgtggttgtatatggacagtgaataatatagaaaagagttaagaaaatatcagtatcctctggaagcaggaagtgtaacatttcaggatgaatactcaaagggacagaggaaaagaattcaactgtttgggaagggctttggtgtcagaagttcatgctgttgtcttcagaatatgacagactcagggtccaaaaaacatgtcagcctaagataagttccaagtgaggatattttttttacaagcaagattgtgagtgctaggtcacttctgcaaaatttgtgggcagtggaatgatcagtggttagtcacgtggctcttcttagtcctgtacttctgtggtcatgcagtccttgtggtggggcactgaggcctttctgccctgtgtccagtgtttgtcacaccgtttcccacataggctcttgataaatgtttgtgggactgagttgaaatgcaagatagatgggagtctggtaaagagagggaaatagaatggagaaagttgaatatatgtagaaataaaagaacctagaaacattaggtcatagaacgtggcatttgggcaaattgtggccaatcatgggttatgtggggactgtggtaagataaccatttgtcacatctggattgagaagttgactctcacttggatgttctatttagattgactctacctggcattttcatggtgttgctatccatgttgccttcaaatggcatacagttcctggagttttcagctaatttcacttctgggagccttctctaatcccccagctctggatgaggcgtcccttctgtgtgctccagaggcattctgcgtctcactgttgtgcatttacctcactctgttgtaattgcctgtttacttgtttgttatcttccattagactgtaagcttgcaaccatggccatctagttggcagaaactcaatacatgtttgttgaatgaataggtcatgcctcatccttctttgggggactaatattgtttttataagtatgaatgcatagttggttctcatttaaaacaaagtctacatgaagatgttcacttacaaagaagaagaaaggggcatgggagcaagaaaaatcaattaggtaatgattatagctgtcttacacccattcgagaacaaagcagggcacaaaggtatcaattattcattttaacgaacattccccagtgccttttaaaaccaagaggtccagttgtacttctcttgctgctgaatgttgaagaaaaaaaaggcaatgcatgagttaaaaagcattggctagcattacaattatgtgtggttggaaagtgcaggagtgggattttagaattgtaaggagataagccctagaggagcctttagtttatagttggtcatccttgttttcatctaggaaaacaggcccttgggttgcattatatgtgtctattggaatgtttaatttaggctttagaaagtagatttcagaatttagcagctatgtgtaaatgaaccaactggtatttttaattttgaccttagaaacacgtttttaaaattattaatccactgatagggtagcctctaccaatcaagaaaatttagtaaatttaaattgcctgagatattattacactggatccttttggtgctagtgctttcaaattctgttgggatctgtgttaggaatatgtgacatgtaatcaagaatatccatttcaattcaccaatccagggaatactcagctgagttcaaaatacatgtcaactcccagcaaatacataatggcataaatataagaggcacattaattccttatacttaaaagtgtatattctgttaaaacaattttatgaacatattttattcttatttctgtgaaatcataaagaaaaagcctcttggagttttactcttagaaagaaaatgagagaaataaggtaaatactgtgcctttccactttagagcttagctggaatttgtcactgcccaattccactccctttagtttcctttgcccatggtatatgtgtctctttaagcttcccccttctaaataatcagaattttttgactgtcttacgtattttatgttaagatatgcaaaaatgcactacatagtaaaacattctaatttgtaccatcatattctttttacataaaaaattagtttctataaacagagcaagaaaagttttggttaagtgggggaagataagaaatgttacttcattccaccagagaagctcagctctgtgtctgggttgccaatgggtgtggctatctcaagacgtagagttgatttggagttctttggagattttggcagtttctgggtcatttgctagtaaacacatccagtgtgaactccctcgctgctgttgcatatttctatatgattctgtcatttgcatttgagcctgctaaactctccttccataccattcatttattcatcaaaagcctgctttatgccagacaccatgttaaatcttgagaatacaaagtaaaatactccttgttctagaggaacttacaagtaagtgagggagacaaagttgaattaattacaatatattgtggcaagtgtgaccattgctaggggagcccagaatcaggggcatttaaatcaaatgcgagtgacaggtgggcagtccaggaagcctgcacagaggagagggcccttcagtggagaagtgacggatgagtgagagttaaatgagggctgggacgctgggggccagcattccaactagagagcacagcctgtgggaaggtgtggaggcctgaaatgagacttcccctgtgaggctcagcctggggaagagataagggaacccggtgggaaagggagaggaaagggggctggagagaaaggcatgagtcatgtcaccaagaacctggaatgctaagctatggaatctgcttcatctttaatgttagcatagtcattgaagagttttaagcagagtggcatggtcagatttgcattttagaacaatgactgacagctgcaggggagatgcatcggaagggagccagactggagcatggggacccaggaggaggctttctttagtggtaatgaagtgaagaaagggatgaggacctgactgaagctgtggcggcagagtggacaaggtaggtggggatgagtgtaggcggggcacagggcgaggattcctggcaggcacactggtttcaaagagcaggtcagcaaaaggctttctggagtcagtgttgtcctcttctcactgggtgaaatgtactggggacttcaagtcagccttcctccatatacactagcaaatgcctgcgttactgtcagaaggcttggcagaaaaaccagatccaggcatgcctgatgtgtcatgtctagagacgaaatcacagtttaggctcaccatgaacaaggcagaagccctgcttgacttctcagattccagagaactttgcagagttggtggtttctttttctttcttcctttctttttttaaagtcttctgtttccctacaaaccaaacaaattgaatctgaagaccatggagagagaataaatatggaacctgcaggactatgattacagagttgtattttagaaaacagcagttaaacttataattgtgttgttagggacacaagaaattttatggttaggtgtcctggtctttttccatcttcctacacaatgtgtttaaattctgtctgatactctttatcctagcagctgacattgctgttcttaaaggctcactctgattgctaattctcactccttgtataaaagaaaaatttcagtaagatagaatgcttccctagtttactgctacctcctctcagtctcactcactctctcacttaaatacacacacagcctatatattaaaatgtcttttcacattttattttttaggatttggttcaccttataatgtcacttatggcctcttctatataattgatcaaagcttgattttgtcatgttttgcttgatttcccttaattgtgtcattattgagattgtttgattgactttactcagagaactgcttttagtttaaaaaggaataaaaacagaggaagaaaggaaggactaaaagtagaacaagcttacaacattgggtagaagacaccaccttgtaggaagctcagttagtctcatacagagagagagagagagaatcatgtcatttcccactgatccttttgtcttgtcattgtagaaatacctgtgtctttccactgatgtgactgcatatgtttcccaatgctttgggcctctgcttggcttgtttcctcaaaaccaccttctcctttatgttatgtggcgtatgacttctgaggataacagtggtggtggttgggggtggggtgttgctggtggttctagatcttttttaaactctcacagactcattaccctacattttctagcatgtaattgcttatgccatctgtggtccattcatttgaatttgtttcagcacagttaatctaatcctatgtaaactcccccagaagttttttatgtttttcttttctgcaaagaattcagcaattcaacttttttcccttgtttcctgctgttttaaatactcattttcatcttttataaaaatgaagccaaggctgagtatttccagtttcttaattctgaagacaatttgaaggcaaaaagcaaaccttttctgctaagggtaggatgtcttaggtcagtcatatcaactgaatctctccgcaaccctcttgctagtaattcttccatagttatgtgccattcttattatgcccataacttctgtcactaatggtgatggagctagagtctgtggacaatatttatctaagaaaagaacatttaagtatgtaggtaaaaataactgaaactggattagacattggctaaaaataaaatgctttatagtcatgacttttccaattaaaattgcaatacttggctgagcgcggtggctctcgcctgtaatcccagtactttgggaggtccggatgggtggatcacttgaggtcaagagttcaagaccagcctggccaacatggtgaaaacccacgtctctactaaacatacaaaagttagccaggcatggtggcatgtgcctgtaatcccagctgctggggaggttgaggcaggagaatcgcctgaacctgggaagtggaggttgcagtgagcagaaatggtgccactgcactctagcctgggcaacagagcgaaactccatctcaaaaaaaaaaaaaattaaattgcaatacttgaaattgtttattgagataaatgatactcctaaatagaaaactgaggtaattgaagcatttggttagtttgtgaagcacagggaaaagacttgccactttctgtccaaaggctgattccttctaaagacatgacacaataaacatgtctgttttaaaaatgactttagggcccagagccatcaaggcctggctagggaattagctcagttggggacttcgtagacactggcacctcctggctgcttttcattttcaggggtatgttcagcaggagccctggaatagggaggtagcttagcacagtggtcaagaacctatgctttagagccagacttccatgcaaaactcacctctaccacatgtgagctatacaggcctgagctgtgaagttacttaacctctctaggcctgagctccttacctgtaacggggagaatagcagtgccttcctgatggaatgactgtcaggagtaaatgagttatgtatgtaaggtgctaggatatggtgtgcactcaactcactgagtggtggggctctcgtcagcacccccaccatcagggccctctagaaccctgccatagaaccttggagagacctgggtggctttcttacatggaccccctgaagcttggtgttatatgtaaccccaggttgcttaagaaacagtattagcaaggttttaggacatgtcattaacatccctctctcattttgtacatttgagaggaaggaacaatcatggcagggtttagtaatcctcgtatattagaaataacatctattgtattttatctctctggctccttgcataatgaaagactgcattattcctcgggctccaacattttgcatttgaaattccttcagttttctaaagtaatttgttggtattatttttatgctttaaaaaatattttattacttaacagtgggccatattctgtcttctgttttgccatttctgacagaaaaatcagacagtcggaaacaatttttctaaaaactgcttggtaagcattatgctaatctttcttaataggacataatttaggatgttagtaaattgttcttgcaccatcagtttcaagtcctggactaaactacatgagataaagataaaatttcttactgtgctacacgttgattagcttatacagtgcctgagccccactgcctcagccaggaatgagctgagttgcttgtgaggttgtgactttctgaatcttccatttcctcacctgtgaaatggcgttaatatctgtttttactctgcctatgatttttgtgaggatcagatgagttaatgtgtataaaagtattttttaatatgtaagtttttatacaaatataaggatattcttactgtcatttaacctagaggcctttttttctctctgctcactacctaaatgcttgataggcatgtggctctgtttattagtcttgcctttcttccttcattccagaggcaatcttttctactttgttttcttcccacttgctgccacttgctgattaactaatgagaggtgatgttcagctaggaggagtgcttcctctgctaccaccgttgtccccactgggattccaggtgcatcgagaatgcagacagcaaggcttctgtttgtagattggttgtgggaaaaaaaaaccccatactcacaggattcttaagacaaatgcagtggatattttgtgtttgaaaatgttctatttcttctttgattcttccttttctttctggtacttttaatttgttgtgagaagggtgataaagctaataatgcaccaaggaatggaaagtgcttccatctttgcagaggtcctggaaagttaacttttggtctgaagccaaatcccgatgtaggacttgaactcatgacctaatcccagaggcaagaatgttaccagctgaccaacactgaccctcataaaatgtagacatttaaaatactcctttgagtagtcctgttgctgctttctatgttttcttctctctttcagtcgtttccagcagtgttcctggcctccctgttaggagcacagttttaaagatctatttttctcactgtctttccatttgctgattatagctgcttccttcttgctttccatttctcttgtgtgagttcctttttttgttcctgttccttcctgtccttcttctgacttaaaaatagattccagggtctttggctgctcggccacaaatccgaccttccttctattcatatgggatccccctgagcatctaaagatcttttccttctctctcaagatacttgaaccccagcattcattccctgttctcagctgacttgtggagctaaatgacccttgtactcagagctgtaactgaaaattaaatctctcctacaaagatgcttaataagtgatttacttatgttaagtgttactgacaaacactgaattctccctgaatctactgactgtgtgtggtggtagaggagaagggactctttgtacactgactcaaggcatgcgtgtaacactcgtttttgtgcaaagcaatggtactgtgaccatttgaacctcaggaaccagctttcagacaacgtactgttaagggtatcctggagggacctgctgctgttttgttcccacagaagtgtttctcagggaccgaaagttgattaaagtgtttcctcatgaacattctttggttagagttggaggattatgatattctttacagaaatgacttcctatccaatgttgatctagacaatccacaaatgagtgtctgctcgagggataaaggcttgtaaaactttagatgactgggataaaaagtgctgatgacagcagctctgatttcagtgcccaaccccaacctgaaatcactattatgctcttgttacagcagcagggatgatgatcctcttctcagtggcaaaagagttttaaaaggtttccttccatctggacctccagacataacctatgtggttatgtctccatgaaaagacctggtcctattcttagtagagaatccggagtttttggtttcatcagccatagtgaagttcacatttatgtgcagctctcttatcactgtgtcactgcttatggcattgcatttacctgccctgcttttctgttcactggttgactgatgaatcctacttaaccctttaagttgcagctcaaatgttatctttactcttctacttttcccaacctctcttctggattaaggatccttttatctgagtttccttagcactttaccaaaagctgtattacagcacttatcacactattaaaaaaaatgtttctctttgccctattcgtttcagtgtttcatgaaagggcgggggccatatttaattaatcatcatattcccgtaacctgggacagtgtttgagacatagttagtacttagtgagcatcttataaattgtttggccttatctttattatagaacgtgtatctttagtgacttttttttggtatttggtaatattgtaagttccattttttgaagcaaaaggaaaacattgaagcagctaaatttagcttatattttatactccaactactgataacaataaaaaaaagaaagtgatgcttttgcctcatctttgtcatcattacttgacctacacatttcatgattgtatgaaaagtggcctaggtatgacagtaacctttatagatgggatgacttggaatttagagttaatccatatacttcttagtgacatataggtttgagtcatgggtcaaggatagacctctgggaactcagtttctgctttgaattctgaagttattctacttaggattttcatgtatcttattatatctggtatctgaggcctataattggcttcaaacttgcattgacccactgtcaagccaataaggctttgccctacataacacatttttatgaagggatctgacacatctccatgaacatagtaatgaaggttatgcccataatgatgaggcctgttactctgagatttatgttgcaggcttgtcctgtagtgtactttgtgtggtgcacctttcttaccggaactcacaggcaaaaggagacttaataagtgacataaattacataatattttgggtatacttttacattttcattagtacaactcaattcccttgctctctggccctccgacacttttctttattctgtggttttacattcttaagtttgaaattttcactttaggcaaaatgtaaagtttatgcaagaggttttcagaattctagaatttcagaattctgtttttaggtgctttcatttacattgtcccaaatgtaattggctccattaaaattaagtgttctgatggcttctgaaccttcctgcatgcttccttgcctttttctttgcatcggtgttcaatggcataaatgtttgctttagaaaagaaggatggacttttttttaaagcaatgccattcttaaaagagtgttgaagcaacattatacttttttttttttttttaagagacagggtcttgttctgtcgcccagtctggagtacagtggtgtgatcatagttcactgcagctttgaactgctggtctcaaagggttctcctgcctcagcctcccgaggggctgagactgcaggtgcacaccaccatgcctggctaatttttaaattttttgtagagatggggggtctcgctatgttgcccaagcttgtcttgaactcctagcctcaagcgatcctcccaccttgggcccctaaagtgctgggattacaggcgtgagccaccatgactagcccattttgttttgtttcgttttgatttaaagaagaagaaaatcatctataattctgccatgataacacagttcttttcacttttacttattatcttccaatttttgttcacaggcacacattttaacatagttgcaatcatgctatctattccgtttgtgataggcaggaaatatttttcagaacaaattagaaaggttactttctaatttgaatcgtttgtgatatttgttatgtttctgatgccacagacaaaagaatgtatttggacttggtgtttgaggagttttaaggtgataatgcttatttattggttaatgagcctcatttctgttttttacccccacgaaatctcccatcctgtatcaggggtgtggggcttgcatgaggaccctgatagcaccatatgagatgagggcatgtgacaaacgtgcagtggaattcagctggagtggatggtgctctttccttctgcttctagacatcattgccactctcttgctctggaggatgtgggtccagaactctctaggcctgtgctgttcaatatggtaacaactagccatatgtgcctattgagcacttgaaatatagccagtcctaattgaaatgttctgtacctgtaaaatccgcaccagagtttgaaaaaataatgtaaaatatctcagtaatttcctatagtgatcacatgttaaaatggtaatactgtgggtaaaatgggttaaataaaatgtatcgttaaaattaattttatggctgggcgcggtggctcatgcctgtaatcccagcactttgggattacatacaccaggctgaggctggtggatcacctgaagtcaggagtttgagaccagcctggccaacatggtgaaaccccgtctctactaaaactacaaaaattagctgggcgtggtggtgggcgcctgtaatcccagctactcgggaggctgaggcatgagaattgcttgtacccaagaggcagaggttgcagtgagctgagattgcgccactgcagtccagcctgggcgacaagagcgaaactccgtctaaaataataataataataataataatacttgtacctgtttcttttcaatgtttttaatttggcaactaaaaaattttaaattgcctatggctagcattatatttctactagacaatgttgctctcaggccttacttttcaaaatgcagcttgtggtttatttgtgggttctgaagtcagttaggtgggctaaaaatcaatattttaaaatcagaacagaatggaatagaaaatattagaatgtcattattgtaaaactttttgtttaaagtatgcatgtgtggactggatcccatgtaaaatgtattttttctttttactatgaatcatggctaaaaagtttgaagattagtaatctggggtggcctgacttaatctgaagcattaccaggaggcctggtctgctctgtaagagggcaggttggtaccaggaacactttatagattttaggtctggttggtaaaagctattctgggactcttcaactagaccagaccctgcaggaaagtaaacctgaacattagtgctcatcctaaaagcagtggccactcaggagacttccagagtgaagggtgaactaaggatagcttactgaaagctggacctgtgtgctcaaccctaaagtgtccctggagtccaagaatgacttttgtctggttacttgcttctcggagactttttcaaaatggtctcatgagtggtgatactttctaagaagcaggatgatttcctaatgaccttagagccaagatgaattggacagggttccttgtgaccctcaggtcctccctgcatcatatcctgttgaaatcagaagagactgtattctaatctagaagcatgtctgtcttcttcctgcctgacagaaaacatgtccttacagtacaaaagatgtaggggtggtcaccagagctgtacttttggctgggttctaaataaatgacactgtaagccacagagagaagggagaaaaggctccaaaaatgaagtttatggggttacatgggccttgtatttattctgacagttgtaaaaattcttttgggctgacccatttttcttttcttaattaaaaaaaaaatatctggcaggcaagaggaagaaatgtaaaccatgtgactaatgcttcagctttttctcctggagccagattctttaaaaattataccttagacatgtttgactttttaaaaacaattgcccacaaaagccaccaaacattttttttctgaaacttgtagacttagatagcattcattttcaggaaggaatccaaaagtacaatatttaggagttattgaaccaaaatctcctttggagattttgccctggtgaattagattaccctaggaattggcagaggaacaggcggccttttgcctctactttgcttgagtatttccagtcctgttggtagccacccaaaatgtttgagggagttagactaaaagatcgtcaaggtcctttgtagacgaaaagtactatgactccagtgacggaatgacatggcagtcaggagttatgtttatgttgacctcttgttttatacttattgcaaacaatttgtttgtttactcactcactcaaatttgagcacttactatgtgccaaatgttggcctttgtaggaaaatcataggattttagagcacttatcatagtagatttgagggcttcaaagtcaagttccaatctccctttctggggtgatttcctatgtctcacttttgcaactccacacttcagctaactgggctattttcctgttttagggtcttttctcttgctgttgccagggtctaaaatgtcctcctttccttaatgccagacatctttaaatcgccagacatcactcaaattctagctcaaatgttacttctgtgagtcctctctggtttctcaaaaggtagtaagtgattcttctctcaagccaaagcactttgtacttcttttttttaacaccacacataatcttcttagaatgaactgtatgaaatcaccagttttataagttaaaaatggttaaatattggcagcttcatacagttccagctaatattaactgtgttattgtatggaacttaaattaggcctctataaatatattgcccccaagacttatagccagaaatattcttttgtcttttcttcaaaaatatgagttattattaaactaagtttcattaaacctgtgcttgcaagtttcatttaaaaaattaaatatagaaaatatttatttttaattttattagtcttagctaatcatctaaaattttgattcagtaaaccaatgtattagctataactttcagtgtagtttaataaggttctgtataattatctactttatttgttaaaatgatttattcaacatggctaaacataaagctctgtgatatattgctggagacattccccactcccagcaatactcgccagttaacatttttttcaccattcagtattccgtgacatctgatttggatacatatctaggcaactctacaattattcaacttacggagttccactgtagctatagagatctcaggagagagttggtgggatagttatttgaagtcaatgaatatcatgtctgtagcattccatgttacctgtatagaatcagagaaggatggaaagttagtttgatatgattttttttcttttaatttagagacagggtcttgctctgtcacacaagctggagtgcagtatggtcatagcttactgcagcctcaaacttctgggctcaagagatcctcctgtctcagcctcctggatggctaggactacaggcctatgcaatcccccatggctaattcttttaatttttttttagagatgggccttgctatgttacccaggctcatctcgaactcctgggcttaagtgatcctcctgctttggcctctcaaggtgttgggattatgggcatgagccactatacctggctgattttatttttctcggtgattttatgttagttcctagtgatcgttgcttacaaaccaaatctgggattttgggaacatttgttggcagaactacccatccgttgttttcagtctaccttaattgctgcctaaaaattggtataccttcttgtacaccctttagacaccactgtgattctaatttctgtgaagattccgctcatcacatctgcttctccttttagtgtccttccaggttatttatccggccctggagacatgaaatcacttgaagggctaagtgctttcttactatcaccttctctatcttgggctttagtttcctcttcaccatgctggtcctaccctttccagtttgaagatcattttccttgatagggaggatagaagcaaaagaggagtgaagtagttctgctttttctttgttatcagttaacattaccccacctatcagcaaccactgccttcctatttttgctcctagaatagctgaaaaaagtccttttacttgaccttaacaattttgacaaggctcagttcattatactattcactttcatgttactgtgttttataaatatgtgttatcctaagtatatgtatagctttaattatgggacctgctttctatcttttataatttggaaaacatgtacaaccaccttgatctctttaggtgctttctttcattgcatattttaaatatttgtctcacctttcttgaagcctcttgcctgttaaagaaggtttatataataatgctttcctaatgtttgggatacatgtctgacacctgtacaagaaatgtaatcaccctccgccaaggtttctatatatcctgcagcaaccatttttcataactgagcataattatgtctggactaatagttatttttatttcctcctatcagtagagtagataaaaacctagaagaaagcattgatagctattggtgagtgcttatatactgagagggaggagtcaaagataattccaagacttttggtgtatttgaacaaagagaacagtggtatcattagtagaaacagggattctgtgaagaacttctttgtggtgctggtgggagggtagtgatatagttatttgaattttagacatatcatgctggaagggtttctggattagaagagatttgggattagaggagtacatttgggtatcatttacacatcagtgatactttaagcagtaagaatgaatgatatagagaaaatggaaaataaaagagtattgcaggccaagtgtgagtaatgtcatgttcaggggaccaaaaggtagagaccggttagcctaggagtcagaaaagcatagctagggaggtagcagcagtaacaggctaattcattggcacagactttaggggaggccaaagttttaaatacataagactgtgtactctaaaaacaagtaacatcctgtcacttttggtcatttcagctttccaaagcatattttaaaactgaacattaatgaaaagcttctctgagtaacccaaatagctctcatcccataggaaaggccaggaggttatcattcttaatgcatatcatatcaattctgaatgcataacaaagttggttgtttatataaagtcataatgaagttccttgttccagttgagtagaagtagcaaatctgaagaaagtggggcttttagaagcagacacactcatagcaacaaaaactgacaatcccagtggaagcctatgttcaaatgtcaccttcttggtaaggccttgtctaatcactcatataaattgcaaccatgaaggccagacgcagaggcccacacctgtaatcctagcactttgggaggctgaggtgggaggattgcttgagcccaggagtatgagaccagcctgggcaaaatactgagaccctgtttctatttttaaaatcaatcaatcaatcaatcaatcaatcgcaactctccccatctctgtctctctctttttttttttgagacggagtctcactctgttgcccaggctggagtgcagtggtgcgatcttggctcaccgcaagctccgcctccctggttcatgccattctcctgcctcagcctcctgagtagctgggactacaggcgcccaccaccacacccagctaagtttttgtatttttagtagagacggactttcagcatgttagccaagatggccctgtctctattttttaaataaacaaatctcaactccccctaaccctgcaactccctatcctccatttcagctttacttcctccttaacaccactgtctaatatacctttttatttgttcatttgtttcattgttattgattgattgattgctgcttcgtacattagaatgtaagttccatgaggacatgggttttggttgtttttttccccctgctatattcccaaagtctagaacagcacctagccgatggaagacacgtgattatttgtggaataaatgcatgtaagaagaagatgatgatgaaataccaggcataaaaataagaaaagtgtataggtatatagatcatttagctttggaataagcacttctatttatgtcagtttctctaggggaagatactacagttcattgtagcactgatggcctactgagctgtaaatgaaaggttaaactgtgctccggatgttctgcttttgaaggcagaaaaataacatatttcagtaacattttaatcaaataaatgaaacttttagaatgttgatgtttaaagggtccctccttgggaaaataattcctgtattgaacactaaattctcccatgaatgaccattattatgtgatttaaatgtacctttttttttcttttcttttcttttctttttcgagacagagtgtcactctgttgcccaggctggagtacagtggcatgatcttggctcactacaacctccgcctcccaggctcaagcaattctcgtgccttagcctcctaaatagctgggattacaggcatacgccaccatgcccagctaatttttgtgtttttaatagagtcagggttttgccatgttggccaggctggtcttgaactactggcctcaagtgatccacctgcctccacctcccaaagtgttgggattacaggtgtgagccactgcatccggccgtgtgccagtttcttaaaatttgatttttccttaaccttattgacaccctgaacaactttcttgcaggtccactggaaatgttaaacgttttgcctccttttttttccagtctcagagacctttaacccaaaggtgtggaattaacccaaaggtgtggagctacagagaaatatatggcagctaaacttaaaaactgttaaactggaatctctcccactggttttgctttcacagactgttgctttattgtaggacgtcagtggcctgtttgttactctcatgtctttttggcaaaatgaatgagtaagtgcttctaaattactgtgagatgcctgtcgaattgcataagtagatttgaaaaatgctgtattttcgattaaggtatagctgcaaagcatagctcttcagttcaagaggcgtagcctgacctcctacacattttacccttctccacagttgcctcttagtccttgaaaaaacatttttttcttattccctctctttcattatttacgttggatacaatagctgtgtacgctatttccctggctcaatataatataagtttttaaactttacaatctatggtagtgactgagaaaaactttttaatgtgaagggaaagtgtccccactttaattagaatgacaaagcagtatggagttatgtaataggtattcatgcagctccattggttacataatataatggtcactcacaacagatacttaaatccatttcacatccaggaccattgtgtccacttgcagagacagtgctttctttgttttcaccaaataaatagctagtgattattagcttagcttttaagttaaatcacattcctggaaagggaaatgttgcaacttttttttaataggagaggagaatgcatttttgaaaatccaaacatactattactgccagtgatatgaccattacacctctttgacaagagaaacctatgttttatttaatttagacagttataatttcacatagtcacatgacctttatcctgttaatatgcaatctaaatatttgtcttcaaacggtttcagtaacatggaacagccatgacttaatttgcctacgatgatgtcttttcccttccagcaccccgtaagtggaattttgacttgttgctgagtttgtgatttatttacagcatctgacatggagtaggtcttaactacttggcatgtgtggagtgggggtagagggcagcacgtggggatgtcttcagtgagcaaatggggggcctgacctactcggccgtctggtgctgctccttccgtgaggctttggagtctgagggatctgggttctgtctttcgactcttggctctgtcaattactagtaatgtgaccaggtggattgcttgtcctgtttgagcctcagtgtcctcatctataaactgagattattgtgagtatcaaatgagattgtgtatttaaaagggcttcgaatattagacacaaccaaagataatgattcccaatctgaaatttactagtcaaaaatgaacttgtaacactgattgacttctgtattcatttcctctgatctgctccagtcaggaacaagttaaagcaagtgtatgcttctactcggaataaaactggtatcagtcaatgacaatggaaaaagaataaaatttgcccctttctatgggtgaggaagagagttggagaggagaataataacactgtgctcagtagaagcagatgactttacttcagtcatggtttatttcattttgtcatcataggaatttctctaatattgttaccatggttcttaatcatcaatgcttgttataataaccgggattgaatgcaccttcttcagttacagggatttggatttagggagttggaggtggggcccgtgaatctacttttaacaagtaccccaggtgattctgatgaaggtggatcagccaggcatggtggctcatgcctgtaatcccagaactttgggaggctgaggcaggaggatagcttgagcccatgagtctacctgggcaatatagtgagacctcgtctctatgaaaaaaataaaaaaattagctgggcacaatggtgtatacctgtagtcccagctattcaggaagctgaggtgagaggattgcttgagcctgagaggtggaggttgcatgaaccatgatcatgctactgcactccagcctaggcgacagaacaagaccctgcttaaaaaaaaaaaaaaaaagtagatcgtgatcaacatttaggaaattttgctcccatcactgttgctttctccagtagttttctaagtgaatcttttctttttttcatacagttcattcttcatgtaaactcattcatcatgatatactcatatttacacttacatttgatcctgataatacccacctgcttaaaaccctttaaaagcttcacattgatactaagttgagtatcaaagctcttctggctgagcttccaccactctcccttggttcactctcctttggccacatcaacttctttttatccttcttgtattccaagttacttcatggcatttgcacatgctgttccctcccctgaaacgttctctctctcaccatttatctggtgcacacctactgattattcccatgtttcctcgtgaaatttatcttatatctaagacaaaacctgatcctctcatgtttttaagcagctttttatagggagcaatggtttctaccgccattagacagttgttaaattatcttctctgcttgaatgttggcttcatgaggatagggagtgtgtctgtgttgttcatttctgtatccacagtgtcctataatagtatgcagaatatagtggaagctcaggaaatattctgaaaaatgaatgaaaatgggatttgtggcaaagaagtgatgctctagtcctccacttatgaggatttaatgactgatgcagtgagtgggcctttttataaagtggcaatgcgcctaacttagcattctagaatgagatgtttatttcagtgataaaaacttcttataagttcagacacctcaaacaatatcctttgtgttcaacgcttagaacctggtatgggaaaaaggggaagttataaagatttcagatgaaatcctgacttattttgcatgacatctttcatgcagaaagtattggaagctgcttggtagtccaatgcctcacaagtaaatttcttgcaatgtatttatttatacttatatcacatagctggttgattagattgtgtattcatttcctcagatactcccacttggagtggtaaaaagtcaagtaagtgcatattcccactctctgttttcgaagcaaacagttggcccagtggcatctacatcagatagaacaataagagcaatgtcagccccagagaatgagagatctttgttatgtgtagcttgattcagcatctcaatcttgttgggaaaagaattctggagaaaaaaaaacccatgacttaagtaatttttaaaatcatgataaccaaatatagaattaattggtcttcaaaaaaatctcagaacagtcattttaataaattcactgcagttctcaactgctatgaagagatgggaccagttaattttgtttacttgaaatttttagttcagaaaaacagatttttgtatttttcaaggtatccatggagtttcgcatgcattgaattcagatttaaaaataatatgcaatttacttacagtattactttgttttccattcattaccacaaatatttactgagcatccattatgtagtagacattattttatgcaccagagacacagtggtgggcaagacagttaagggctctgaacccatggagtttacaggcaacaaacaagtaaagaagtcagtactatcaataaattagtctagataaggtaatctggtgtggcaggggaagatgggaagtgtgacactgaccagaggggtgctctagggggtttatctgagtaagtactgcccaatgaaaagaaggcaataaggagccagtctgagaacatgctcaggctgagcagcatttaaggcagatggaacaaatgcaaagatccttccatgagaatgagcttgctgtgttttaggaactgaaggaaggccagtgtggttggggcctagagagggaaggagatggttttggtagtgaggtcaaggagataggtaggaagggctttgtgaggtctggcagaaggctggatttcatttaaaggattatgggaagccagtgggaggttttaagtagggagtgacaccatctgatttgtgtttttaaaagatcaccatggatgccataagaacaatttaaaagattgtttattttagcagtccagctgagaggtgatgatcaagcattacatgcttttattgtatatgtacagactttatatgtacatatttttatttgactgaatttggaagaatcaagtaaaggttatttagggactataataatgtcactagatagattcattacattagaaacatatccatttaattaatattcatgaagagcttattgctgatttggttgaaggccaatttctagagatttaaatatgaatagtctttgctcttaaaaattttacagtctagtgcgggatacctataattaaataaatacaacctaatatgggaagtatatggctactatgaataaaactgtaataaatgtttctggccatgtcttttggtgggcatatacactcatttctgttgagaatatgtctgagtgaattggtgaattataggataggcatgtcaagctttagtagcttgttggactttattataaaagcaggatttgtactttagaaagatcattttgtatatggatgagtggttgaagtgataagactagaggcaagtgagactagttaggtgcctattactcatacccagttatggactgagatgtaaattaaggcaaaggcaatgaggctgaggaatgagaatgaagtgggacgatataggagatggaagaggttggattttggggggatgagggagtaaggatgatctgtacatttatgacttgggtcattaagtcagaggctagaaaaggggtgagcttttagaggaataaaatgaatttccttatgtatgtgttaaattagagttgtctgtgaattattcaggtgaatgtggtaattggaaattcaagtctagaattcagaagagaagtaaaagctgtagataaagctttgggagttaatataatatttgtgttaggtgaaactctaaggatatatgtgtgggatgaccagaaagagtatagaaaaagaggaaagaaggttgtggttagaaatgtttccatattgatggtaagtgaaggatgaggaactgttgatgagcctttagattcacagaagatttttgaggaagatgagatagtgtggttaagtctgactgtgggtccagactgcttgaatttgaatcctggcttttctgcctcttagctgtgtgacctggaatgagtcacttagcctctctgggtctcagttttcttatctgtaaaatggggataataaatgtatctgctttataaggttattataagatatatacaaaatgcttggaattgttgttgttattgttattcttgagaaaatgatgtttataaggaaaaggtacagagtttcaggcgggaatcaatagtgccgattctccagggatatcacaggaggtaagtgctaaaacatttccataggattgacaaccagctggaagagtaatgggggcagaaacaaactctgtaggctaatcataataccgtccctttttgtaggaacacctattgaatttcataacataaacacacaagcaagatcacatggtttgcttgaaagcctctcaggttattgacataagtgctagtaataccttagtttaatatatagttctttaatttaaagcagctcaaagtgtatcctgtgttcttttgaatcaccctcataacatcaaggtgagttaaggaagatgaagataatattcttagtttacaaatgaggaaactaagactaagagaggccagatgactttatccaagcttttattaatcaacttctctgttatcccatcaataaaccctagtcatccttgttttcacattgtcaagcatagtatagctcaaagggtaatcaatagagattctgcagtttagaatcacctaggatgctggttaaaatgcagaccacctagcccttgttctgggtctactgatcggaatctctggggcatgggctcaggaatcagtttctgcccagcactccaggtgaatctcttgaaaaccctttagtgtatttaagagaacaggcaaatagatccataaatgtatcttgtttattagtgagatttttcacaaaaaagtgttaaaatattttgtattcagaaactcaggctactataactaaaaccttagaaccttgttctgaacatattgtatgatttgctatatttttgcagttgaatagtacttttggttaaaagtaaaactgatttgaccttacaaatgaataatagaatccattggtaagttaccacagcactgctggagaagtcacagagaagctatggctgaggactctattttatatcgattcggttaatggccctacctgcagttagtatttttagttatatagtattgattagaaagagttgctccccctatatttatagcttcagtatgcatatgatgatgaaatgagccatatctctctctgtttttttttttttttagcatagcagcataaaactctgaggctcaggtagctttgaagactgtctctaggaggtgggacctcataagagtctaggccaggtctaggtggtaaaagcctcgtgaatttactttcttatttaattgtagaggaggtgcatttatctgtatgagttggcgtcttatctgtctattaatttgttgtatctctggcttccagcagccccatagtaggaactcaacaaatatttgctgaatgaatgtatctactcaagtgtatttaggaacaaacaaaaacaaccaaatcaaaaggaattatcctagctcactaccgagatagctagttctagaaagcactagcaagtagctgataattaattgaactggaactagaaacagagtctagttccttgcccaccctccccttcattttttcctgactgccacctttatcattgaatcctaaggttgcgagaggccttaccccatcagttctgcaactccctctgtgaggctcctgcttatttacctggcatgtatttaatgtctatggcatatgcactagtactaagctctgtacccctttctttacacgtcattaaatgaagaaattcacactcatcatctctaaggtttttagagagtagaaattccttattccttttatagatttccttagtacctcatttgagttcttggcacaatggaggctcttctctttttattttgtattttttttatttttagagacagggacttggtctgttgcccaggctggagtgcagtggcacaatcatagctcattgtagccttgtactcgtccgttcaagagatcctttcacttcagcctcccaagtagctaggcacatatcaccacacccaggctaattttctaatttttttttacaaacagggtctcactatattgcccaggctagtcctgaactcctgacctcaagcgatcctcccacttcagcctcccaaagcactgggattatatgcatcagccaccatgcctggccaaagcacttttaatactgttttaatgactgataccaagagcgggtcacaagccatggaaatgatgagcatcttcttaggaggataaatattttcttttcaaacaaatgcctatctttttacataaaattttgatcattaatatctagtaaacaaaatgtttgctttcttggtttctgttcatttggacaaattggatctgtgtttttttgccagctaccaggcctttctatatgctactttcttctttaaatgtttttttacaagtcagaatttataaatctgcccttttgtctggctgtatcccataatcaatcatattgtcattctgctttcatttccctttatttctgaaaatagaaggaaactgtcttttgactagagagtagatctctaaacctagcaggtaggaaaattatttaataatctggaaatcagagcagaacacgagtgctttccatggattcccagtctgtattacccagtagtttctcatgcagaagccagcttctcctggctttccttgagcccttgggttaagtcattcatccatctttcttagactcttagactaaatttactcatttaagaaactataataatgagagggattttgtttccccccaaagagagtctttggcactaagacgttattttttgtctttaggtgttaaggatttcagtcagtgtcaagaggtaagaaggataataccagagataataccagatgtaatcagacttaactttgggtgaaagtagttggtgtaggggaaagaaagtgaaaagtatttgtagagtgctgaatagcttgtaatctttcaacatgccttagatctattatctaactttctctttcttacaaaaatcctatgaagtctgtagattctgggcaattgagttctgataattcttgggtgtacagatatggagattgagtacccaataccgtattgctttgtgtttttagggaatattccatgattgaaagacagggctggttttatatccttgctttaatgcctatgctaattggctgggtaactctgggtgtgaccccttacttctccaaacctctgtttccttaagtgggaataattcctacactacagggttgttgtaagggttgagcatctaatccataatgtgcactcagtaaatacaagttagccttctttcttcatttacagtctaagaatggttttcttagaattaatgtatagcttatgaagaagaaaacctattaagaaaaaaagccagtttagtgtatcttttcttttcttttttttttagacggagttttgctcttgttgcccaggttggagtgcaatggcgcgatctcaggtcactgctacctccgcctcttgggttcaagcgagtctcctgcctcagcttcccgagtagctgggattacaggcacccgccatcacacccagctaatttttttttttttgtatttttttgtatttttagtagagatggggtttctccatgttggccaggatgatctcgaactcctgacctcaggtgatccacccacctaggccttccaaagtgcgggaatacaggcgtgagccactgcgcccagccttcagtgtatgtttcaaagaggtatactcaggatacacgcaactgtttttcatagaactttgccctaggtttgatcacctaataacatgcttgaaagacacctggtgggtttatcagtagccaattctagcaagcccatgatctaggaatattatacgtgccaaaaacagtgctgagggatagaatacttgccagagacactgcagcccagaggtttgtgagtcataaagctacatcttacatctgaatttataagtccacatagactttaaatatttcattttggaggggaagggatcaaactaaacaacgtcattattacttgaattccgagatccaggggagtaataattttattgtcattttggataatggggctttggtttttaacattacaataataggtaatcataacagtgggaactaaatgttcccataggaatcgcctaggtagggaaagtgcagaagattccttaatgtggtatacggagtaagaatcaaaaattaatgacttgactttaaagtttggaaacatcagttagttgctacccttccccgtactctccctggaggattggtgaaggagcacttataaatctcacaaggagataaagccccatggagctgtctgtgggatttatggcatgctgggaaagcttctgggctgtggggaagcctctccattcatagcaggcttcattcacagagaatattaggtcacacagaagctcactaccccctgctgacctttacagacagagattggttgggctgcacaaaaacagaatggactcaagcaagccagggcacctgttaacctgtgaccttagtttatgaagaccttggacatttgaggctctgaatgagagaaaaaggagggagctatgaattttggaagttcactctggatactaatttgtatgtgacaatttgtgatcttatttggcaaatgcaacagtgactattttaattcaaactcctctccctccgtgcaactcttaaatccttgaacttctcaaaattgcattgatgtattccttttataaagtaggtaacgaagtcattgaaactaagtttttgccctaggtccgacagtaaattggctccaaatggaaatgcaacctgttaattcataacgccttagttcagcagtccccaaccttttggcaccagggactggttttgtggaagacagtttttccatgaacgggggttgaggggtgttcgtttcaggatgaaactgtttcacctcagatcatcaggcattagttagattcccataagaagtgtacaacctaggtccctcgcatgtgcagttcacaataggcttggcgctcctatgagaatctaatgtcgccgctgatctgacaggaggtggagctcaggcagtaatgctggctcacctgccactcacctgctgctgtgaggcccggttcctaacaggccatagactgctactggtccatggtgcaggggttggagacccttgctttagttattggcattctgagtttcaagcagaaaagtatcagatgaaagtgaaattattttatttgaaaaatgtggtcggcaaacttcttaaaatccacttaatatttaaatttgctttctgggaaactttggaatccttaaaggatgaccagaatgtcagaaatggagatttgtgttagagaagatagaatctgttatggattaatgttggaccaagactccaggagtactactctttttcaggagatgagaaacacagcttcctgtttccttcaggagggttcctggactctatctaggaaaccctactgagacaggatggcaaagggggatgggatttctgtgtgataaaacactagctattgtttgttattacagctccctttacatcttcctgaggatgaaggatattcatcatagaagcctgaccacgtggcttcattctaacaagtggcttcaagcaaggtcaactcttggggctcgtgtagttttttcagagcacattggtttgtcatacacatgcccttctgcctctcctgcctccacatttctactttcttcatagttcagaggtgtaattcccttcttctatcagataaagatcatggtgacaacacaaataccttaactggaacgtacacagaaagaaaatgtctcagccagtgtgaaggtgtctcttgacactgacacaatctgagagggacttctgggcaggggtatgctgataaactggccctccaaaataaaaaccctaatttgtagcattgctaattttcatggcgtaaatagtgtcaccatgtctgaactcacactaccaacatgatgccactgaatgcagaggtgaggagtgtgcacatttggctcgtgcaagaggttcaagctggctccagcataccgctgtctaagccttgatatgtttgtataattagagggaaggtacatatgtcagcacatatgtgaatctggtggtgaagatttcttctggtttctctgcccagaaatgccatcatagatcagacgatgtatgaatttgccacatgtgcaagtgcctcttctggtgctgcccatctttactcttggaaccagcttaattttggtactcatccagataccatccttagcctactactcttcctattttaattgatgtaatttctacatatttccatcttagacccttctcccaacttttagattctaactgcctgttggacttaccattggcatgtaattcagtacctaacccaccaaaatctgacttcctcccctcaattttctttcttataggtgacaccattacctttccagccatccacactagaaatcaggtgaagtttccagattctttattttccttcattttattctctacatccaattgatcagaagtcttgatgatcttctttttgattatttgatgggagggtaaatgtgtccctcccatctgccaccttctccattcctattattgtactagttaaagcccttgcagttgcttatctggaatatccacaactttcgtactggtttttccaactttaaaactgtcctcatcaaatctgtcctccacgttgatttccttgactatgcttaaaacctcatcattggtctcccatttcaacaggacacagagtctcagctccttagcatgcaacctaagtcctccataatcaggtagtctcctgctggctctccagccaaagcattccttccctctgtcatattgtttatgcagccacacattttccccctgtagtggtggaaaggtatgatgcctttcctcacccatcataagggtcatcggtaactctcctataacaaaagacaggttaacaagagaaaagcataacagatttctttaatcaaagttttatgtgacatgggagccttcagaaataatggcccaaagagccagaggaaactttccatttttatgcttagagtcaatgaagaatggacagccatgtggaaatgtgattggatgaaacgggtatgatctaatggtaatagactaagggggaacccagcaaggcctgtctgttcagattcttcctggccactctttgtagtattcttctttccccctgggtgtgggccaggacccctatggaatgagggtcttatgatctactatcagacaaggtaggtcagagaatttatggtcagcttctaaacaaaaaggtgagggaggttagagcaatatttccaggctttaagccttgctttaggataagagggggttctagtttctatgactcaccttgggaaggaggaatcctggtttctatgattcacttcaagggagaaagaagtgtaggagacaggagggcaggaaaaggtcagagaatttgcttctgaggctgcttctgaggccttccaattcctttagttcaaagtcctcagcatgtcaaagttccatactttgggatagcgttttcatgacttttttaatgcttgtttctctgcctgctgtgccctccccaacatagttaactctcattcattatgtgaaacccagtgcaggccaggtatggtggctcatgcctgtaatgctagcactttgagaggccaaggtgggagaatcgcttgagtccaggagtttgagaccagcttgggcaatatagcgaggccttgtctctaaaaaataaataaataaataaataaataataaataaataaataaataaattagctggggtggtgcgtgcctgtagtcccagctacttgggaggctgaggtgggaggaatgcttgagcatgggaggttgaggctgcattgaaccctgattgcaccactgtactgcggcctgggcaatagagatggactgcatctctaacaaacaaacaaaacaaaacaacccagtgcagacagaacctacttaagaagccttttctgacacctcctttacactgggcccctcttggtgcttccctccatgtcttgcctctctctccaccattttactcacattttattgtaatggtttctttgtgtctgtttccttcaccagactgaacaacttggttgccagaactgcatgctatttacctttatatgtctagtaccttgcacagtgcctggcacatagtaccatttagttaatatgtagctgaataagtagatgaataaatggaaaagacagccattgtgtatgtgctagtagcataaaaatacaggatacacaattacatttcaaattcagataaataacaaataggtttttttagtatgcatagatcccaaacatggaatgggacatacttataccacatagtatgtaattattcattatttctctgaaattaaaatttcactgggcatcctgtaatttatctgtcaaccctaacctagcaaaaaagtgacttcccacccaatattaggttagcacaaaggtgattgtgacaagttttggtttaagttttgttaagtttgccactatttttaatggcaaaagccataatcacctttgcaccaacctaataaaagttcacacaaggcagaacctcatgttgagcttgacatcatgggccctaaagtattttctagactttaccttaacatctctgagtgtcctgtgtgtaaatagtcactgtagtactcaggtgtattggccttgtcatgttctgctgggtgtcattacatacatgatttctgctgagagaatgatgcaaattttgttgcatggcaaagaaatttatgcagttgagtaatatggagagatgagcagagcttatttgtgagtcagcttgtgggttttcctatacaggtggagtatccttaatcttaaaaccgaaattcaaagtgctccaacatccatgcttattgcagtgttttgcagtttggattttcagaatggggatacttgaatggtaagtatagtgggaatatttcaaaatctgaaaaattctgaaatccaaaccactttcagtcccaagaatttgagataaaagatcctcagcctgtattgtggtggtttgttgttgctggatagtggttgtagggcatatgaaaaggaagcataaaacttacttttggtgtttggggatgaatgtagggattgggtgtgggttttagatttttggagggagttaacagctggaatagtactcactatttactttgctgctcaggccaagatgcctgagaactgatatactgaagagtgatcatggtgtggaggactccatactgtctccatcctaatgaggttgtttgcttaacacgttccctgttaaactatcagatgactgaattattattttgattgaagggactttttttttttttcaaattagaaacacccaactggttaacagtttatgttttagaaggtgaaagagtttatttttccatgactggaaacggaattgaaatatggcatctttcatctctcacatgccctttttcctctccgtctcatgccaaaatcgataattatggaaattacctggtaggacacttgggcacagttttagatatttaccccataggactcagacatgttctcttagaaaaagctggattctaaaggcacaaagatcaaccaaaaaaacaaacatgaaacatttttgtggtcacagtaccgtgatcttgtcagtaaagcgacggtctatgattaaatccagattgagctgtttcctgttagcgtgctaacccacaggacaggctcaggcctccgtgtcttgctttctaagtctgggttattaagcacttgtctgacaagggttccacccctttcgtcttcaacttaataattcaaagttactaagataatataagcaaaaacaggtcctaaagtctcttaaaacacttacagacctataggaatcttttcttgcaaaaatgaaacttttaacattttagcttctcttgtcgggccatatggcagagtattttttgtgtttcccctctgtacagtttcatttcaaaataatttcagtggtaagcagatcattttaagtttttgtttcataagaaatgtactctatttgaatgttggcaaattagaagtcatcagatctttcccctgccataataagcaggtattaggatatttagcagttctacagaaaatgacattaagcaaattctctgataacttaacatgcattgttattttgtgtgagaatgattgtaggcacaagagcaattctatacttattttatgatattgtcattgatgttcactttgaaaattattttttaaatctaaattttcaaaatattttattagtcttctgttaggtcatatgtggttcttcctaatgcacagatgcaaaccctgaggaacaaatactgttaaagggacttacaggaatcatgtatgcatattgaaattttttccgagtaagaaagtactgaaagagaggggctgggttaatgagaaacataattccattcccaagggagaaccctggctttctgccaaatctctgctttctggcaggaaatgggacccacttcatcaggtcctttgacaagcatttttctctgtgtttgaattttgggacacgtcaatactcggtgaaaaaatagttcttttaaataatcatcacttttgataagaaggatttagaattaaagtagagtttccattgtaagtaaaataagaatcgtcaaatttcaacattgtttggtaagggaacactgttattatcacaaggcgaggaagcttgatttaaatcagagtttgactatccctaaccactgagaagccattccttttattgttgttaatatttaacattgaagtatattttcatgtttttttttgtttgtttgcttttgagatggagtctcgctctgttgcccaggctggagtgcagtggcacaatctccagcccactgcaacctccgcttcctgggttcaagtgattctcctgcctcagcttcctgagtagctgagactacaggcacgcacattacacgtggctgattttgtatttttagtagagatggggttttactatgttggccaggctgttcttgaactcctgacctcaggtgatccaccccccttggcctcccgaagtgctgggattacaggcgtgagccaccgctcccatcctgaagtatattttctaactgctacttttgaatatcatgcaggctgacaattattttggccaggtcttttgaagtgacaaggtacaaaacacaaaacatcctgacatttttgtattaataaagagatcaaaggaatacacatttgaaaataaaaattaacattatattttataatgttttgatttttcttttttaaatgaaaagtggtaaatatgagttaagttttaaatgcattacagtaatttaataagccaaaatttttcaaagtatgtgcattctgaagttctgcaagatgctctcagactaaagagaaatccatctggaaatgctgcataccatacccctctcttggagttgaataacaccgttggcatatgagaaattctgcagtaaagagatatcattgactttgttgaactctatagttcccaaacttgaccataggagttttttttggaactagtgttttacggcacacacttcaagcaacagtgaaccaaataattaataacatgtagaattctaaaccatatatctttttcacttattgtttctgataaagttaattggaacttctggggaacagatgggtactacaaggtttgttctaaaactacatatagagtgataaagaacagctattagaccctgatctgagtcaacagtcttaagaggcctaaagaaatgtttgctattttgcctgaaccagatccctctccctagaaaactttcagaaattaaataaagagataaagccatctaccacataagctggagtcttaattttaattcctgttagcggtttgacatgatgacattaagctattctaacccccttctgaaagcagttgccaccactctggtctttctgaaagcaatccatctgttagtttccttccagtagtttgatttctgacaggccaggtgaaggaaaagcaaacatgctacttagtaagcacaatatcatcattagagatccacttctttcttctttgtgtctcttctttaattttcacatgtgactatttcaatttaggaaatctgacataaaacaattacaattcaacttgcgattcagataaaccgcctggcgattgttcgcatcacttaggattatttttgctttagaaatagacctcctctctttagagcagtttccttagtgcctatgaaggatgagttaaactttcaaaattgcatctctgtataatttgttaggcacagatttactgcagaatgtaaggcacaccaatatttttcttcattttaattctcttcccttatactcaaattttaagctgtgaagattttattaccaatgaatttttatgtattatggtttatatctaccaaggtacaattatatctaccaatattcatttacagtttcattttcatgtgctagctgcttctcgtgagtaaatgtcttcttttagactttgcaagtttccagaaggcagggtcatacacccacccacccttttcatcactccccagagcttaacccagtggtgcttggtacaaccattttctcagtcagctctgttgattgctgatgatattgaatcaaaatgcacattgccgtctgtggactgaagaaagtcagatcatgattccatctccatagatttccacggagaatatactccaaccatggccagtttttcaagctatcaacatgatttcaactggctcacacaaattcttaaaatttaacaatcctctctccaaaaccagtatgactcagctccagcactccaccataggagctgtctttaggaatgagtgtgcaaaaatttttttcccattctctaggttgcctgttcactcatagttcaaccattgtggaagacagtgtggcgattcctcaaggatctagaaccagaaacaccctttgtcccaacaatcccattactgggtatatacccaaaggattataaatcattctactataaagacacatgcacacgtgtgtttattgcagcactgttcacaatagcaaagacttggaaccaacccaaatgcccatcagtgatagactggataaagaaaatgaggcacatatacaccatggaatactgtgcagccataaaaaaggatgagttcatgtcctttggagggacatggatgaagctggaaaccatcattctcagcaaactaacagaagaacagaaaaccaaacaccgcatgttctcactcataagtgggagttgaacaatgaggacatatggacacagagaggggaacgtcacacatgggggcctgtcgggggtggggtgacagactaggggagggatagccttaggagaaatacctaatatagatgatgggttgatgggtgcaacaaaccaccatggcatgtgtatacctatgtaacaaacctgcatatgtatcccagcacttaaagtataatttttaaaaaaaaaaagaataaaaaactccaacaacaacaacaacaaaaaagaatgagtttgtccaggtgcagtggctcacgcctgtaatcacaacacttttggaggctgaggcgggcgtatcacctgaggtcaggagttcaagaccagcctggccaacatggtgaaaacctgtctctcctaaaaatgcaaaaattagtcgggtgtggtgatgggtgcctgtaatcccagctactcgggaggctgaggcaggagaattacttgaccccaggaggtggaggttgcagtgagccaagatcacatcactgcactccagcctgggcgacaaagcgagactccatctcaaaaaaaagaatgagtttgaaaactttccatggaacaaaacaaagggaatgcttgctaaacctgatcctggtatcattaaaaatgcgcttggtaaaattatatcagcaaactagttcttgataggggagtaagtagaagcaaatgtaaccattatgaagtaatacctctacttctagaaaggtaggaaacacgcatacctccaccaccaccaccctaccacactaaactcataggagagagcattgccttatatgacatgtagagaaattaaataagagtgagggtaagctgcatgcagtggctcacacctataatcccagcattttgggaggccaaggcgagagggttgcttgaacccaggagtttgagaccagtctggataacatagcgagacactatctctaccaaaaacaaaaatacaaaaatgagcagagcatggttgcctgagcctgtagtcccagctacttgggaggctgagtcaggaggatcactcgagcccaggagctccaagctgcagtgatctgtgatcacaccactgctctccagcctgggtaacaaaagggataaataaataaataagaatgagaggaaacataacaggctatggccttcaactatttcaatgcttccaattttactttagggagtcatttctccttatggtaattgttaatttattatacaggttgaaggggaccagctgcctccaggacacacagtcagtcaatatgaaacctgtaagatcaggaccataaaagctggcaccttggagaagcttgtggagaacctgctgacagcttttggggacaatgactttacctatatcagcatctttctttcaacgtacagaggctttgcctccactaaagaagtgctggaactactgctggacaggtaagaatgtaaaggagcttttgagttgaaagaaatgtaggctgattatggagtggagcacgaggttctgaatcacctgcacttggtattcggagagagatatgtgaggaaagattaacgggaagggatgacctttggcacaaatgaaaagaagatcattcaggagccacttatggtctgttgctggggaaaaatatctcctaaaagatttataaaagagttgagagtggataccttaaatctagattcagttgctttatggatttactatttgccaccctaaatttctccatatttttataattttatattattcagtaaataatcagttgaccaagaattttactgggatgttgtggggatgaaatgtgctaatatgtgtgaagtgtggagctcattcttagatccacaggaagcagcttaggaatggtggcaatgatgatgcgatgatgatgataactattaacagtcagcatgtattgactgttttaaggatctgcacataaatatccttgatccgtatttttaagctacttattacatagagcagtatacattgatatttacacactgttaaactttagattttcctctttatttctgttttatttagaattaaacttggtcttttagaaaatatcattaaatcaacttgatactgggaggaagaaagctgtcagccaaacaattgttttagaatcaggagaatcctcatctaaatccttatattctggggtttcctgcataaggaaggaaatgagatacggctttctgttgggcttgttgagtattgatgtttgttaactaaatttttttattttgaaagtaatctgtgctcatgctaaaaattcttacactgtggaagaatatgcaaaatattaaagtttgttcatattgctgccttttccccaaataacatttattagatttaaaaatattagtagtaagaagaaaattaaatagaccatcaactaggcaaataacacatattaacattttaaaaatagaggtaatccatgtatatggtgaaaagttccatcagcccagataattataaaaataaaaagtaaaatatttttttctccaagctccaatcccattcctcccaggaaatcactgtgaaccatccttttgtatttttcccacacttttgggtgtatagaaagtatgtatgtatatatacacacatttatgtactgtatgtcatatatatgatatgtttatatatttatcatatgacacatatacttacctatgatacagatagcatcacagtacatagtctgttctgcaattttcatttaaaaaattttttttttctatttttagagataggatcttgtcctgttgtccagactggactggagtgcagtcacacaatcatagctcactgcatcctcaaactccggggctcaagagatcagcctcagcctcctgagttgctaggatgacaggtgcatgccaccacgcctggccagttttcagtttttacttatctgcatatcttggaaattttttactcattaagtgaattagtatatataaaaggcttagaacagtggctggcatattgaaagctcaaaaaatgtaattcttatttcaaaaccagcacgtgtagatgaatctatcataatcttttcaatagctttataatatttattgaatgggttattatatggatagacatttaagttttctccagtttttagtttttttttttttttttttttttgttgagatggcatctcgctctgtctccaggctggagtgcagtggcgtgatctcggctcactgcaacctccgcctcttgggttcaagcaattctcctgcctcagcctcctgggtagctgggattacaggtgcatgccaccacacccagctaatttttgtattttttgtaaagacagggctttaccatgttggccaggatgatctcgatctcttgacctcatgatctgccgcctcagcctcccaaagtgctgggattagacttgagagccgctgcgcccagcaaatttgttttttaaactttgtaaacagtactgcaaggagcatttttgaatatatatcttcggaatagttggttgagaattctataggataatgtcatagaagagtcactaatgggtcaaagtatatcagcatttaaagatttgaaagataactgccagattgcaccagtgacattcctgtccacagaaaacgggaatgcctatttcctcattttccccacactcttgccaactgtggatattttctctctacttttgaaactgtctttgccatgacctgaccactgacaaatgatagcttcttgtttttgaatttgtgcttcttacatttatgagtgaggtttagcatcttttaaaattcttattggctgtttgtgttttcttttctgtgaactgccttttcatatccttttgcctatttttcttttggactcttttcatctaattattgattatctaattataactctgcatattaagggaattagtttgttgcttatcatatgttagaaatattttcctaatttttccattcgttttaaaagttatttattaaaattttttataacgacattaacattttttgtgtagtcatatctattagtcttaagaaatacctttaataatcaagttatattccaatataagtaaggttattgacaatagtgggttttctctcaaagtagtttactcgtaagatgcatatagagtaagattatttggatcaatggttattaatatgttaatcttcaagaatactcacaaaatgtctgttctttgtcatacattgatctggattatgatactttgagctgcagcacagataggaagttctgtagcttttttcatagcagtgcttgacaaaataggcctggaatataaacttggattggtgaggcatttctttatataggcaggatcttatgtaatagatcatacctgtaagtagaaattgaaaaattatatgaattttatctttttggtatttcatgtttataaaaaaatgcagtatgctgttggcaggcagtatgaattgactgttcaaaacgttaaaaaactcctacaagtttactttggaattggtaacctcttctatttatggggtgactattgataataggccacagatatccacagtcaataaaggagtgcacgtaaattccagctgttcatcctaaatagaggacatatacacacaggaactggagtgtttagtctatgactcatgtacatccagattttgatattttttaaatcttttctttgttctattatagaggatagatgtttttgctttttaaaacactaactggatgactgactaacactgaaaatgaatcaaactgcatttaattcaagctgtcatgtacgatataactggagagttaggatttatttttttaccatttggatgggccaaggcttggccttgaatttaatctcataaacagatcctttgcttgcttctgaaatgaatggaattgacaagtactcaatgcctacacaatacccagcttctgcaagacaccatgcagatggaactcaggaatatgagacttgtttcatgccttgagatagtttagaggtagatttactatgaagccactggtacttaacctccaggggcgctcacttggaatgccctctgcataattttatattcatgattttgtattctttttctttgagaggatccctcagattacatatggcttcaaattacatatccataagacctggatccacccctcagtacttaatattttactgcaaaagataacatattaaggcttgcatttctgaaacaagtagataactgcttgagatggtattagatgaagttctaacatgttctgcagatgaaacaggatatagaagttcagaggaataaatatcatttatttagattattctgcagaaattgggatttgttcaaataagtacaaacctcaacatgagtatttcttccttgcttcatttcctactcacacttagatcttgagccaggcttcagtcttgattaaatttaaccaaaatgcacattctgtgaaacagtgggttcttaaattggttgttgagacttttaatgtctataattaagaggaagcaattatgttgtataaacttgcctattctgaagatgagcatttgaaatattattttgtcagtagattgtggtagacttgtttatgggtctctgacataattttaaaaataatttcttttggtttcttaatagtagtttgcttatctgttgtgaaattaacactgagacgctattacagcatgtgctaatcatacaataatcagtcaagaatagattgaagacagatactgcagtatttatttcccaccggagaagcttatttgatgtcaagctttgatttcccttaagacttctaataatgtgggttttctcatatggaactatttgctttctgggatttattttttatcttttgacagttttttattctgctataatatgagccttttgtgattggccaatagacagtggtttgaattcacgtatagctaattccatgtgtttgctttaccccttacttggggtgatcatttcccaaggacccctgtttcctgtgcttctcaacatggctcagagtccacattggcctacttttaacccaagagaaagttcttgaattctgggccagcagtttgtgttggggctttgagattttcttttatctaacttcaaacatacactcactcagttaaaaatctggccaggcgtggtggctcacatctttaatcccagcactttgggaggctgaggcaggtggatcacctgaggtcaggagtttgagaccaacctggccaacatggtgaaaccctgtccctactaaaaatataaaaattagctggtatggtggcaggcgtctgtagtcctagctactcgggaggctgaggcgggagaatcgcttgaacctgggaggcagaagttgcagtgagctgaaattgcaccagcctgggcgacacagtaagacttggtctcaaaaaaaatcatctgttctctccaccataccattttaaacataagggtgttagatactactgaatatgcccaacctcaaatgtagggagaaacctactttaattagtgaccttcagtgagagccatgaaatgttggcacaagtatctagagttttcttcagatagctgtcacaatagctcccttttgggccatttcttgaacattctctctttctgtgttatgcactctaatatcagaattaagcagaatgagctgagtgcagtggctcatgcttgtaatcccagcactttgggaggccgaggtgggcggttcacttgaggccaggagtttgagaccagcctggccaacaaggcaaaaccccatctctactaaaaatacaaaagttagctgggcgtggtggtgcatgcctgtagccctagggagggtgaggcaggaggataacttgagcctgggaagcggaggttgcagtgagctgagattgtgccactgcaatccagcctgggtaacaaagcgagaccctgtctaaaagaaaaaaaaagtaagcagaatgccaacaagaaccagagtaggggttaactaggtctccagaaacctttgccaagctgatggcactcaggtcacactatggaaagcactgagtaatagtctgaattactcccttaatttcaaatgaattctcccagtggaggacattcggggtttttaaaggttggagccatttgtaaacactatgctttaagattatctgacttaaatttgcttgcttatggtgcagagaagagactaattcagtaggtctttgaacttatttcttcttcccatgtttgcttgccatgtgttttcacaggcttcatctcatttagttcacttatttttacccctatgtttacagattagaaaattgtggctcagaaacattcaatcagtaagtagcagagctagaattaaaacctactcctttctgacttggaagctctttccaagtgtacaatatcaccttccttgatttgttaatatcacctttaaaggaacccttttttgggaatcctttttagccatccttttcactactacctcaagtgattttccctggaaactgtatttcccaagggctcctcccttcacacagttgtgagcagttcacttgagcatcagtgctgttatttgtctactcaagcaatatttatcagctctttaatgtgtactatgtactgtacaagatgctgtgtgtataatggtggacaaacctgccttcttcatgctgaatgtctagtgggaaagagtaacattaaacaaatcagtgtgcaaatacatttatataattaaaattgatagaccactgggagataaaaggttctataacacagagttataaaggatattttggagagctgtacccaaataaaactgaatgttggccaggatcttaggtgatcacttagatcatggcccataaaggtaattgctttgtctgtgtgtttggagtgtttctgtgtactgaatgggcctggccaaatccctgacctcgatcagcttttcctgaagggtcagggatagcaaatgagagagcacgggtggatttaagtaagtatagtaccaccgtgggaacagaaaccttaaatccattctttatgtcgcctggagtaacattttcatatgcaaaacctgacataccaataaccagcaaaacggagctgcctttgttagtgcaaccagttcctccacagtgtagagaggagttgatcagatataaagcttgaaaattttcatttatttccaaggattttgtcatagatgtcaaacagacttttcagaattttaggatacattatgggaaaagcaatttttcctgtctttttttttacccatgagattcagatttaaggcatatagtataatggttaagaacatgggcttaggagtcagaaatttgaattttattccagttttgcactccttacttgctctgcagtattgggcagtgaatttatcttactagcttcagttttcctcatctataaaataacaaaaatagcacctaatttatagagttattataaagtttgaacatgataatataggtaaaatttgtagtatagtggctgaaaaatattaagtgcttaagagattactattaccttgttttctttcttcaaggcatttattattatttgaaattaccttatttatcttgcttatttcatgactgtctttcccactcagagaccatgttagtcttgttcattgctctaccctcaaaatggtgcctgcagtaggtgcttaggaactatttgtctaacaaataaataatggttatcattattcatgccttttccaagcaggtgttttggaaggtccagcagtgaacattgcccagcctctgcccatgtttagtgggagagacaaataagtctatagactcgtgtcatcactgtcaaggccatgaggctgaatgtgcgtttttaatgaaaaccttttccccccgggagctggtagttgtaaaccttctataaaaagcccattgcacacatccattcagttctcaaatgctttcgttgcatgagaagctggtaagtgtttttgagatgcgtacaatatgttccaatttgctttttgttaaacctcacttaaaaataattgaattttttatttagtgctggaattacactaggcacttgccaaatattcctagattcatgctggcatgcagtgttcatgttcctgtacttccttttctttcagtaagaggcaaggtttctaatatctttcctctcctcttccaggtccaaggaaaggaagttgtcaacagagagagcactgggaaacatactggaaactgaacccgcacgacgggtctcagagcatcttcatgtgacttatggtcccagtgtcgcctctagggtcaccagcatctagaggtgacactgagaccataactcacctgtaggtgctggtctcttatagcattaacactcacattaaatcttgttactatgaaactcataatttgatttttttctaaactttttgttctgagttatttattaatgtttaacttccatcacttacataggaaatttttcaaaataattccataccattctcttcattaattttagtaacctcctacagggccaaatcgaaattagcagagagggtcactcattaagtcttttgtgcctcccccaacccacccatgcatgaaacagttgagatttagtggttggtggctccaggatgcacatcccatttatttagtagaaaaactttcaggaaatcttaacattgctttgcttcctttctagcttaacatacaatcatattgaatatcctgactagggtgagaatttcttagtaaatgaaggctgctatttaagatttttgttagaacagatgagtttaaatagattttctctaggtctgggtgttgatgacttcctaggcaaaaaaacccaaaaaaacttggatgggttacacacacatacacatacacacacatatatataacagaacatatatatatatgttctgttatgtatatgaccctctctactagtttccatttggctctgtggggggttactaaaattaatgaagagaatatggaattattttgaaaaatttcctatataagtgatagaagttaaacattaataaataactcttagaacaaacaaaaagtttagaaaaatgtcaaattatgagtttatgttctattcaggacatcatgccctgttcagttttggtccacacactcagctccaggaagcatggctggagccagaatgtgaccagaattgttattattttctccctgtaaatatatatatatttttatatatatatatatgttaaggtgttttttaaaaaaaggtagattgctgaaagataaattggacttagatcttatttcctgcaactatgagaaacatgacactattggttggtagaagagaaaagaggattgtaagaagggtgtgaaaatctttgggtatgaaaatggttataatatagaaaagagcattaaaaactttgataggggatgcctttcataaaaggtctcaggctcttgctggctcacactttatcaggtggagagaaacagtttagctcagaaaacaatagaaggtataacatttataataatttacatatccaaagatgtccacatcctcatccctgaaacctgggaatatgttaggttatatgcaaaggggaattgaggttgcagatggaattaaggttactaatcagctgactataaaataaggagattatcttggattatctgagtgagcccagagtaatcacaagggtccttaaaaatgtaaaagatggaggcagaagacagagaaagagatacaaggatggaaatgggatcagatagatgctatgttgctggctttgaagatggaggaagggggccttgagccaaagaatgcaggcagcctcttgaagctagaaaaggggattgaacagattctcttctagaacctctagaaaggaacatagccctgacaacaccttgattttaacccattgagacccttgttggacttctgacttacagaactataaaatagtaaatttgtattgttataagccactaagtttgtaataatttattccagcaacacagataagaaacaaggaattcttgtcagggagattgactctgaaaaatctagtggccataggctcaaggatgttgaaggtcggtgtccaccctcacctttgttctgttcaggacatcatgccctgttcagtttcggtccacacactcagctccaggaagcatggccggagccagaatgtgatgggcattgttattattttctccctgtaactatgccagttactttggattaaccagaaaaatttaatctggtgctgtttgagaattatatccaaccataattacctgagggaaaatggaaataagttctcttccctgctgggttggtggcctttggtaaatatttacttttgccaagtggacccaactgtcacctgccaacactatgggaattctggataggaacatgtggcgactgtagagccttagcttgtgggacgacagtgatggttttgttaaagtagacactgaggggatgctgtcaaagactttgcctcagatcatagccaggctagctttcttttcttgaaatgggatttataagacctaagagataaaaatgtttccatgaagtagcttgttttttttatttcacttggcaaagggaggcaaggacatgcaattatcctttttttgaaaagaatataaaattgcccagcaggttttttttttaaagtgtgcttaacatttgtaaactacaaaacaaaactgacaagaaactgaaatgtaatgggtggtaactgagttagtaactggacagtcagacattcagctttgatcatttaaagcagtggttttgaccatttttcagcagttggtgggagtgattgatcacaaacccctgtaagaatgtactaaaaactatggaccttctctttagaaaaaagagaatgtcacaatttttttcataaaatttagggacttcccagacttctgtaaattcatctagagaccctgggttatgatcccctaggcaaagtgtccctagcgtggtaacaggggatatgtaggcagccattatgaatgagaggtgggcactgatcctagctttattataactggaacacagaccttaagtgtggctctgaaaagtaaaccaatcaaattaactaaaattacgcttcatggttcattcaggtaaatttaatggttttagaaagtatcttgggacatctaaaaggggaagatactggtggttttgagttaattttgtttttcatatcgctattctcttatctgaaaattttttttacatttattttttgtgaacttagcccttgataatgctgtcaggcccctagtcctgggaacacaattcttttgcctttggcctctactaaagctaacagtaagcacccatttagataaattgatattccgttgagtttttgtaagctataggcgaaaaagaaaagtattcttgaaaatgaaaggatgccatgatactaaactcatattcattgtatttgatgttacaaagcatgtttcataagattttgaagagctctgcaatagcagctttttgtggttggggaaaactgagccacaggcttgtactgatttgttaataatgtattaattcatcttaaacctgagaaaaatctagactcatgaacagagtctgagtgctgcctccttcctacccccatctaccagtttcttctgttgtccgtcattgtagcctcatccattgcagtgtactaacaagatgtgtttgcagttggtggtttagcattgttatgaactagaagtggaaggagtagctacggatgggccaccaagctctgagtgcaggaaacaggccagagaaaagaaacggatgacagaggcttggaatggaaaatagaagaaaccttatagcaggagtgtgagagccaacatacttaaataattttaaatctgcgtgagatataagttgtggcaggagagaactttttttctttcccttggatgaatagtgtccttttcttgaactcctctttagacagttgtgggttaagggctggaaagaaaggttattctccaggaaaatgttatagcattttgtaactgtcaagtggggcagaaatatcaggtactcttttgctgttaatgttgccttaagtgtcagggacttagtatggagatatgtggacaatgaaagaacaaggaaggtgcagtgtccttcacagcaaaggcctagaggtgaggagggcagcttttgttgggtcttctagctttttctagtcagggaaaaatggcctagagaactaaccctcataaatggaaagcacagtatagggttctcggctcaatcttcttggccccttcctttcctgcaagagaacaaggagtttttgccttgttgtttttgacctttgtctttccccttgaataagtaacttcacagtggtaacaagacctttccaaggtaggcttggtggctgtgacccagttctcaggtcagacttggcggagaggtgcctgccatggaggatattattcagagtaattaaaaccacacttcttgctgatctgtggaaacagtccaaagtcttcactaaggttttcaccagacatctgcaggctatttcacccatgtcgttctcctgagtcaaggtcagcttctgaacatttttttcatacctgacctgtgttcttttgggtcagttacagaaaaatgcctaagatgttctgaggccagcatttattagaaaagattcccaggagtccttgagtcagcagcttcatgtgaggtctctctttcctttacttcttcctttccgttctttcactatccccaataaagtacctccttcccaactcttcccgccccagcctttcttttattcttggtagaagagggtgtgtattaattcattgagcaaatatttattgtctactttgtgcaggctctattccaggctcagtagaagtagcagtaagcaaaatagaagagtaaaaccagagtccttgccacagcctacctaccaggccctcagcatctgtccttgtcatctccatgcctccttttctattcacgctcactcagctctgcccctcattggcctcttaatgtttcttagaaacatccttctgctactcttccaaggcctttgcattggctctttggactgcttagaggctctttccctggagatctgcagggcccacttcctcactttctggagagtttacttagttttcacattcacattgggccttccccaaatacccaacctctggccctccattataccaggtcaccctgacctgctttatttctctccattgcacttttcactctctgacttagtatatattaactaattattgttgtctgtctcctccgcactaccatgtatacttcatgaaaacagagactttggtttgtttgctgctgtatcctcaatgtctagaatagtacctgtacgtagtccttagtaaataatcctcattgaatgaggactaaatgagtgaaagaatgaatgatggaataaatgaatgaaaggctcaccatagcttgtatggtagggagtgattcagaggctggttgctgaacgctgactgtcatggctgaaatccctgctgcacgtattagttgtatctttgagggcatgttacttaatttaagccttctgggcctcatttttctcatctgtagaataggaataaaaataacttcactctatagaattataggagaactaaaccaagccagcatgtaaagcccttagcacagtacctggcatatagtaagttctcaataattattaactgctgttattattggatcatttgccagaatcaagcagagcctgagagattcttcaggatcacccgcctcctgatctggtgttactgagactttcctgttggggagcaaaggttagcaagggcccccactagagagaccgtccctgggtacaactttatctaagggtttctttgaaccacagatacacctggtcttccccttcaaacacatataaaacacttcaccttaccagataggctacaaagaatacagacatcctctctggaaataactgtttctgtttaaatatttagcaaccagttaaacattgtactggttttttctttcccttttctattactttttaggctgcagtaaataattgcttaaggctgcactttaggagacatttgtaaatttttcttttgccttgtgataacagagaaaaccatgtcaaaagtcattctgacaatttttattttaagttttatgagttaccatttaaagaagagcagttggtcattggtaagccttcttaagaggttggagctttgatcttaaatcctagggaggctttgcagaaattggacacgacatcgttgacaggtttgttggtagctattctatggccattaattaaacatacacactcatacacacactttatttactaccctggaataagtgaattgaacttgactttgagttttgatgggaagctatgagagggtccaggaaaacatcaaaggaaccttcttaatctagtagtactgactgtcaaaggacctagcctgaacatttaaagagttctggattccaacactagtctagtttcttttctgtaaagcagtaattctccttaatgataagaaaggtgcagggatggcctggcatgttggcttatgcctgtaatcccagcactttgaggggctaagacgggaggatcacttgagcccagaagttcgagaccggcctgggcaacagagtgagatctcgtctctacaaaaaataaaaaaaattagccaggcatggtggcatgcatctgtggtcccagctagtgcctgtggtcccagcctctcaggaggctgaggtgggaggcttgctcaaacctagaaggacaaggctacagtgagccatgactgtgccactgcattccagtctgggcaagagagtgagaccctgtttcaatgggaaaagaaaaaaaattaagaaaggtgcaggggcaaataatcatctccatcccagtccattaagttccacaaggttacaggctctttccttttatctcacttctaaaagacttctttggaatagcgtgtatacttttgttttgcattttaatagtttttacctttaagatctcaactttaacatcttaaaactttttttctttttaattgtagatttttggaataatcacagctatcttaaaacttttatgctcctaagcccttagaagtgagggcttgatacttgtagaagcataaataaggccagatgatgcctttgcagaggcaaatctgaacctagtagttgggaggtccattactgcgtctgcttctgaaaccccaatagagcactagcaacaggtagctattgcatgcctgttgggtgccaggcactaaagagttgggtgccagctctaaagagtagtgagcaaaaagaaaacatcctggtatgctggagtttattttctaatggacaattaacacaacaacaaaatgaactacacagtatatcagaaggtattaaaagccatagagaaaaataaaggagggaaggggctgatgttacagttggtttgtattttaaatagggcagtctgggaaggcctcactgataaagtgatacctgagcaaagacctgaggagctgagagagtgagcccttggcacaggtgtgggaggaggcagcagcaggcacagattcagaggcaggaggatgcccagtgtgtgggtggagcagggaggaggctggtgaggctggaaagggagtaagggctgaggaattgtaggaggcgtgggaggaggtctctgcagatcattcagggccttgtgagacacgtaagactttcgccttttctcagagtgagatgggagtcatgggagggtttctccctttttcttttttcttcttcttcttcttcctttttttgttttttgttttttgtttttgagagacagcgtcttgctatgtgttgcccaggctaggcttgaactcctgggctcaggagatcctcttgctgcagcctcttgagtagctgggattgcagacatgtgccaccatgcttggctttttatgggagggttttgagtggagcagtgacatgatctgatctacctaaagcagaattgctctggctactgggcagaagctggggaccatttaggtggctgttgtattgatttaggttacacttgatttacactatccaagatagtgtagttggagccagggtggaagcaatggaagtgatgagaagtgtttggattcaggatatattagaagggcagagcaaaaaggatttcctgatgggttgggtggagaagagttagtatgtctgcaagatttgagcctcagcaactggatcgtgtgctctgccacacactcctttttatccatggcccttattggtgtccaagttattatcaagcagtcactctgatcccaattgagaaactgtagacactctggtagccaggagaaatacttctgtggtcttctgagccattgctcagaagatgctaccaggttagttaatgagagagaacttggctcaccagtataagttacttagtctttcttgacaccttctcattacacatttggcatcacattctggggaggaactgtgatagatgttggtgccatccaaacctgcacctcagctctgagtctgaagaatgcaggaaaagagcagaagagtaggaggagctaaagcaaagataaagaatagagagatctggaaacttgtagtacaaaccactttgaaaaaaagactatcaggagcagtaaaatgtgtatctttccctggtgttttccctttttatatctacctttcatagcttccagttgaaagataaaaagatgtgatatttccacaataactggagtgggaattaatggactaacatggaatgtaacaaaaacaaagattaagtcccacatttagtaattgagagatggcaagagaagagtttatggatccttctagtcagatacatagaagatacactggctttccaagatcccactcttgcttgcacccaccgtaatctctcctacttaaataaaccaccaagcctgctgtgagagagtacgaggacatagtttgctacgatgttggccaagtatagagctgaaaaatctcaccctgtttatttattaggaatcttgttttccatccttgccttgctcatgtggggctgagtaaatcttaatctgagttcttatctcaggaagagcaaagggtagccctggaagccttctaaatagcaggtgcaggacagaatgaagaggaaaagagagggtggagaccagtggaaaatatctttgagaggccaagaaatccataaggctgatgagctagagaaaggagcaggtggatgggtgagctggtgcctaagggcgcaaactggaacctaccgggatgggatgatagggacaccagatggactggcgttgggtcaaaccagatggtgggcttttatttttaaaaggatttgtaagtcctaggaacaaggaaccataagggtactgggcctttaatcccattagtagaaaacaaaagtgtgctctttaaaaatgtaaactcatcaattatagaatttatcaaaactttgggacagactactcacttgtgaaaccccaaggaatctctggattctgtattgatggaaggagaaactgaagaaatagtctaggcattataagttaattaaagactcctccttaataatttaaagtgcgtttactaagtttacattccaaaccaaacaaaatatgatatatttgtatgaaataggctggctcacatgtggagttgggagaacagctagcagtgtaagtagggactgatgaattattgagtaaattttgagttggtaatgagaaaatttttaaaatttaagcatctattgctttcccaaaaatcagacccctgcaccccacctccccagttgctgtgtctagcgcaacctggcctcagtatagctacagctgctctcatggttgctaagacatgagagcttctactgtagtccttgtctctatcccagccttaattttagggtccagagctatttccataatccctctacaacggacttattttcaaggagaccagactcttaagtgtagcctggagccatcagtttgtgctcccatgtggcatgagtgtggatgctgtgcctgcagagccatgtgtcccttgcatagacatgcagaggggttggacgggagggtttggtgtgctacagagttcatgaggaatctgccttcttcgtattatgtaatagccgattctcctgctgataggaacactctaatctaaaaaagtcaataaatgttaagtgttaatattaagagaaagttttaagtagtgtgattagttgttaaatgacttttctgtttagaatatgcagatatatccattaagtaactatcaataatactgcatcattttcaatgctatttcatagatatatctttccttaattacttctgaaaagtataactgtcactttgtagttgaagttgaatagagttgctttccaacaccactgactgtttttgcttgcttgttcattattatctctacaggtatggaaacctgacaagcccaaactgtgaagaagatggaagccaaagttcatcagagtccaaaatggtgatcaggaagtgagtctcccttttctttgcattctaagctctcagtcaagacaatatcttaaagtagtttagtagagtattttattcctttgaatgttgccatgatttttttttccatagtgcatacagaggcttattttttgattacctaacaatattcatttatgtatccagtgaaagtatcttaagtaaccactgtctgccaggcattgtgctaaggtatacaaaacaaacaagtgaagaaaacaaacgaacaaaataaacagtcccagctcataaaaagtgtgtattttaccagaaagagacaaagaatacacacaaaaaagtgaagaagaatgaagcagggtctgagggctggagcgtttggctatgtgtagggtgcccggattgggctgtctggtctgttggcattggagcacgccgaaatgaggtgtgccctgagccttgcaaatagccaggccgacagaccacgggaaagcctctgaggcaggagcggtgtttgagaatcagcagggaattgcatgtggccggagcgcgtgctaggggatgagcactgtgaggtgagcaggaaggtggccactcacaaggggactcatagcaacttggggaaagatgttgaatttgattctgaggaagataagaagcgcttagaaggttttgagaagagtgctgtggcctgacacatcttaaaagacccgctctggctctgtgtccggaaagtagcctgtggcagtgtggctggggacaagggtgggagcagggagcctggtcaggaccctcccaagagtccagatgagggctgcttgtggtgcgggctgaagcaatagcagtgaaggtgaccagcctttgcagagatcttccaggtgttggtggcaggacaagctggagtgcatgggctgtgtgagagaacaagaggaggccagatgcttcccagggttgcggtttgagcagcggagagacagaaccttggctttataaaataaggaagatcgagggagcaggtttaatggggagtgtgtatcagaaattcagtcacagacataattagctcagtctagatttcagggagaggcatggaatggaggtataaatttggatgtctttagtttatacatggtatttaaagctatgagactgaatgtggcttcctgggaactaagggcagatagaggagagaagatccagagactgagcctggttccttgggtgtttagagttagggaagtagagcgtctggcagaggagactggaacagagcagctttggggaaggatgggggaggagaaaaaagaagttgttgtgtccccagaagacaagcaaagaaaggatttcagggagggagtgaccaactccctccagtgctgccctagatcgagtgtgagggtctgaaaagtgactcctcctttgcagtgctgcggtctttggtgacttgacaagtgcagtttggtggatggaaaggtgggcaagagagaatgaaggggatgaagtggggacagtgagtcttgttagaggaggagctttgctgcaaaggggaatagagaaatggatggaagatgggttttttttttggttgtatatgtgttttttaaaagatggaagatattttatgctgatgagaatgtcctatgagaaaacatccatgatgcgggggtgggggccattgtaggggtgatgttcctgagtagatggaatgtgcacctgggtgcctgaaaccactagtgttaaatattcattttggggccaaaagtctggggggaatcctgtggaatttttaactcctcagaagagttactgatagactcctttcttcaggagctagggatgtgaaagtagaaagctgagtatcttttttaactcctgagttaggttccatgtagttttacagttttgttcagtggatcataactttccagaaaaccagacataccagtgtaggtatttgaatgtcaagcacaaggtacagtgggaggaacaattcttttgtttttagaagggcttggggaaggcctcttggaggaggttacctttgatctgggccctgaagcatggtgaagattttgttggtagagccgtctgggtataggaaacagtgggaccaaattgggcaaatgcaattttcatggaattttggggaacaacacagaattggtgtggctgcttcatagagtacatgttaggtgagaggggagtcagtggagctgaagctagattggacttacttcatgaagggcattaatttcttgcaggagagtttggactttccctggtaagcagtgggcagtcagcagtaatgaatttttataggagggaaacaatataatctaaaaggtgatttttcagaatgggttagacatagagccttctcgctcaaagtgtgaccgtggacctatagcatcagcatctcctgggtgggagcttgtgagaaatgcagactctcaggccccactcagacctaatggattagaatctgcattttaacaagattctcaagtgattcctaagcactttagagttttgagaatcataggagtctatgaaaactcactaagataatgatttttttagaagaacctttttataatggacattttggagcatatacaaaaggagagatactgtaagaattgagtgtaatctagacttgtgagcagattcagaaatagacatgttattatacacatattttggaactcagtccaatctagagctgccattcaattagccacctgaacactctgaggagagtcacaatcaaaaatatccagagctggccgggcgtggtggctcatgcctgtaatcccaacactttgggaagcccaggagggaagatcacttaaggcaggagctcaaaaccagcctgggcaacgtagtgggactctgtctctacaaaaatttttttaaaaaattgctggatgtggtggcacatgcctgtagtcccagttacttgggaggctgaggcaggaggattgcttgagcctgggaggttgaggctgctgtgagccatgatcgtgccactgcactccagcctgggcaacagagtgagtgagaccttgtcttaaaagtaaataataataataaaaaaatccagagcttctctgtcccatgaggtgttttgagataaaatagattttttgggaagtagcagttaagaaaattgcaccctgggtatgaagagtcatgttcattcttttaaagtctcattcgaattcgttgtatactaggaacactaatgtgaatgaaactccaagctaagctgttttaaagagttttagagttttaagcatatgagggcttaacaaagagcttcacacagaactcccctgaggggtccatcctctggggacaatggtcctttcctaaagtctcacaataacttggtggaaagttcttgacccttttgctcagactgagttgccttttaaaaaattatgcctgatgaaaatatgccactttatcttataatgggtcgctctgtcctacagattctggaatgttaaaatcccttcttactggtgacctctttcttccttccatttccctttcttctgtctttctcactgttttttccccacatcttttattgtttttcatctcacttcactattattttttggctctctttttctgaaactatgcttctcctgatcatttctgtgcctagatagggtcactgctttgtctttgtctttgtgagaggaaatcagggaagcatcttctcccatctgtatgtaatgtattgcaaatttcctggtcatcccagacctctggcatctgacttgcagcaatgattgagggcttcctgatgatcaatagatgtgtaggaggtatggcagtggttctcaacagggcgattgttatcctccagaggacatttgccaatgccctacagacattttggttgtctcaacttggtggggggaggctattggcaactcatgggtagaggccagggatgctgctaaacgtcctagcatgtgaaagtttcttgtattggttcgaaccctaaaagcatgccaacagacaacacaaagcggtgtggagcaacacactgttttaatgagtgcctgggtgcaggcgggctgagacctaaaatgacatcagccccaagtgaggacgggacaggggctttgtagtcctctgtaaacaggaagtgtcccagtctgacgtgactgctacgtagtacctggacggcctctttctcggtcttcaggggtatgtgtcttccggccagggtaggtgtcttccggccagggtagttgtcttccggccagggtaggtgtcttccggccagggtagttgtcttccggccagggtaggtgtcttccggccagggtagttgtcttccggccagggtaggtgtcttccggccagggtagttgtcttccggccagggtaggtgtcttccggccagggtaggtgtcttccggccagggtaggtgtcttctggcccgctgtcttcctgcttctgctatcttgctgacgcgtgctgctggcgcaagtggccttgagctttgggactgggcctgagaagggaggagttactcatcccttcaagctttcgggcccgggggagaatctttcagcatgcacaaagtaactctcctctaccccaacaaggaatgatctgaccttaaatgtcaatagtgcctaagaagccctgctatgtagtattgaggctctagttctcaagtgaaactgtctttatgaatacctaacatacataaaaataggagcaggcctatttggaaatttctctatttgtgtctctttttataagtagctgaatcaaatgtggaagtgattcagaggcagccacatggagagggaaaggccctggtgaaggagcctggagaactcggatcctgctccttctctatcactctgtcacttaccagtcatctgaccttggcttagtcccttcacctccctttgtttcagtttcttcacctgaaaaatgagtgcttggagtaaatgctcgctgaggtccttttaagttcagtgatgtctaagataaaatttatttagctttttctttctctcaaaaaatgaataacagaaacagagatatggtccacacagcatagtggacttttgagagtacggtaccttcgaccacttttctctgttggaaagtgtgttaccagttttgaagagacaggaagaaacacatacacaagctttgtttgttattagtcatgacatcacagctgctcactggggtcatgaataaagagctgagctaaagcattgtcttgtgggagtaaggcaaggagtggcaaaatgcccattgttttcttttgctatgaatctgttctcttgtgatttcaggtggaaaaccgacagcaggaatccaatgacattcaggaagtaaacatcctgtttagggcagttgccttcagttttgcagacctgggtggaggaggggatggggacagggactcactattggatttaaccatgaacagaaaaatgcccaaatattgtttgttttcccgttttagctgtaaagcaaagagcaacccttacattttatacaggctcccaagtaccaagtaaaatctttcctgtatttccaaatatggatttaaacctttcagagggtaaaagaactttaaagaaggaaaatgtggaaatacagatgaagcattcaagatgaaaaattggtttctgatgtcttggaccacaaccgactagtgttcttcatgcatttaaaaaagtatcagattgtgcagggactcccacatgcggagtacttgtaattccagtccagagttcaggctttgcacaatgtcaggaccctctaaagttatctggctaagacaagaatgtgttcagttgcaaaggattcaacttccaaggcttctggatgttggaatctttgcctcacggtgatttctgatggtagggctagactgattatataaggtgtgccacatttatttctaggattcctaaattggccactatttatcaattaggaaactcactttctatgacagaagaaaacatttctgcctatattcattctacccgtgcccttttcctgctgacatttttacacgataaaatgctatctttttaaataataaaatctgaaccagatggaaaaagtgaattgtctctagggcagatttattatagtcattgaattcagaaatgaagagaatgtaaagaagggatattaaccatatagagcttttacaacacgaatcttcattctctgaattttatatgagatggccatatctccctctctctatatataactttatttaaagagatttaaaactcctcaagaaatgatgctttatttctttcctttaatgactattataaggttgaaattgtttctgttttcttttctttaattgaatctcatcagtttccttctggagtgccaagttttgttttctcaaactctctaccatagtactacttcaaattgttgaaatcgttctgctttcatttccacatattcagaagatacgtatattgttcttgtaatcttttcccagaagttgtaaacagtgacaccagatttcagtcactggtaaaggatcatgtaaatagtagtaatccaagacatcggatacactttaaagagaaaggaaaggagttaaaggaagttggctgtgttacattactgcctcagaaacttcacagtggaaagttaaaaaatcttcccagagagtttgcaatcaatattcattcctgcaaattcagatgccctaagaaggcaattgaaattaattggagtgattataacaaaaatggggaaaaggaggaggggtgaagaacagcaaaaacaagatttaaaactccaatttagaagaattaaaagttataatgtgaaaggaattttttttaaagtgaaacaaaagaaatgaagaagtgatatgccatatcgaagagtctggtattgtctttaaaatatccctacaggacaaagaagaataaaaaccatagttttacaagtcattagcattctaagtcaagtctgcattttagggacatgggtagaaagccctgagcagaaactgatgttctaatagttgaggaagaataaaacaacattgataatcaatggctcaaaaagaagacagatcaatcatacgagtatctcctagggttttctacattaaagaatgtctcttttagaaaggaaaacagacatcacaattagactgtattgtttgattccctgcacagcattgtaaacaaagaaaatgatgacactgcccttgccaccaccattggctacaatttgtggtatgcttacaaggcattctgctaagtactttatatttgtgtcttcttcaaccatcacaaatatgctgagatattgtcctcactttataggatataaagtgaagcttcagagaagttatgtgttttgactaagatcaggcaggtggttaagtgacaggtctgatatttgaactcccgtccaactgactccaagacctgggtgggaagcccaggcatgccatttatagaagagcattgggatctcggatactcaagatttttctccgcatttgcctatatcaccataataagactgcggaagtacatgaagaactagattacaatatcattgttgtgactaatgttttagattgttattattctgagatcttttgtcattatttccattgctctatgctgttttgcctggctgttgctttattattgaatgaacaccctgagcaaggttcgcacacagctgttagaaatgtggaagctagacctttttcctggggaaggagatgggttgaagaatgtgaggaaacaagaccaaattaggcccatcaaaggagaacctgcttcctgttccttgtgcctcgtagcatctgtcactaccaacggaaactcagttctagtggtgaaaactatagaaggccttagccatttttttcaatagagttctatttataacatgaaaactcccttcttggactgtggggaatgagttattgaggtccttgaaagataattttggtgactggcgatgtccttttctaataatagctagaatttattgactacttagtaggaatggtccctgtgttaagtactgtacatacttgttaaatcctcataatgattatgttttattattcttattttacagaggaggaacctggggcgtaggttaaggaacatgtccaaggctacacagtgaataaatgaaagagctgggatttaaccgaggccttaacctctgtgctgcatgacctttactatttttcctctgataaaaatgaaaatatttctcttaagtacttagcttgggaatgaaagacaggtgtgtaaataaccttgactttgggtaattggcttcaggcttatccatcctactccgggccctctcccactcacatttactgtctttctgtatgtcttcctttcataatctttttcttcctccttcttgccgtggaggtttttttttttctcttctctcccttccccatagtccctgcgttgcccttgccttcttagtgcttaaatctgactctggctttgttggcattatttccctggtcttttctcaatctctctttcacgtctcctcctagtatttgaatccctgtttaccaacagcactgaaatgtgacaatgtaaagtgtaaaaaagcaacgcaggacaaccttgacaagtccagataataatattttcatcctttccaggaaaaaaacaaagaggaaagctttgtatctttctttgttccttctcatcaggaaaatcatctagctggaggtctcagaggcagcttctatctggcaaccttccctgaaacagagcaaaactgttctatgattaggagaacaaggtggagggtccggcccagagtcagggtcaaggttgacttaggcttcagttcttgaaggacaaagtgtattagatcctgccctcagagcttggcagaagttacttcattgcttgaaaggcccaccgtctgcgtaaatcttcttaccttttcattatctgcagcgaagacaagatccagttctcagagaatgtattaaaatagaaaaacattttgctgcttttgaaaaatggttccatgtcttattttctgctgatgattaagtacaaaaaattattatttcaaatagattgctggggagagaaaagaactctagatggatagtgttattctttttgtcacggtaatcctatttcttggctcagaagttacacatcatgggagaggtgacttcatacctgaaaaaatttgtattaaacatttgaccaattatagagtattttactgcctatggaatgttaatatgatttaatacgtttacctaaaatctgcattcattaaaaagtctgtgatttgcgcataatcgctgcctaaatgcttgcctcagccctctctgcattgcgtgcctgaagatcgtggggtggctagaagttctgaaccattttcttttatctctcagccaaggtgcatctgtctaatgtcttctaagcaggtgttattaggtgtgatttctggttggctgagaaatcaatgagtggccagctgcggtggctcatgcctgtaatcctagcactttgggaggccaaggcaggtggatcacctgaggtcaggagtttgaaaccagcctggccaacatggtgaaacctggtctctactaaaaagaaaaaaaaaattagccaggcatggtggcacgtgcctgtaatcccagctactcgggaggctgaggcaggagaatcgcttgaacctgggaggcgaagattgcagtgagccgagattgcgccactgcactccagcctgggcgacagctctgtctcaaaaaaaaaaaaaaaaaaaaatcaatgagtatagcagatttcatcatgctcctttcccccaactctttatattttttagtttaacagatctttaagtcctctacaagtgtttagctctttcaccgcagaacctctgcctcattgctgccccagaatcctcatcccactgactcctaaccctcaagatctcagctttcacatcatttcctcagggagatcctccctaaagccttgaccaggtcagctccctctgaagttcagtgcttccctgggaccctggacttcctgtattgtgatgctcatcgcataaattgtttttgtgactctgggaaataaagggcactcaacaaatattagtttaattggtgaatgaatttcttagaagcaaaagtcctagaagctgctttagtatgtttcaaacagtgacatctgagcatgtcttccttcccctatagacgattgcagtcggttggaaaagaatcacacactacaaagttttgtatgttgccaagaatgcctgaggtagaaaactcaattttggttgtctcctctgctatcagttttgggcccctggccttggccacctacccggcatacttgcccttaggaccgaggagttttgttctgtgagccaccaaagattactttggaaaaggaagtcacatactggcttttctccagactgaatttaggttatgtcacaattgtaatcatccagtttggcttcaggaattacttctgcctttacaagttattcaagaatcatctcttgcagttaatactacagtttgatgtctttgatttgtcctagagaggatacctcaaggtatatgtatgtgggcacatatgtgtgtgtgtgtcttgtgtgtgtgttcacagcagccatcttcttccagcaggcctgaagtcacacatgtcatagcatggcttgtattctgtgtcattcttcctgtgagaggtggcagattctttgagtcaattcctgtgagtgctgatggattttcgctgagccattttaccttttcaatcccttccttctatgacttctggcaagtagttgtaagactgttgataattatgtttctctccaggtatctcaaaatgtccttattgacattatatcatttgaaatcacaactgatcagtgtcaggtagatgaagaaggtgttattatatctcttccccagagaggggggtcagtggagttaactgacctatccaggcttccttagttccccggtgggacagccaggatgaaagatagagttttctttctccaggtctccaagcgtcctgtcttggtctgtgtacagaaccaagtggcttctgtagtctaacagacataccagacctgtaaatttgtgacttcaaaccagaatttcccttcagctgtaagattctttacatccccccactctgttctggttaatatataagttagatcttaggactggagccaggctgggtaagaccgaaaagccattggccagtaatcctgtttttcttttcatcattattttgcgatgttgctttcttttttgaaatcttaaaagtttcgcatttgtatctgcttctaaatctatcaagaacggaaagtttcttcccaggactggcacacacaaagctactgtgagccttgggcatgtgtccaggcctttccagaaagcttccctgcctggtgtgctgagaaacgctctgccgatgaggagggcagggctctgcctcgtgttctattgtgctgtttgtgtatgtctttccctttctctgtttcttcgtcctcctcccccttcattcctcttttgtgtgaaaatgcttttttctggctgattgagtatctgagtttgtggtgaactttcaaagccttcttaggctaagctacaggaaggtcactgtcacaaagagtaaaaaaatgtatagatcgccagagttcattaaaaacatcagattgaggaacacaaaatgtccacctaagggcaagtctaatgtggacgaaggctcctctttagaactctcctagttcttctgaggctgcagctctccatagaggtaagtgctgtgtgcccatcagaaatacccacacgagcatgcagagatggaggcaaggatgcacatattttgtagttgtgacaacctgaaaataacttaaatacctgccttccagtagaagaatacttaattatggtgtgtccacatcatgagaaacaataagatagatctagaggtaatgatgaagtatctgtaatatactgctcagtaaaaaagcccatgttgattttctttctatctatctatctatctatctatctatctatctatctatctatctgtctatctttttttttggagatagggtctcgctctgttacccaggctggagtgcagtggtgtgatcacagctcactgcagcctctatctcttgggtacaatcaatccacccacctcagcctcctgagcagctgggactacaggcgtgtaccaccacacctggctaattttctgtattttttgtagagatggggtttcgccacgttgccctagctggtctcgaactcctgggctcaagcaataatcctgtctcagcctcccaaagtgctgggattacaggcgtgagccaccacacctggcacatattatgtatatttaaatatgtatacatatccacagaaaagcctagaaggatatattctaacagttaacaaaaggtcctgggaatgggattaggatgaagggagagagtaggtattttgcttttttagtttatgtacatttgtaagacttacttttttgcaataaataatgagttttatcataataattaaggatcacaggcatttaagaagtgaataatatattagcatcactgactcttacctgtaattttgtgtttccgtctgggtgttcttttcagtgaaacactgtcttgttgttaggctgctactgtttttgacttgagtatatgatatgaattatcacctctccatatctgtttttccatcagtgtcatcataagagtatcttttcactgaaatattaagaaacattaagcaagtatagtggtgttaattagattaattcatccctctttttaaaggtgcaaaactctttttctgtaaaagtcaagctgatgtaaatgcaaatatcaggttttcaattaatttctggctttctggaagaaagtgaaattattgtttatcatttcatttaatctggactaaatatttggagtattgaattatttctatgactttcatttgatggtttcatgtatctactttagatgcagataattgaatattatagttccaaatgctttaacgttccacattagtgaaacaatgatctacaccataatgaaaacagtaacacatttattttctttctgtttgtacttcaattccaaaagttaagcattaaattggctttagtcatacttatgctttgatgatagtccagcttcttggtgtgaaatcaagatgtgaagaaagttagacacacctgtgaaagcccagccttcactttcacatatgtgggtaataacttagtccagttatagtttgttaactaaaaaaacaatttctttgaagtataattaggtgataatgataattttaaaatgtgctaaaaaattctttttggctgaaaaattttggtaaagtgtttagttaagatgaggtgttgtgtctctgtcaataaaagatgcatggattaatgtatagtccctgtcatcttctccagccttcagcagtgactattccgggaccgtatggggtaactggttgctaggcaggcagagtgttctgttctgttctccttgtctgtggcatgtgattgagtcaggagtgttggtaaagtcttctttgaagatgaagcatagaataatagcatgcaaaacattttatcctttttatccttcagctatttgtctctagccttcagtgagtgggtgccccaacctaaagacaacatgctgtgttattactaacatactggagggagctgtgcacatacaaatgaccctgtctctttttgtgccctggaaccttgtcttcccctaggtggactctgtgacccacagagccatcagaagaaatcacctttgcttatcaagtttttgttctttatcttttaaagacataacttctctacctactgtttctgctacttgaaacatattcctctcattgtaatttgagaaacaaaaggataattttatgaggacattttcagtgttcatgctgaagccctggtgatccttgtcaacttgaatttatgcatttatctttccacactcaggcacttcctttcatcagatggatttctggcctaccggcagtcagttatttcctaacatattaggtggcagattttgtgggatttaatttgagcataatcttattgtgtacagattgctttgaagtttcttcaggactcactaaaccttctacacatcaatttttctgccctgtatgggtttttccaaagtttagcctccttaaaacaaacaaacaacaacaacaaaaaaccttatcagtttcactgcagcactccacttaaaacaataaagtttagtttgttttcaagtgctttaaatccattgatgtttctaggaacttttggatgaatgatctgttgaccacccacccaagtttccaggggtgcccctggggtccaccctggtgtccagggattgctttgcctccccacagccagttgggtgcagtgactctccatttgtctttctcagtgcaatcgcttccatactaagggcctggcttgaccagtgtgcagaagacttccgagagccccctcacttcccttgcttacagaaactgctggattatctcacacggatgatgccgggctctgacccagaaagaagagcacaaaatcttcttgagcagtttcagaagcaagaagtggaaactgacagtgagtacttgtttgttcccagggaaaaggctagattctgattctccagcctccacgctggagaaaggttctccctgtgctggctaataggaaaccttggtaccctcaaaacaacatgctgctggaggattggcttgagtataaaattctcaagattactgaagtactaattagagagcctagaattttagacagagaagggtattttcaagactacctaatctggctccctcattttatggatgaggaaactgtggaaactccagctcagaaaaattaagtaatttcctggggtttcttctgttaccaagaagagggtctccttgatgaactttaatcttcccttatcaacatgtaccatgctgaacctgaatttgcattttattacctgtttaatggctccttctagccttccatcacaaccactcccgtctagcagtcaaggaatgaagtctagttctgatcctgccctcccaaaagcttggaaaaggtgtttgtccttcagtatggaaaagcatcactgtaacgggtcccctgccagtgcagattgtcatcatttagcatctataagggcctcatcaaaggaagtttctgcagctgtttttccctatttgaagattaacttcctatttgcaaggacaaaggaaaggccaccactgcaggttatgaggtgcttggaactattaggctttgaagaaagtcagaaagaggctgggacaggcttccagtgtgatgttgtatcctctcactggggtgctgggtgacagtttccatggtggctgacccacttggagcttctgacaggcattaccctgaagggatgcctgacttcatcagtaagggaaaggaaatgttcctcagcaccaataaggaaagctgcatcagctccaaagaaaatagacctaaattccaaacaatacctgctgaatttcttatggatgggggtcccagagagagggaaatgcaattgcatcattggaagctgactgccaaatactctatatctcagatgacttcatctgccaggaatgtttgaataccaggggcactcctccagctgcggacctcagctcccttcagggcctccatgcctggctttgtgctggagtgggaaacgctgtgttggagcccagctctccccactggggctgcccctggctctgagcctaattggggaaccggtgggaccagtcattcattgtttccaacacagggactgcaaggcagagctcatttggcaggctgaggcaggggagagggagattgcctcagttcccatgtgcttgttttacccaattttactcctgcggaagaagcaagctctcctatatgtttttaaaaagtaaaatcgtgcttcatgttgttacttatctctggaggagaatcaaaagcagaaaacagtgaaggcatggactatgccccagagagaaaggatcatgtaatcttcatgcacagcaacattatagacacacattgggctgctgtgtttgctgaatgaatgaatggaaagatcaagccttagcacataccctgctccttgactgaagtgggttaggctctgcattgcagggcaaatgggatatatgtatgtatttgttgacaagacgagggagaggccgtttctgaacctttatttgggatcccaagtttctaattacacctctaaattaaacagtgccagagttgtatggaggaagaatgatgaaattagattgcttaacatcctccatgtcatggggttttagcttcctttagcttgtacctgtttgtgtcgcagactccggggataggcagtgatccccttctacgtttttcagtcataacccaaccccattggcatctggaacttcaagtccagggtaaaggggcaatcctcaaatcacatacctgccaccagtataggcagataaccacatgctgccctaaaggggaagtggtgtagggtccactctcggaagctccttttccctggaaaatgaaggaaagccactgtgacttaatccaagatgcccaatagtctttaattctacaaagaaagaaagaaaaggctcaaaatataagcattctgggggagtagtaacatgctgatttacatttctgctaagatataactgaatgtaactagagttttctttccttgagaacaggtttgacaggaaggagtgtgaggggtgtgaaggggctgaggttgggaaacaacccgagcactggggaaaggttccaggaaaggaaggctggggatttaagtcagaaaaccttcatcaaattccagtctttcaaaatggagactggaggtcctattccaggtgtgggctcttctgctttttattcggaatcctgggtactgattttctcttcttcatgctgtgccctatgtaatttgctaattgatgatcttggctgtgataggttcaggtgaatttagttgaagactgttctgcttcatgcattcttagctttgggtggaagttgaaagtgactctgaacattttgagaattttgagggcttcgtcagcatttctaacaccaaaatggctcattttattgcccaaagtcatacctgccttcatggcgagtccttccaggcttctggttataagtcgcccagcaaccaaaaattgcatggttggggtttaggagttagttggattagtcctggagctgatctgatcaaaaagtttgaaagagccctagacaaagggctctctctagactttgcctatcctggctctgtccttggcctaggagccagtgatttgtcagagtgagagcatgagggctctgatcttaatagagaatctaagaacaagcagagatgggaagatctccattgttctcagatgcattgtgcttgtggttgtctccctgtggctgttctggaggattggccctcttcttcctaaacaaggagtaaagtctgatgactctataagcaagattatatacactggcgccaaattactaatcttttccatatgtgaacagatgggcttcccaacacgatctccttcagcctggaagaggaagaggaactggagggtggagagtcagcagaattcacgtgcttctcagaagatctcgtggcagagcagctgacctacatggatgcagtatgtcttctctttgtgatcagatgtactttcacttaaaacataggggagtgatggcactggtgccccggtgacagcagtgggataatgtgattttaagtcttcttgaatccttgagacaggctgcgcctgcagatacagagttaagatgtgtcttgaatcaatcatctgaataattcaggcctgagctcttcttgcaactctaggagaaggtgcttttggagctcaagacacagagggaaataagaattcgaatccctgtgaaacaaaatctgccttgttctgtgggtatttttctccctttacactcataaatatttcaagatctgaactgtttatttggaggattgtaaagggatcaaagtataagttagaataaaataaattcacagaatccacatgtgattgtatctggcccctcatttccacgtgtgctttctgtacttttgaagtttgaatatttttgtgagctggacatatttgagtatgtcagtcagatttcataggtcggtgttagatggtaaatacaagaggactgtgaggagttatcgtggtggctttagctcttctgctttatcacttttgacaaggcagtgtggaacagggtggagattttccttctagtgaacattatcgatgagtatattaattatttacttttgtctgttgaaatggacaccatgagacaaatcaagtagaaaaggattatctggccattcacaaaaataccaatttacaaatgacccagatgacatgctttgccatatgaaatgtctgtgttgtccttaaagtcagttcctcttttgttccagcaactcttcaagaaagtagtgcctcaccactgcctgggctgcatttggtctcgaagggataagaaggaaaacaaacatttggctcctacgatccgtgccaccatctctcagtttaataccctcaccaaatgtgttgtcagcaccatcctggggggcaaagaactcaaaactcagcagagagccaaaatcattgagaagtggatcaacatcgctcatgtaattgtcttttataaaatattctttgtgtttggtagatgcaagagactgctccatcacttcgtttaaatggtttagctgtttggttgaaaaggcagtcaaaagaccatatatgagagcccactgggtttttgttgttcttccagagtaagaaaaaagttgcctttctaaacttggcagcttatttattttcctcttttttaaaaaattggacccctgctcacttcttcccagttatgggctctcacactgctacctctctagagtgagacattctgtctgctttcccctttgtattcacgacaagactgagtgttggtttcagcaccatgttcagtaaatataaatgtatggtctgcatgtcaaaacagactgcccttcaacccagagtgattacctatgccccctcccagtacctggaggcattacatcttctgcagttttgaagagctggtacttcttcagagtcctgaatctcttttctaaaggactgagacacttacagagatctcatattaatctgaggtcatgtctcatattaatctgaagttggaggggaggagtctgttcctaggcctgactcacattcttctgagtgttggagtctagtctcttggatgaactgcttacataccataggacctccccttctcagcatcttatctcatgactgagaaaatggcaacagtgtgcagtcagtgggccaccaaatattttgtgaacttctaatgtgtgtaaaccacaatattctgtacttaggggacatactaggatagagcataattatttgtttgcaggaacccgtacacaaacaaggaagctaagatatactggaattatctcagcctgagacagtagaggagtagggccatgggagataagcactgtaaaagtgggggagagagaaatcatttctgatgggatgatcaaggaaggtttcatggatgaattgacatttgaaattaactttgagtaacagataggatttttggtatttgaagattagagaggtttttttttttctaggcaaaagaaattacatcagcaaaataatgattttgaaaaattattaatatgaaaatatcatattaatttgtgttctgggctctatgggtaaactctcaaccaaaacacattttgctttatgtccccttaaatatatttttccttgagcccctattgatagggcataatgttacattctcttttgctgtctttgattaaagagcagagacacaattgtgccagataatttgccttgagtcttcaggtggtctgttattacagacttcttagtgtattatgaaagtcagcaagaaacaaagagtgtaagttgcataaacaacttctatttctcctattctaaatcgagcttattgctcagcaagtaagagatacaaaagaagttgtgagtgagatatagtgtagaagttctctgtttttttagaatgataaggaattatttttttttttgccataagtgtcacagcatgtctcaaaagcagactgtctacccctaattcattcaactactttggctatagtgacaatatagcatctgtgtatgtgacatagtggggctcaagcgatgacttttggtccaaattgaatgtaaattgtgcatttatgtagtaataagaaatgcaagttgaatcatttgaagtatatttcaaatcccatatcatgtgctaataaagccaagggctcttactttttttttggtgatatcacttcctaatactgagtatgttgtatcttttacaattgtgtagggaaatgtaataaaataatgaggcttaccagtggtttgctaccaagatttattttacctttcctgcattcatcgtagtcaatttctattgaaaggatatttgaaaaagaaaatttttctgacctaatatgactatattttcttggactgcccttaatggtatgtttttacttttgcatcacatctcctggaagatgcctctttttctagaaatgggaccagatgccttttgtactcctttaaacccttagtttaaacctctttttgaataatgtgttccatgtgtttatttcaatttgcatgatgtatctgttcctgagttcctttttttattgcaagtttcctgatttttagaatataacttttgtgaacctttgttgaaccatgctcccataggcttagtttccagattgcaattcagaacatttctcttgttctctctctcttcccctccctccctccctcttttcctccctccctccctccttcccctccttcttctctctttctctttatatctttccaaataaggggaggacattgaggcatttaaaaagggtggacatgacttttattaagtactttggcatttactctaaagaaaatgtttgagggtttgtttggcatagttttcagtgtccagattttggcatgctaaattagagtgctgtttttccttcgtattcaggattaacatttctttgtgaaatgattctcgaagtgatttacatttatgcccaatcactctgggacttcttacctgagatactctacacaaaaccaaatacgtgctcacatggtgtactcacttgtaaacactgggcctagtacgctgtcatgtgcctgtatatgaagcatctcctttgacataaggcctggtccagtctcctcacgttgctaccttccccatgccagccaagaatgggactttctccctgtctgttttgctgtccctgctattcagtcacaggactttgactccaaggtcactaactgctgatgctacaggctccttatggtagcttaagtttaaatagggagcctctctccttacccagaaaatggcatccagaatgtttcctgttctctttctattttgttttaaaacattgccaaaatgaattttattttaaaaggccgagttattttggaagcattgaagtaccaaggtgtttttgaatgtttatggttgcaggacaagccaatttgaaaccaaatgaatgtgtataaaaatatccccccttggctaagagcataaaagccaaagttcaacttgtggtgaatttttattgccaaattatatacacctctgtggacaagggttggtgatgagatgttcaataccatctgacctcaaagtggctgctgcccagctcattttgggatctaaagaagatctaaagtgcatatttttaggacatctgtgtgctttcagcagaagaaagttgctctttctagcatagctctgtagacttacctccattagtgtttttactaggaaagctggaaactataaaactgtaacaacaacacaaaaaaatatattgacgagagaaaaacaagcatactgtgccaaaatctataaagtgtttcgatgactggggtgggaggaaggagccactttttgatgttcactatttatacagctgcctattttgtggtaagaattcatagcagctgtgatacctctaaaacaggaaaccaccaagtcattgtaatattgatagttaaatgccttttatgttttaatcactccccatgcaggaatgtagactcctgaagaatttttcctccttgagggccatcgtttcggcactgcagtctaattccatctatcggttaaaaaagacttgggctgccgtcccaaggtaagttcccaagtgtttgctctgcttttctttggccgggataattagtggttgtgatgagtcctcaccttcaaagcttgtatcgcataactagagaaacatatttgaaatcctctgtgtgtttcaggcagggtgcatcttacacataatcattaatgacttttgaggcagggctcctgcagaaatcaaactcattctaagtataccaaagccaagattattggctttggggatgatttgaaggatgtgcttattatctggattttgagggataaggttgtggagtgatgaagttacagcaatttgccattacttctggttatttttcagcctcactacaaagccctaagctattttaggactcaaggggtaatgtgtgcagataggacattagttcttgatgttcagtaggaaactatttagttgtccttttagtttcagcattttaaaaactatcttattggcattaaaaacctttaaatgttctttcctaagtacctgaaattattaactggccacatcctatgctgtttttcttcatatttcttggtgcaaccgttggaataattaacaacttggtttcctgatttttgcactactgccatcacttccatttccggaacttcactgtagatcaaagaactttgtgcaaaggaaggaaaggtgagggagggggcagttctgattctctgtcactacagatttagaggctggggattgtgtcatgagtacaactaggccagctacattcaacaagtttgcccaggtttgaactagtcaggaagttaggctatatcagggaagaatctataaattctgtatggtctataccacatgtggtatagtcagtttcagttaggaggagagggatgccagctggcttcccagccaggctgccttagtggggcagaatggaaggtctgggtcctcagtttcataagtttactcagagttgatcaagccctaagagactggcattgtttgaatttgcaagagccccaagctggtaaaccagagtttcataaatttatgctgaaaaatgagtgccagaatcctcaagcttgctgataagctcatattctcgttcaggggatagtctacttggtgtaagccaaattatttattaggtgattctttgatgggtaaaaagaaaaaaataaagtggatgtttataatgcctcatgttacagagctgtagaagccacagctacttgcactccaaagctcgtgctttgtttatgacatcaatatttatcagtagaagaactagcaggcttttcaaagaccaatgcaattttcttgattattattctttttttaggttctttcttctctattttgaataatcaaggtgattgtgtgtattaaagagagattagttggttgattttcctctgcacatttctccttaagaacgatggggtcatataaaatcattacttgataggccctggtgaaatgcgatgggaaaatcagaagcatgcagtgtccccacccttcacacctccacttcacctcttctttcccttaccaccactctccactcaactgtagtatagtatcaaaaacaaagggacagtcaagtgttaaaatgtagccttactcaattgattgcaaccttgtctgattgccacgaaaggtaatcctttctttgatggttgaaaaaagaacactaaggaaagtcacgtaaccagcctaagatttcttccacagcaagtttgagactaaaacatgagcaaaaaaaattaatggacttgtatcttagtctccttggctgccatatgaaaagatttattctagctggcttttaaaactattttctaaagacaaaggaaaaaccctctaagctgcattctgtgtaacatatgtttctggtttgtttcttagttggtttgtatgtgttttagcaaggacactacagaagtgtcacagttccttagagaacacacttctatatcagctttacatgttctccattgctaaattcaaggaacaggattaagataacttatttggacatggtacatctatacagtggaatattttgcaggcataaaaggagtgtagtactgatacatggtgtaacatgaaggaaccttgaaaacatgctaaatttaaaaagccagccacaacagctacgtatcatatacttggacttgtatatgaaatgtccagaatcagcaaatctatggacacggaatgtagatcagtggttacctagggctgggactgggaggacggtagggtcccagggtgatagctaaagggtagagggctgctttttggggtgataaaatattctaaagttgattatggggatgactgcacaactctgtgaatatactaaaaagcattggactgtatacttcaatgatatgtggattatatctcaataaagctgttattgtaagaaaaaagatatcttatttggttatcactttccctataatccttgacatttgtcgctttaagtagacaaagggaatacctatttatttctcttcatttagggccacatataattaattttgaaattattttctccaaatatgaatagcttaatggttttctttattatttagagtaatattacactcactataaaacaggctcttaataatggtttttttcataataatgaaaatgttgcatatatagtgatattgcccctattaattctttgtcttcagaatcatgcactcattaaccctggagggtgtgtagagaaaaccatgaggctcacagagatgtagtgtcctggaaagggagaggggcagagcagatgctttgcatatgtggtttcactcactgtcccagcagtcccataaaagcactgtcatatttcccttgtagaggtgagaacattgaagctcaggaaagttaagcagcttgtccaggatcattcagaaagtgagtggagagatgcaattggaactcaccacccctggttgcagagcccatccggttccaccattctctgactctgggagtagaaatagtggcctgtgagccagaaaatttggcttccatacctacaaccctcagcagttattcgtggaaatttgggaaaatccctggttctggcatcgtcatctctaaacttaggggcctggccaagatgacctctcagatctgtgggctctgtgtgtgtaacagtttttttttttttttttttttttttttgtttaactcactgagaagaacatgtcctaattgaacaacttgatgccccaattgaataatccttttttatgattataatatgcatggctagggaaatatacctctctccacaggggtggccaagtccaccttaaaagaaataaaaagccatcccgcataaaaaaaaatcatgggccttatctgtgcttacagtacccaccaaccctgagatcagcacagtccctccttagacatgagtcctgaggacagctgggccaaaagtgtcgggttattcctaactcttcattgttaatattttcttaatcccttttcatagggaccgaatgctgatgtttgaagaactttcagatatcttctcagaccataataaccatttgaccagccgagaactactgatgaaggtgaggctcttagtgaggctgctgtgtagtgctgttaatagctctggaatccattcaaggaagagtagtgtgagggctccttaagttccttcaactccaaagaaagcctaaagtaactagaaggcaaaaaatttttttaaatgcagaatctaagaaacttggggctgagaaaattctaagtccagttgagctctctctttctacctcccttagcttgcctgttatgcaagcagattgtgaaacttgagttcatatgtgtatgtacctccttaacaagctactctgcaaataccaagtgctggcagttaggtgggtgagaggccctggaatattccttctcagcaaaacatctagaatgacagaggccaagcctgcctgcaattccacatcctttatttggactaaattgcacaatctgtcagtcagcagtatttattgaacaccaagtaagtgctgacttctgaatgacacactaggtaaagatatagcttagttcattttatgtctccagacatttgttgaatgcctaatatttgtaaagctttgaacctgcttctagaaatatgaaggtgactaacacaaacactgtttcctggagtttaccatctaattggggtatatagacactaaacaacaagaataaatagtcaaataaagacaactaacaggttgtgaacaaccatcagaggggaactagcatagaccaaatattatcctcatagtctttctataaagtagattttatcatcatcattttgtagatagccaagactcagagagggtaataacctgccctaaggcatacaaccaataggtggtagagctaaaatatgaatgtaatgtggtgagactctaaaacctgtgcttttatcaccaagacataaagctatttcttctgacctttttggagtaaggtgcaggatggatcagatccagcttcatagagaaggtaaattagtagttcagtaaatattggttgagcacccactaggtattggggataaaaccatattaaaggcagtgtttgatcttaaggggattacagtctcatgtgggaggtaaaacatttataaaatagtgtgataggtcctaccataggggaaagtcctgaactgggcaatcaaaagttgtgattcttatccttaatctccttttctataaatgggagccaatcaaagtatttggtctgttgacttcatagaattgttttgaagattcactatggtaaaatacttgaaagtgctatgcaaatgtaagttattttttgtatttggtgagctatattcatgtaaaaccaaagtatgcataacaaatgaaaataaatagagaataagctgcatatttgagcttagggaagatacttggagtaggagtgaaaatcaggtagaggtggggttagtaagaaaaggcatccaggtgctaacccttaggttagtcgatcctataagggcatttgttaaggtcttcatgactgttcctgtcctatgtcctacttatccttcatgtctcagtgtagactcctccttttctggaagccttccttcattctcaggtctgtgctccaggagaagctgtcatttctctgtcctggcacttatcacttgctctgttgcaactgcctgtctctctactggtctgtaggcctcttgcaggcaggggctgtatgtatcttttcactttgtatccctaatgcccaaccagtgcctggcatgcagtaagtgttcagaagctattgtttggctgcatgaattgatgggtcttatcattcacatgactttttaacaatatgcccactattagcccttcttggagtaggtgatatgagaagggcagtatgtgctgatgtctgactttggatttggactacctgattaactgcacactaaacaatcattactgagatcgtgttactccctgcttcacatgcccctggctttgcatactttaaatggaaacccatctggctggaaggagatggcttagtggtctccctgtcagcagtacgaagctagactaactggagccacacattcaaatccaaacagtcctgagtcttccttccaaagtagataaattgaatactgtgcagctcattgcctggtagcagccttctggctgaaggcttagaagtgaagctgtatctagacattaaagatcccataaacctttcttaaatgcagaagttaccccccgtactctaaattaaatttcttatagatatgactcaaattccaaagaaatggaaaacttggctgtgaattcatgtggtctgtgcattatcattaatgatagtgaaatgctttgggcagtccatgtatatctgtaggtccttttccagtcatttttgttaatcattcttcatatgaagtgtctaattctgagtgtaaattgtcagcacattttttttttaaatggaatcacaaggtacttagtttctcaaaagagtcactaggaaaaactaccggcctctgtttctagtgttactcctggttttatacggatttatggttgggtaacaatataatagtttcattttattttattttttgtagatatgtagtctcattatttttctcaggctggtctcaaattcttggactcttagttttaaatgacctaacttctcttcttctgggaagatgtaacgtgccacttatataatatggcccaggcaacatgattattagcaaaaatctgtggttttccttttaattgtttttaaaaatgtttcatttcctctcaaagactatcttaaacctgctatgtccttgtgatttctgaaacctgggtaattctaagcaggtgaattatagtctggaaatttcaagacatcagggaagaaagcagaatgccagcaaatcttggttctcatgattcttggtaagaattttttcggttgactttatataaaggactgctagaaagccccagaaattcaaccctgatggagacgtatgttcagtgacactccaaaacatgctaaactcaaagttagagcaagagtctgttacaactgtgacagttctgagctataattgctggtagctactgagcttaagttaaccaacatttatggagatggatccagagtccagtagacaagttccatctagacctagtagaagagggccctctgaagcccaagaacagcatggatgagggtagctgaactctgctaaagatggttataaagaaaaggtgagacttaagcaagccatttgcactaagagacggagagggaagagaagggcagagggggagataaaaggagagagagagggagaaggagattgatggaggaagagggagatttggcatttatccaaacataggtgatgattaaaatcatgagattggatagtatttccaaagacatgagtacagcagaaaacaagaggataactttgacaaaaagaagaatcactaagagaatatgagaacagcagaggaggcagggggagagaatgagtgatacagtcacaaaaacctatgaaaactttcaagaaggttcaagggattggtgttgtgcgacattgcagagtaggagatttggggctgaggaaggaaaaactgaaactgctggatgtggcaggtaagtggattttcagttgacacctcatttggaataatagggactcgtcggtctttttagatctctagcagggatggaatctcattctcatgaaatcataaagtcatggaatcaacaagtcttgtagctccccatctcaggcgtttctctctcctatctaatgaggaggttgtcttaagtgctcttttgagatccctttcacctctgttattctgtgattcttaggagcctttgaacttttcagaaattctctttaggaattttagccatgtctacaataacttatgatacattattcctctgcccataactgacatactggagggagaccagaaggacctacacaccggaaagaggtgggcactcttattcaagtcagacataattgatttctcactctaagcaaattctcaagaatttcggaggactcacaactatctagcacaggaaaggcgcatattaggctgctttcttttttttagaggtggggtctcactatgttgctcaagttggacttgaactcctgggctcaagcgaccctcctgcctcagccttctgagtagctaggattacaggcgcatgccgccatgtccagtataggctattttcattcatccctgtgaaaaactatgaatgggagatcattaaatagtggctctctttattatcatttgtgatgggaagaacttaaataggtaatgagtcactgtgggttctgtcccagtagtgtacctgggacctgagttaaggctgagagatggaacatgttgatgctctatcactatcagcaaggccaagccactgaaaaaaacccttttgtggttgtacagtagtggaaggtcacgtgctatggtaatacataaatctcaggaaaagtgactaaggaaaaactagtgtagaagttatatactactgaattgtgcaatttacccccccattcatgcagttcctggaaaatgagaacttaacaagaccccaaaaccgcaaaagcacttaatgttcagtcagcaaactcatgattactcattatatagaagagtttgttgttacaatagacaggaggagagaaagggtagccatgtgtcctcaggcaccaggaggaaggattgatttgtaagagttccaaacctgagaggcaatttagaagaactgactgggggctggggatgtgtgaaagttcgacttttatggattggtcatgtagtacaatattggacttcctcagaaaacttccggtgcaaaagtttcatttagctaagaaatgctacagaagtagtccctttctttcacagaatgctggcacatccatttcaggccaagatcgagaaatcacaaaatgtactgaggaagtcgatctttgttttcaggatatctgattactttgagtttaatttgggatctgtaaaaatgtcttcatttatgagaattgcctggcttgtattgatgattgctttcataaccaaatcaggtgatcttcttacaaagtaaggggaaggccaggtgtggtggctggctcatgcctgtaatcccagcacttggggaagctgaggcaggtggatgatctgagatcaggagttcaagaccagcctggccaacatggcgaaaccccatctctactaaaaacaaaaaataaaataaaatataaaaattagccaggtggtggcgcattcctctaatcccagctactcgggaggctgaggcaggagaatcacttgaacctgggaggcagaggttgcagtgagctgagattgcgccactgcactccagccttcccagcagagtgagacttcgtctcaaaaaaaaaaaaaacaaagttgggggaagaacaagaaaatccaagtccaccagcctcgttataaataggcaacttgcaacaagccagccaagtatttgcataatatacatcgtgagagcctgctggaggcctcttcattttgcatggtgttccgagcgagagttatgcagggttgtgtgcgagaaactagatgcctctttacttcttaccattgtggcatcctgtatcaattccctctgtgtgcatttctgtttctcaggaaggaacctcaaaatttgcaaacctggacagcagtgtgaaagaaaaccagaagcgtacccagaggcggctgcagctccagaaggacatggtatgtctggccctcgtcttccctgacagctcacagaggagaagggccgtgtgcgtctgggctcccacatggcactggcaccttcagtcaacagggcacccaggctttcagaaagggtctcccattctctaccccatttgttctcagcagccctgggaggtctataggagagagatgattaccctcattcaactagtaggaagtaagcactgggtggcaaatcctgttttctggcaaagttgttttctgaaggtgagggggagtctacagcaggtcgacttcctccctcttgcagtctcttccgccccctcctgcacttagaagctgctccaccttggcctgagggcctcctgagcttcctactgtagtcagcttctgatacatggtgaccaaggagaaagagtgtcttctccacagggccctggtccttgtactcagagatcttttcatttgttctaatctagccattgcccagctctccttactaatcccaaggctaaccaaatctttatagtttttcaatatttaaaggagcatcatgcctccctcctgaagactgaaagataggtattatcaactttagcttcattttaaacttctgactgttagcataaagtgtggaagaccagagggaggagattagagactgacaaactctaaatattctgctttaagagggttttctctttctttggaaagctcaacgtaagtaagaaatgtttttgaatgataggactcttccgcaacatgaagcctataaaacattcacagtgttacaaacttttttggttgttcaaagacaagctaaaaatagctgttaccaaaaaaatagattattttagtacaggatgagaccttgtacacagaatgggaaggacacactgcagctgacagtgagttcctgaaggacaaaaccctccttggtatgaacctcacaaagcagttctggctgaggaagcagccagcctcatgtcaagcagcctggctttaccctgtttgaggctttgtgttctgccaaaatttccagaattggcttgatgagatttaggataagggatccatggggaccgctttttacttttcctttaggatgtttagtgccttggtggcttactgaagaagagagatgattttaaaggagatttagtgaaatgaatatagtgtatccctgcagttgtaggtagaagtgcctccaccttcatttccaactttttattctggaataagtttagatttacagaaaagctgcaaagctagaagtgcagtttccctcattgttaacatcttctaaaaccatagcacatttgtcaatactaagaaactgacactggcataatactattaactaaaatctagactttgtttggatttcaccagttttccactagtatcttcttatctgttccaggacccaatccggcataccaactgcattttgttgtctgtcacccctgtctcttcaggtctacgacagtgttttcttgactgttttttatgaccttggttgtcttaaggggtctatccaggtattctgtagaatgttccacagtttgaggttgtctgctgttttctagtgattagactgagcttctggatttttagaaagaatatcacagagtaaagtgcccttctcatcacatcacatcaaggagtgaatgaatggtttcagcgtgacatctggtgtcatgttgatggtgacacgaatgatgttgatctttattacttggttaaggaagagtttgccaggttcttcctcagaagttactgtttttctctttccctcctctattatttgagagttagtcaccaagtctagcccaaggggttatattaatagtgatgccccatgcttttgtggtacatacttctctgtgtacaacagccaatggtgaggcaatgactatccagtgccatccccaactaccaggaatgtccccatgctctgaaagagaacagacatccttctcacttgagccaaagcaaaacataaaccccacagtcaacacttttgaacagatgtgtatgatctcctggctttgaggcttggttttcatgatttcacaagttagatattagatcatggagtttctatcctatttgtgtagaaatttaaaaaatgttattcatggaggttagcaccactggcccgcagttaggccttgaatacatccatttgctccagcttgaagattcctaaaacccctcaacttttcaatgacaataaagacagttttgctttggatgctcttcagggtgtgatgcagggaactgtgccctacctgggcaccttcctgactgacctgaccatgcttgacactgcccttcaggactacatcgaggtgagttccatgtgggtggtgtgatcgggcctgcagccttcccactggataccctaaagagtagttaacttctcttagtatcttttgaaggtccaaaagtacatggcattgtgctagctgttaggaggaatacaaagaataacaccaaagactaacaccagaagtggctcaaaatccagtggaagtaattaatatatcaaaataagcagtgaacgatagtaataatcgaaattcaaacaaatgcattgagagaacatgggagatgacaattattattatttttttgagatggagttttgctcttgttgtccaagctggagtgcaatggcacgatcttggctcactgcaatctctgcctctcgggttcaagcaattctcctgcctcagcctcccaagtagctgggattacaggcgtgcaccaccacgcccagctaattttttgtatttttagtagaaacagggtttcaccatattagccaggctagccttgaactcctgaccacaggtgatccgcccaccttggccttccaaagtgctgggattacaggcgttgagccactgcacccggcccacaatgaactcttatgaggggttgtgatgaacagggctcatgaaggagtgggtttgggtttgaacaagactttaaggccgggcgcgatgtctcatgcctgtaatcccagcactttaagaggtcaaggcaggtgaatcacctgaggtcaggagttcaagaccagcctggccaacatggtgaaaccccgtctctactaaaaatacaaaaattaggctgggtgtggtggctcacgcctgtaatcccagcactttgggaggctgagacaggcagatcatgaggtcaggagttcgagaccaccctggccaacatggtgaaaccccatctctactaaaaacacaaaaatcagccgggcatggtgacacatgcctgtagtcccagctactcaggaggttgaggcagaagaattgcttgaacccgagaggcggaggttgcagtgagccgagattgcgccactgcacttcagcctgggtgacagagcaagaccccatctcaaaaaaaagaaaaagaataaataaataaaaatacaaaaattagccggtcatggtggcaggtgcctataatcccaactactctggaggctgaggcaggagaatcacttgagctcgggaggcagaggttgcagtgagccgagatcgtgtcattgcacgatctaggtgcccagcctaggtgccagagtgagactcggtctcaaacaaaaacaaacaaacaaacaaacaaaaaaccccacaagactttaatgttgagtaggactacttggtggggtagagagtcagtcaaatttgtgatttttcaaatatgcttttctttttgtattgctgcctgctgtggggtatttttctctctctctgtctctctctctctctgtccccttgtccctctttctctctgttccccctctctctacccctactcccttcatcccccatcttctctgaaagggaaaatacatgaaaactcagataaacaacttgttagtagcagcaataaaatattaagtgaagaagaaatttcaaatttgaaatgaaattgaaagattgcttgcatatttcagtatatactacccccttgttatcatatgcaaccagcctgcttttattgtatcttaattagaagaagtagaagttactttgcatagatctacctacctttggatttgccacagtgttgtggacacatttattcattttgcatctcctgacttctatgtctcttcacatcctctttctcagcttatctcaggaaacacccatcagtgttggggaattctggggagtaaccaaagatttagaagttaaattcagcctactgagaataggagctgaggggatgaagaattgaaacttaacttttcatgatgctatggagaaatgacttcccttttgataaaccgtatgagtcaatgaccatctgttttagttgcttttggtaagggaaaaaagtgtaatggaatatttactcaagcttttatctttactggttctgcaagtgtctttggatcctgatttgtaattatttatcattactattttagttggtttcagacatttcaagagaaggctttctgcttatcctgccttataataatactttttttaaaagcaaaacaggactctcttcttccacagtagtcgtaattataggatcattgataattgtgactttatcacccctttgatctattttaatgtgacctacgacaacatatggctgtgttttaaagtagcttggttgctcactctttttattaaaatttcttttagggtggactgataaactttgagaaaaggagaagggtaagtagagttgttggctgtgtttcctttgtctgagcatgaaaaaaatgaaagaaatggggacttaagtttttttgtagaggcagaaaaaaatgagttagcacctactgaacgtttatcatataccattttgcttggcattctcctatacattatcccccactagccttatgaggtaggttttatcatcctcaattcaaaggtgaggaagctaggactcaagagattaaattactggacgagaatctcttggtggcaaagccagggttctcatcctgtcctgatgccccaaagcccacatttcttccctgcccactccttatctcctttacaattagcttcagcaatagcaggcttgccacttaattaataacaatgtattttatacttgaagattactaagagtagactttaagtattctcatcacaaataaatatgtgaagtaatgcatatgttagttagcctgatttagccattccacggtatatacatgtttcagaacatcatgttgcacaccataaatacaaacaattttttaatttgccaattaaaataaaaaccaggtttaccctattaaggataaggggtttctgatgagtaaatgacatagaagagttaataaagatggtaaactctcgtgggtatactcgagagaggaaaggaaatggccttcgtcttcggtgtaggtagttattctttccctttcgtgtcagcataggaaggtgtgctcaacatcaatttcactcttcctgtggatagcacagttctgaactgtgctattcaagataaaacagtcttgaaatttttctgtgattttcatattcaaatggcatatttaaatagatatttaaaagactcaaaggaaaatgagtgagcaaaataataacttcaccctgtagtactctcgttatttttcagtactttcacattccacaaatattgactgtctacctaacatggggggggtttgggaattacagcagagaaagaacagagctgcctgccctcgtaaagttcacaatccaggagagaggtagacaaataaataggcagttataatacaacctgaaaagggtttgtgagcagaagtagtgggtgttagagaagtatataggtggggtatctatctccaacttgtagggccagagaaacttccaggagaaaatgacgttgaagttaaaaccaaaaaggcatagaggagctaaacaaagctgggcttatcagaacaagatactaacctggacaaatgtaaattttttgtcccatatagacgatacttttttctttagcatgatggtaaatattccttgaggatactgagaccaagggccgaggtcactggatggcaagttgagacttggagaatctaccagttcttgagttacttctgtcatgtcctgtaatgataataaattcagttattgccccctcagttcccctctctgtcatttaacttcagaataactgtggttggtaatctctttcctttttagactaggatattaaacttctggaaagtttgactgtaaaacctaaacctaaagcttatacccattgctgacttaaattttttttattgaaacatccaaataagtataaataattttcaacataattatgtacttgcctctctgtgagttttaaaagacttagttaaatgatttagtggcgtagtaaaaacccaaggattcaggaaatctaaacattcaattttatgagacctaggactgtttagatactcagccctaccaaaacttatttattgaggggtaaaggttgaggaagatggggatggggatcttgggagctccctgacttaaagtatttcttttcttttttttaagaaatatgaatagaaattaatatattttatgaagtacttaaaaccttaaaaatcatttttctattccaaggatgaaagtgaagaagagaaaaaggaagccactgtaacttaacgtagtgactagtttgggttgctttggtagcttgttttatacaaattgctttctcaaggagaaaagaggattaaaaattaaagcatacaaggactttggagagttctagttagaatttttaagagttagttagctcctttatttttaaggaagcagtatttcagaatcctcctagatggttttcttcatcttttatcctaatgtggtatattttcatgttgaaagattctatatttggttggccttattattcagtcttttttttttaatttttggtattctgtctgctttaggaatttgaagtgattgcccagataaagctcttacagtctgcctgcaacagctattgcatgaccccagaccaaaagttcatccagtggttccagaggcagcagctcctgacagaggaggagaggtgggatcacctgtcgttcatcggggtagaactgaagtgttggcaagaaaaatgctgcatttaatacctcgctgggtcatttattcaacaactatttagtgagcagctgctaggttccaggtccttggttttcaaaggcgcatggtgtggcaggaaaggctgagttgatagcatcaagatgtactttcagactcttgcttggccacttatttatctttgtaaccttgaacaagtcatttgttcttccctatcttaaggatgctcatctgtagaatgtttgtgaggcgtaactaagatcttatgtgggaatgctttgttagaatgcttgtcctcagcgttgtcaccaccaccactgtcactgtgtttgtcattcctgttaattgatggtagctttccaggaagctttcaacctagaggggttgagagactcatgaaactttgaaatatgatgggtaactacattcctacaaaacctatgggaagaattggggaaaataaggaaaatataaaggcattaatatttaggctggctgtaaaggagaaacaagattttgccataagaaccggaagagaacattccagaccgagagagaacacaagcaaaagcttggtggcctgacatgtttggcatttgaaggaacagtgataactcaggtgtggcagggacacaaagaacagtttaaaaatagtgggatgggcatagaaaggcatgttcacttgagtgccctgcctgctggctcagcacgtccctgtcctgtagcctgctcgcttgttggcagattggtctgcaggccatatgtggcccactgcctgtttttacatttttaaatgattggggtgggggggaacaaaaaaagaatattttgtgacacgaaacagttatttgaaattcagatttcagtatctacataaatatggttttattgaaacacagcccgttcatttacatctcatctatggttgctttcatgctgtaaagacagagttgagtagttgcaacagagaccatatggcccacaaagcctaaaatactatgtgatcctttacagaagaagttggcccatccctaccctagcccaggggatttctttggaagtttatcataagggagagtgaaattgacagcaaaataagtatttacaaaaaaaaaaacttgaggtttagagaaatatttgaatgaattaatgacagcatttggattcaaactcaggtctgcccggctctacagcctaagctctgaagatggctgtataatgttgggcacccttccccacctactcagtaacgaaatacatctactgtctacagctacaagctttcataaaaggcacttggaatcacatataaattcctcttgtgcttgtgtcagttatatctgcctggcagatagaggtctgaatctggagcatttttaatttaggaagttttggcaattaaaaatttaaaaaagtatttgtaggccaccctggccaacatggtgaaaccccatctctactaaaataaataaatatatatatatatatctttatcagtaatgtaattgcctatgtctgttcattgacgatcagatagattacaaaagtctcttcattttctttagataaaactaagtcatttgtgcatgtgcacaaacacacatacaaaatagtaggaaggaggtaatagagaagaaataggagggggaggtagtagaggaaggaagattcttccactggcctagcagtgggatgagaatgatcagaatggagttagtttttgatgctgccaaagtgcatatatccttgtatttgaaacacgcagaactaaatagcctcaatccatatgccagtggaggtgagggaggaagcacataagataaatgtgtcaaatcgggccgtgaagtcagtaccccctgacgtttatgataggacaacgtttgtatatatctttactttgaacaattagagccttctctaaaacaaaaccaggacatcatgtgaatttaagtgtgtttttcaattctctaactttgacctcatggagcccccttctctttctcagctatgccctgtcatgtgagattgaagcagctgctgacgccagcaccacctcgcccaagcctcggaagagcatggtgaagagactcagcctgtgagtgtcccctgggggttctggggctccaagagggtgccatcagagtcgtgagaggagatgtattcaacaggatgaccttgagccagggtgaaagtgaagagcactccgctcatttgttaagccgtttatccttctgtcatgaactcaaagcatttgctgagtccattcttctccactcccctctctgttgtgaatcaccattctctcctgcctgaatcactccagtaacatcttcactgtcttctggctgccccttacccaaccattcattctccactaaatagctaggttgtcttttaaaatgtacaccagattatgttgcttcctgtataaaaacccctatagcttttattttaaaataaaacccaaactctgtatcctggtttactaggccttacatgacttaacctgcagacttccctctcttacaacattgccctctgttcaccagtgttgaagacgtttgcactggctgtgcctggcctgaaatgctctttcttcatgactggctccttcaaatattagcaaaaatgttatgtgccaagagagaaccctttctaatgttgctgtccacccctcattctcattcatactagctgcttcctccagtggaatgtaagcaacctgagaacaggaaccttgtctatcatgctcgcagttgtattgcctgaggccaggagtttgagaccagcctggacaatgtagtgagatcctgtctctacaaaaaaatatcacttaaaatattagctgggcatggtggtgcacgcatgtagtcccagctacttgggaggctgaggtgggagggttgcctgagcccaggagttcagtgttacagtgagctatttttgtgccactgcactctagcctggatgacagggcgagaccctgtctctaagaacaaaacaaaacaaaacaacaacaacaaatatatatatatatttatacacacatatatatatacacatacatatatatatgcagtacctagctctcaatatgtgcctgaaaaaccaccattatttttaatgaaatgaatcagttaatatctttttgaggatttggggggatcaggattctgactgtctttatgggcatttgatatttcccagcactgtctctccacctacttcagtgagtcacattgagacacaggcagggatggcacatgaccttgagtgttgccatgtccccggtgtaacataaagacctctgctggatgtggatagcaaggtctcccaccatcagcggccacgcaggctgctatctgccatcaggtgatatgggtggtatgaggcattgtgggtgggttggaacatgcgctttagtagaaagcatctggaagatcatcctgtgttttgctcaccctctctttgttcagatgactgtcctggccctgcggaactctagatttatgagcttttggagtcagctcttgaggagaatttttcatagtatcttgctgtcttttcatctttgcagatatgggggaatgaactactgagataatctgaggggcctgaccaagccttgtcagctggtaagactggcatgtgcacagggaatcagctccctgatagaggagtccagacatgcaggggatcctgggtgtccactctgctcactgaggcagcagaaggaattgggagcttctggacccactatggcagtcagaggttcttaaggaaaaaaacaaaaattctcaatgcaggcaggcctaatcctgcgtcctgctacctctatcctcctgccttctccccatcctcatttctatgctactgcttctctgtactcctctccaagcccgggatctatatgttttgtggtgggagttctaatacccctggatcctctgtcttcactgacacagacaagtggtcagtcctatgaaaacatttactgtgaaatccagagagggcaggactgtgagggtgctatgcccttcacaaagtgtggtaggtactcagtacatctcttactagtaaaatcttgctgggataacccttggtatctgcagttgagtttgggcatctattatgaaagcagttcatatgcccccatcttatttcttgtacatacaagggtgtttgcataccattatttttcaaaagatttcatgatcttcttagcatgtttacaaatctgggaaatgcatttttgctgttcccacattcaatggctcatcattccaaagaggttggagaaaactttgggtgcttaggcctagtttgaaagttagagatgcctactactgagccagaatgaaccttcacaacgcaggacaaagcaggaccttactgaattgtagaaatggaagaaccctagagactctgagataatggatggaggaccactagttgacatcctttcaagatctacctttgtaatttatgaagcagtaagaaagggcattatttttgcttctgtgatcagagtttagctcatacccctatagtccctgtaatgctcctgtaatgcttgaagggtcataaaaggaagacagggaaaatggggctggagatagcagggtagagataaggcagagcaaaaatatgcttgagctcttggaattcaagcatataattccgaaaatatttaataaaaaatcaagttcaccttcattgtttctattattgttgttattttatagtcagtacttgtttaggttcagcccacgtgctagttgccttgcatgccgttccttcttaatctgactcccgccctccttttaccactacttgtggtgtaaatctgttaacggtaaaccttctcagtcttagtctgagaaagtctttattttgccctccttcttagaattatattagacgggtatagaattcaatactgactgttactttcactcagcactttgacgatattattcagtgtcttttgacttccatggttacttttgagatgtgtggtatctgcttaattactattcctctgttttatgttcccactcctgttgcttttctttcttctttccttccttccttccttcctcactcgctctctttctttcaaaagagttttgctctgtcgcttaggctggagtgatcttggctcactgtaacctctgcctcctgggttcatgcaattcttgtgcttcagcttcccaagtagctgggattacaggcacatgccaccacacctgggtaatttttttgtattttggtagagatggggcttcaccacgttgcctggagtggtcttgaactcctgaactcaggcagtcagcctgcctcggcctcccaaagtgctggaagcactttgagagccactgtgcctggccccctgttgattttaagaatttcttttgtctttgatataccagtttaagtgggagtttagtcttaccctattcaggacatggctcttggatgggaggattcctatggttcaccagttctggaatcctctcagccaccatctcttctgatatgggccttcttccatcctctccatgtcttctggaactcctcctacacatacctggggctttcttactgctttctccatatcttttcactgttctttctatgtctttatcttttgatgatgatttttgaggattttcttcagatctgtcatctagttcatgatttttttcttcaagttatttaatccttccactgaggttttagtttaagtcaccacctttttcacttagaggtgaaatgtttttcaaattatcttcttcctttattaggatgtcttgctctgagctccggttttcaatttcttcttttatgtctttaatatttcctaacatacttattttgcagcttggcttatagtagacatgcagatatttgttggatgaataagcacattattagttttgttctgacagttctcaaatttgaagttctcaggagtctaagcctgctttttgttatgcctgttggctctctctttcagtggaatatttccttgtgtgtattttgtaattttgtatcacgagtttatctttatcaggggattctctgaagcctgggctgaaggtatatccctcccgcaagattttctttttttttaagaaaaaatctagtttactagcggtgtcaccggttgagagtttctaaccccatagaccacataaatagcaaattggagtgaggcacagacccagctcacacatgacttcataggagacatttttcttctttccatgctcaggcaagaacagtctccctgttgtcttcctatgctagtagaaagatatttttctggcctatctttttagtaagggtatagccctttgtgggccctggctgtatatagttttggttctaactcctcaccattcataaacagaaaccctcatctttgggccctgggtgtgcattaaaacccatatcactattttgccaagattggggcctcccactcccccaccagagcagctgcagaactagctcgcgtgcttctggttttcagttcctttttcacttaaggcctgtagggatttcccttcctatcttgcaagctcaactaaaaagagtttttaatatttcttatctagctgttttatagaggaagcatttaggatactgtagttcacagattgttggaaatagaagtcttcctccttggtttcttacccaaagcagtgccatcccttctttgcctgtgaagatcattttatggtaggaagtgatgggggtatgctgatggtatcttgatcctgccaaggtggtccatagactgttaaaatgtagaggaccattgacctagaaagacttcagattagtactgaataatctatgtgttctttgaagttggaaatactcttttgggacaagatgtttactactatttgttagaaactttatagcgaatgtcctcctaaaataataatgacagaacacacaagactgaaaaaacatcaagggcttaatcaacacaaaatatttgcctaatcatggattccagatttgtaacagcccaaatgcttggcattctgtttttttccagactgtttctagggtctgacatgatcaccagtcccactcccaccaaagagcagcccaagtccactgccagcgggagctctggtgaaagcatggactctgtcagcgtgtcatcctgcgagtcgaaccactcagaggctgaggagggctccattactcccatggacacccctgatgagcctcaaaaaaaggtatatactcaacccttctcataattcctaatgcaggcacctacatgctctttgccacaccacagcaaggaatgtctgtttttaagtggatcactctatagtattttgaaagtcatgttttgaacaggcatcaaaagaagagttcaatttggggacatactactaatagaaacaggtgtaaaagcactaagcagtttcgtttattcatttggcctttgaaatattgttctatacccacctcttaaggcactggagttatttaggggaagtaggacttcttagaaagagcaaaaagtcagagatggagatgtgtcaggttcttggtgccatgttttgtcttagccaagcatttatcacaataatgttgcattgcatgccactccaaaagtcagtgacttaaaacaaccactatttatctctcttatgtatctgctggttggctgatctaggttgggcttgacactaggccacagatttggtccaggtctgttccacttgcctctcattattgttggagtaacgggctacccagggcatgcccttagcatgctaagacggacaagcaagagggcaagcccactcgcaagcatatgtcaagcctttacttgagtcgtatcaaccaacattctattggctaaagtaatcatgtggccacattccacataagtaaatgaagcagagaaataggctccagttttagtgggaggaactctgaaatcacagtgcaaagggcacagctgcaggggaagatgagggattggtaacaaggatacattctcccatgttggaaaaaaggaaactgatgagaggtgataaaagaatttccgtcgagtttctattttctgtgactgcataaataaaaatttaaaaaccaaaatatcttaatcttaagatcttaattaagaccagtcttcttttttttttttttttttttttttttttgagatgaagtctcactactctgttgcccaggctggaatgcagtggtacgatcttggctcactacaacctctgtcttctgggttcaggggattctcctgcctcagcctcccgagtagctgggattacaggcatgtgccaccatgcccgcataatttttgtatttttagtagagatggagtttcaccatgttggccaggttggtctcacacccctgacctcaggtgatccacccacttcggcctcccaaagtgctgggatgagccaccgcaccccaccaatatcagtgttaatcttctgtacacatctgcttcaatctgttggttgaagggtttggatcagaaagtcaactatgacataactagaatttgcaccatttggggaaggtttctggctaaccaagcttactcaatagtgacttctggctccttagcttatggttaggtcagtaaggtagaatgttggcaatggtttcatcccttggtttatatctgctgctcttcaaggggacatgtgtgttgcttcacatggtgttaaaacaacagtggtaatcctggaaccctcaagtgactttgtcataatgtagccaatccaggaaaagcatcatattcaggattcatcaaactgagatgactaatttgctgctctagttggatttcttagctttctgctttgaaatccaggggatacaatcattcatgctctaaatattgaaagaaagccttcgtggacacctacggactggccatgctctcaaaaggcatttttcctcaacccgggatgtagtcattcttcgtgacttgacatacaaattagctttgtcaaaatctggaatgcagtctcatcattcactttttcacagcctctgaggttttataggctccatttctgatggtagacattgtaggaaagtaataactgaggtattgcccacattattgtgggatttctccctgtctctccaggaaggagatggaatcacagtcacaccttgtggcatagtggaaatgtacattggtccaaatggtaccttttaaaactatgcagaagcccagtgtgctttctcctgcacatcccttgcttcatcttttttgtctcatccctcatcagactggctttttaaattcttgcagaagtcatggctctttattctttggatgaacctttctcagagtcatacatttcttaaacatcagtgattcacttggatgcaagtagctcctggactgcacaatccctgcatattagctagaaaggctcgtgattctcctgcttggcacatagctggactgagctgacctccacacttccttcctgacctgagagcctgtgacagccgccttctccaaaagtcctccagactgtcattcttccttttccacaggctgcactgtgaggttgctcttaagggtgaagtgtaatttatttgcattcctttcttcattccccgatcatgatttctaaatattgatttttgcacttgctcctcacttcttaaattctcaataggaatttgggggctcatcaggcagtctgtttagagctgctataacccaggcatattctaggctttatcttaactataaatgtcactagaatcatagaaaaatctaacaaaggaaatagagtttggatagaggaacatgaaggcgaaaaaattgaatgaataattggaaaatgcacccccttaactaatatatctgcaaagaaacttatgctattaacttatctatcatcagttagtcctcaaattgagccactaagttgattcatttgggaacataaggaagaaaaaaacccaaaaaccaaaacaaaaactaaaccatattatgatagagccacaatcagacccctacccatgagaattgtcacatcagctggctggctgtaaactaactgtgcaatagaactgaatgtataattatgccacaggaggaaatctacaggaaataagataatagactccattttaatcagaagcctgataaccagaaagctcaacttctatactgtttccatggaaaggcagataaatatgaaagaaatgttatttattttataaatgacttccagaatattttataggattaacatggtataatttagcttaagtcattccgggaaattctttataattttctacaataataatgggtattttaaatggttcaatttaatgatttttaaaagtacctcttccaataacttctttctttggttattggtattgcatggatgagaaatgtgtagttaatcagaaaagcatattaactgtagtactccatttcttaattgtccttgatacacatcatgaaaatgtatacagttggctctactagcaaatgtggaaagtggtgaagctgcttaaaggctgtatttcccttgagcaagtcacttttatattctgaatcttattctcctcgtctttataatgctctgcattttgttcacaagacagttgtggaattaaaatgggataagataatatgaaagttcatgataagcctcacagtactaaacataccgaggtagcagcatactatgttgattcatcttattgtcatcagccacaggctgagccttggccatgtgcttgctctgggaactcgacagtgggaatcagggagcttgggttcctgttctaggggtgctgtcaactagctgtgtggacctggagccccagttttctccctgggtctcaggttcctcagcagaacaggtatgggactagttgatgtccaaggcctttctagcactaatattcaatgcagagccgtataatctggggtacttctcttagaaacttctaaaaatacagaactttctctctcactacgaaatctgactgcagtaggactgaatcaactgcgttggcaaggctttcctccagccccgtaagcttctgacttctttgggaacccatattgcctccagtttctggtgtctgctgccacctgctggttaacttctataagaacagctaaaacctagggaaatagaactgctttgcctcacgtgcttatagagtgattaggtcacactgagtcaccgataggcatctaccactgatggggactcagagtacttacaccagggatgagacacatgtgtgctgtgggctgttgtggaggaaataactgcagtctatcagtcttgatatctacctctgctttgaaaattgcaaagctgttggccagcgttctaatctgttttcttctggggtgtgtttactcttccagctctctgagtcctcctcatcctgttcttctatccattccatggacacaaattcctcagggatgtcttccttaatcaaccccctctcctcccctccgtcctgcaacaacaaccccaaaatccacaagcgctctgtctcggtgacgtccattacctcgactgtgctgcctcctgtttacaaccaacagaatgaagacacctgcataatccgcatcagtgtggaagacaataacggcaacatgtacaagagcatcatggtgaggagcaagccctgacccaggagcgggtttccatttagattgtgtgtctgtgtctgtcggccgctcagactaatagccctaaatatgcacactcaatattagcatatacatatatgcattcacacagaagggatgtgtgtcagttccaggtctccctgggcatagatgctgaatgatatatgtatataaaatatatatacatatatatgcacacacatggtgtatataggatataattttcacatcttaaagaaatgctaaaacttattcgtttaggtcagtattagccatttgaaaattctcaatttgggtgacagtgtaaatgtgctccagggaggatgacacaacctcacacatttttggaagccttcctatggaattatatgtctggttttatcattgaatttccacacattcttagcagtgtactcccctgatggcagatttttgtcatttagtcatttggatcaaacctagttaataaagtggatgatcaagctagaaatacagtttgggttaatgaggaacgatgcctataaaatgagactgacctttttgagcttcttgtaaaatctgtgtgtttctgaggacaattgcaaagatatttttaataatggcagtcttttgggaatacacacagagcctctcatggcgataaccttgggtatgtgaggtctggtaggtttatcacaagaatataaactccttagtttatgggagataatcatgtattggaaatcactttatcctttgcagcaaaatcccacagctaattccacatctctcctcatctttatcactcgcctctttgaaggcacactcagtgcttacaagctcaggtctgaatatggcataagtggtatggaggctccacataaaagctttgctaaagcatttattgagtcaacaaaatatcaaacatttattgcgttctagtcattagatcaggctttggggatagggagatgagtgagacatttctgcctttgaggaacttttaattagaaagggagcccacaaagcattattcacaatgtgcaaaataatagagccaagatcaggtggtaaagggccttgtggcccacacagaggagtgtgttaatcccgcaggcaatagggtcttgttgaaggcttttaagtagtgatgggatttgctcattaagaaagtcatggcactgtgtttgctggagtgtcggggtagactggaggcggggaagcaagttaggaagctgctatcatgttccatgtaggagaggataagggcttgaatgacggtcatgtggctggagatggtgaggatttttgaaagcttttgatgaggtagaattgtagaatccattcatttagttaccaactttttggttactgttgtggaggactagaggctgtctgggtagttggtgggtctgtgagatatgaactaccagaggaggatattcagggacatttaaatcagaggtaccagtatgacatcagatggcattgtctgatagatggtcagaaacatgggctggtgcaaggctggtgctgagatcaaatactgggagttgtcaaaccccacaggggggacgtggtctcgcgagactgagtgtaggatgaggcagaatgcaagtggtaatgagggaggggctaataaaggagcacccgagaggtagaggaaacacagggaagccaaggtcctccatgtggttactgcctgctcagcatggtctgttcacctggcacctcttacctgcaccaatcagagagaatgtccactgcataactctacagtgtctctgaattatagcatggatttgtacaccaaacagttatgttttgggacatgcctggtcagcgtgcactctgctcagtctggggggaactgtgagtggttggactgcacaaacctctactgcccaggaggagtcacaggttgtgcatgctgtctgagtgttgggagggtagtgagcagaagatcccctgccccctgctctgagattcctccttccccagcaaatgggctgcctctgtgagaatcacctctcctgccaaccccttcctgtggccctttatattgcaccaggtggtggcactcacctttcatgaaaatcctgccagcgcatgtcacaggcttattctggagagacgacacactgctctcgtgctctcattctaatcgttaggcctctcaggagaaaccttgctcacaggacgtacctttctgaaatgtattatgctgtgtgctgttgaccagaagatggaaataaatcagtccaggttcaggcgagactagcagttctcaaactttttgttctcaggacccctttatactctgaaacagcattgaatattccaaagagctccagactatgtgggttgtatctgttgatatttaccacattagatatttaaactgagaaactttcaaaatgttgattaattcatttaaaataacaataatgaacacattgcatgttaatgtaaattttattttttaatgaaaaatatctatttttttccaaaaattattgagtgagaagtgtggcattgttttccatttctgaaagtctgttaaaatgtgagtgagactggctttgttttgttttgtttttgtttttactgtgagtacagggtactgaagaatacagtgacagctagtagatttgtagttagaaaccactggaccgatttgtgctgttgtgccagcaattccatccaccatagcttctgcaatacctatgcaaatgtcaacacaaagaaaagacaaacagcatcttagtattatcatgaaaataattttgatctcatggatcccctcacagatttcagggaccccacgggccatagattgcacactgagaactggtggcctagagaacttgctttgcaagagcaactaatgtccctggaatccaaggcccttccatagaagaagagacagcaattagcccttgtaaaattacctcctcagtgaccatggaaaaatgtcttctaccactgaacccatcactctttcgaaatgatctttctctccattgtgtcaatcacagagtcagtctcccaagatcccttacacagggaatgcagtatttctgtcacaggaaagtcaatgagggcgacaccaaagcatcgttcagtaccgcgcattcagtacagcagccactggccacgggtggcgatggagcatttgaaatgggaatactccaaattgagatgagctgagggtaaaatatataccagattttgaacacttagtacaaaaaagtaaaatactgcattaacaatttttgtattgattatatatgctgatgtaatatttggggtgttcaagttaaatatcacctttcaaaaactttttttttttttgaggcagagtcttgcactgttgcctgggctggattgcaatggcacgatctcagctcactgcaacctctgcctccctggttcaagcggttctcctgcctcagcctcctgagtagctgggattacaggcacccacgaccacgcctggctaacttttttgtatttttattagagacggggtttcaccatgttggccaggatggtctcaagctcctgacctcctgatccacctgcctcggcctcccaaagttggtgggattacaggcatgagccacctcacccgtcctaaaaactttttaattgtggctactagaaacttaaaatgaaatatgtggctcacattcgatacctatgagtgctaattcagtctatcagcataaggatgcacgcttgagctgtgaatactcattgtaatcataagtttgattcagcatcgctttgatggtacaaagtaataaacacgcaagggaaagcccttggtcatcttgtcttcattgggacatacctggggaagtttaaggaaaggagaatgaaggtagcctggctgtctcatatgacttacccaccttagcctgacatgcatcccctgaagggaggtcttctcctttagctttctgctactagtccagtgtgacccagctttgggagtattttcttcatactatcaaaaacatattttcctcatttagaattttgtgtgcacctacttttcccttgtaaatgaatatgccagatgttttggtaacagacacgtgaacaagatctttgctgcttacaaggacccctttgtaatgcacattgtttatggaatcacaaacaccagctgctgccccagatcagagtgaggcatcttggcactgccatcctcaggcacacaatggcagtttctgggaggaaatgagacttctgtatgtgtcgaggggggtcgtggggggctttctttctatagtcctcttgccccctggtgagaacagcttttatttttaagtaagaataatctgagttttcattcacttctttcaaacttaaagaaatcacccaaggtatggtacataatttagctttcttttcaggttgctctgcacaccctgcaaatagttggctggcaggcagtgaggtgaagggaagaacatcagaattggggacgagggaaacctttaacttgtgcttttaaaacacttacaagctgatgtttattgaagcataatttgcatgtagttacatatgcagatcttaaatgtttgattctttgagttttaataactatatatatctatgaaactactaccccaaatctagataaagaacatttccatcctgcctgccagattccctgtgccctttccaatcaatcccctcctaacctagaggttcattttctaatgccacagattttgtttttcctttttttgaaagaatagactccactggtatgtaatcttttgtgtccggtttcttttgcctaagatgatgtttgtgagattcacctgcattgttgcatgtgccagttcttagttcccttcagttgctcagtaggattctattatgaatatactacgatttattctcttttcctgttgatggagattcagattgattcagtttttagctattgtgaataaatctgctatgaatgtttgtgtacaagtccttttgtggacgtatgtttttattccgcttggtaaatgcctaggagtgggactgctgaatcacagggtcacctgtactttttgaaatggtcaatgggcagaactgcgaccatttttatcccgtgggttgtaaccagtgccatagaagcagttcaacatgggaggataattttgggccaggactaataatgctttgcatttttcacaattccctcatatatattctttcacgggaacttcaaccactgtggaggagataggcaaggaaagcgttctctccattttaatagcggatgacgctgtgactcagagattaggtgactcgcccatcatctgtggctgctaagggtagaaccaggactagaaaccagggatcctggctcttggtccagttccaattccacgagtccgttctttctggaaaggcatcacaacacaagacagcaagaatgagagggtcaggagaactccctcaggaaacgtgaagctaagtactttacaaacctgttcattgtctttgcagttgacgagccaggataaaacccccgctgtgatccagagagccatgctgaagcacaatctggactcagaccccgccgaggagtacgagctggtgcaggtcatctcggaggacaaaggtgggcatccttccgagacaggcatgttccttcccagggcaggtggctagcacatgtccacagtgctccgcgtttagaaggcagaaaacggatacgtattgttttattgggacctagtggtggtttttgatagtgcaagggtgaacaaccgtgccatcacctcacttgtggaattaagtatctcaaaccgctctccgattccccagctcttgtttttcctgcgattttgatgagtatttcttctgcccagtctttctgagctcttcaaacacttttctaggaagaagtgtctccctgtgccaggaggcagagggtaggggagtctgttgggcattgcaggtggccacacacctcctttacccaagaatgtgtttctaagttgtgtgtgaatctgaaatttagtggttcctgtaataatttctcatcatttcaattaatcatgtatgaaaggtattttctttattcatgatcaattttaaaataacacaaacctctaacttgaaggttatttacctcacatttattgaggcaaagaactggtaatctatgaaaggcttcaatatgcctgggaacatattatttaaagaaatctcttttatgaaatactttttgggggaaataatcacccttgcatgtatctgtctgctaatatgaatttggggattgtatttgttgagagaaggaaacaggctggtagaaaactcctctgtaccttgtcacttcacagacagtgactgtcaggataggtctcttctccaagtgcagaaggagcagcaaatattgttgaccgaagccaaccctttctgccgccagaccccaaactgtccattgcagccaccttaagtagtcctctgctcaccaacaagcagtgtcccctataagtgagaagcattccacaagctaggctatgggatcagcatgtcacccagggctctattgctggtttagaggagagtggctgaaattagaatactaccttctcctagagattaaaagctacagcctctgggaaaattctttttcagtttcctcttggaagatttctcattcattcagctgagccttaggctgtggggcaacactttctcagttataaccttttgatgtaattataattataattctaagcctaaaagatggtctcaagttgtaccattttgcttacaacacagcactaaggtgaggctggtgggtctaaaggtccaggagtctcgaggggtagccaggacccagtgttgcccaccagctgtgtggtcctaaatgcaagctgctggacccccgggccttggtccttaattagagacaataccctgctggttcctcatatatcacagggcgattctgaagataacaagaaatcgtgtacctgaacatggggagacactaagtgatatataactgtgaggactattattactgacctgtgagtatgtgggcagcagcatgggacactttgaggggattgttctccgctgagcctttgtgcacagaatgtacaggagtcacttggaacctgctcatatcagtcttgttgttggatatcaatgtttgaagttaacttaagactcaatttgtccagttttacaaccatatgcctctctggttgcctccccgaccccactaccacagagctagacttgcacattttaccttttttaattctgtttgttttttcaaatactcattacacttgagtgctaaatactgtataccttcttgtggcgattactcaaggatctagaaccagaaatgccatttgacccagcaatcccattactgggtgtatacccaaaggattataaatcattctgctataaagacacatgcacacatatgtttattgcagcactattcacaatagcaaaacctggaaccaacgcaaatgcccatcaatgatagactggataaagaaaatgtggcacatatacaccatggaatactatgcagtgataaaaaaggatgagttcatgtcctttgcagggacatggatgaagctggaaaccatcattctcagcaaactaacacaggaacaaaaaaccaaacactgcatgttctcactcataagtgggagttgaacaatgagaacatgagaacacatggacacagggaggggaatatcacacaccggggcctgttggggggtggaagactaggggaaggatagcattaggagaaatacctaatgtagatggcgggttgatgggtgcagcaagccaccgtggcacatatatacctgtgtaacaaacctgcacgttctgcacatgtaccccagaccttaaagtatagtaaaaataaaataaaaattaaaaaacaaaaataaaagtgaggctgggcatggtggctcacgcctgtaatcccagcactttgagaggccgaggcaggtagatcatctgacgtcaggagttcaagaccagcctggccaacctggtgaaacccgcctctactaaaaatacaaaaaaatacaaaaaaaaaaaaaaaaattagccgggggtggtggcacacgcctgtaatcccagctacttggggggctgagacaggagaatcacttgaccctgggaggcagaggttgcagtgagctgacattgtgccactgcactgcagcctgggcaacaagagcaaaactccatctcaaaaaatataataataataaataaataacttaaataaataaaataaaactgagtcaaaataactttgctttgatgatttcatattacacttggaacaatccttgttcaaaaattacagatgtctagttgggaatcattgaaattgaaaatagtttaaatattaaaagaaggggatatttgctgcaatatttgctgctccttctgcacttggagaagagacctatcctgacagtcactgtctgtgaagtgacaaggtacagaggagttttctaccagcctgtttccttctctcaacaaatacaatacccaaattcatattagcagacagatacccaggaaggggagcatcacacactggggcctgtcagggggttggggaaaaggggagggagagcattaggacaaatatctaatgcatgcaggacttaaaacctagatgacagattgataggtgcagcacatgtatacctatgtaacaaacctgaacattctgcacatgtatcccagaacttaaagtaaaatactataaaataaagatatgcacgttcagcacatgtatcccaaaacttaaagtaaaatttttttaaaaaaatatacatactttcctacatgggaaataaaatactcgtttgacgggattacttcaaaaaatatttcaatatttcaagtagaattctggagtgctgtagattttctgttttttctatgtcattggattctcttagtctttgagaaaatctgcatactggggtggaaaatggactgcaggagaaacgaaacccgagttcaaatcccagttctgctattcactagctgccatcttgggaattttctttaacttttcttggcctctgtttcctactgtactttttttctagttttaacattttctattggaacatttaattcatggagcgaatttctaaaatctcatttgtactaattttttaaattgggattgagaagctggggccaatttttggggtagtgatggtgatcactgtctggttcaggtcacattccagagatgaagggccgtagtcccgttcttgtgtctgggcaaggtttacagctgccgttgtcagtactgagctgacctccacaagctgaccatcttatctttccttatctttttcagaacttgtgattccagactcagcaaatgtcttttatgccatgaacagccaagtgaactttgacttcattttgcgcaaaaagaactccatggaagaacaagtgaaactgcgtagccggaccagcttgacgttgcccaggacagctaaacggggctgctggagtaacagacacagcaaaatcaccctctgaagggagggaccagtggccccttgtttgccaaaggcagagtggggctgagaaacaggctgcggtgattgcaattaccatccggtgttcgaggatcattggtgaagtcagcagatatttattgagttcctgtggtgtgcaaagcattatgataggcaccgtggggaaactggaaatgaatttgacatgaaaaggatgaacgattcactgattctctttgactcatttgagactaaaatgcagaattaccaacatttaaaacatatatatgcacatgtatttggtatgcatgtgtatctatataaaaatatataagagggactttatgggatagtatggactatggaaaaacaaatttgcacaatggcctgggaagttgaggtcactttttacagggaaatagaagaaactgagaacctagtctcgtatattctgagtaaatggaatcagtcctgggaatagagagtgtcctttgtgccagtattacaagaagcccaaactttatttttataaagggagaggatgactttctcaatcaagtgccaccagataaaaacaactgcagaggctggaactgccacaggctgtatgaaaggccactttggaaagggtttggatgagctggtggccttcaacctctgcctgcatctgccactttctgctaccctagggaggccaggaggagcttcggaggaccatcgccccactggtctagccatcatgacacctctggaggtgtcaagctcctgaaacaagctcatttcagtttctggcaaccccgtgtatttccgttttccccctaaagaacatatcataatcattgcacaaataaccatgttctttggtaatgaagccagaaaagaaagcgcaaaagaatggtgactcatttggactcttatctgtcttggaatgtcactgcttcattgccttctctgattgccttttgcatgtaaaactatgtgtctggagtcttttgccatctggatcttagtacctctttattatgtgcaatttattcctcaggtgtggaaatttctactgcaattgactacgtttgattattttgagcttgtgaaagatttctgaacagtgattgtcccgttaatagcccctcagaagatgttccctgctgataacagcatcctattttacttacttttatagcattactgtgcctagtcgtggggaaagagatggggctgtatagattatctgaatcatttgtctaagaggtacattcttccagatggaatcaataacttttttttttccaggttcccgtgcttgctatcacagtatcattgttaagtgacacttttgtctctcataacaccatcacactcttccttccaagtctgagctgtgctggggtttgaactaaaagccatatgtggaatattgacatgtgtaagaagcactttcagaatgttgtcctttttaagaaatgattctcaaaataccagtttttattccaaaaatttagagaacaaacccggaatatgaagtgcagattgtaacatggagctatttttttttcttaatcccataatacagctcctaaaagttgtgtgggatttgcgttgcataaatagccatgtgaattccacaagaagcaccagggaaagtttagagatttgcggcaatggaccgaagaacgggccaggaagtcctccaatttcctttggtctttccaggagattggactacacattgtaaagactgactgggtttcaactagtcaaaaagcactttcttctgttttcaatccctgttcgatttgtgcttctgtgcttgtaggagagatggccagggtggcagccctcatgcaggttgaagtatatgtagcctcagcctgatattcttggtgcgaaggtaaaaaaaaaaaaataaataaaaccattggcctggttgagggcgtgaccaccaagacatatatgttgtgcccgtgttcatcctgtgtatttatactgtatatgtagagtctagatttatatactgcaatgtaaaatatatatatatttaccttttttaaagacaatggaaattccaagtagctaaaacttagcttcatttatttaatgccactttaaatgtcttaaatttgtttcctggtggacagccgggtaatgcttttagctgctcgcatgcttgtctttctgcatctccatcatctgtttaccttttggttaaactaataaactagtttgggacttggctggcatgtgctgccagacccaaaggga

SEQ ID NO: 1602 - DNA, 54435 bp, Homo sapiens
ttacccggaggaaaatggatttattgctttataaaaaagaagtctaataaaactgaagagaaaataactaaaaatccaaacacaactcacccctctaagcacgcccaggaggtctcaagacacacttctgggggcagtcaaggtgggcgggttggtgggccaggcggacgggcctcccccgtcatcagctccagggccccacggagcccgccggcagggggtgctgtgggcctgtggccttggacaagctcctggccccacgccaggatggctcctgggcactggcccagctgcaggcctggcggctcccgcctggtcagtggggataagggctaactcctagagcccaccccgaccccacacacacctcggacccacccacgtccccaccccggcctggacctccacgtctgccggccacagcctttcgtccacctccacaaaagcagctgtgtgtatgtacggggtgccctggcggcggtcctcaaattcccttcaggtggcagacagaacgagggtgacagtgaaaacgtgtccgcggcattggccctcggggaggaggcgaggggtccacccagcccgctaaaccctctccagggcataagccaggtggggcttctccaccggcctccaacgggtgggcaggccctggacaggcgacagggggctggaattacaaaggaattagcaccgacaacaggaagcgggtccttccttcctcaggcagcctcaggctggccggggagggggtgggggccaggcgcgggcgagacagtgcaagcctttgtcctcaggcaggtacggctgtgggcatgcagccgaggggcaggtggcaggcaggggatggcagccccctctgctttggcaagaggcagaatccagacactggcgggagagcgcctgcctgccgggcgttcctggctcctgctgcaggcaccacagagaccccaggccccgggtccccggggggcggcagagcaaagtcagggcagcccctgcgttcggcaggagaaaacgcgcgtgtccggggccctctcccgtccttccaccacagagctccgaggcagggccccgggagggagcgtgaacgctggcacggagacggcgaaggtcctgggggtgcgtggggtactctggaggggcaggacaggggtcagtcactgaagcacaggcaggagaccgcagttccgaggcggcagccactacacgaaggcctcctggttggacgagccgttgattttgaggaagagtttgtcatcctcctgcctctgctgcagctgccgctccagctggcgccggtagcagatcaggtagagcgggaggcagaagcccagcaggctgagaaggagcagccccacgttcacctggggaggcagggaggccgcgcatcacagggcgtggtggtgcgccgaggctgcagacccgccctccactcgggtttgggaaaggggagaaggtcacggggtggaagggggaacgaaacaggaaggcccacgaggtcccatatgccagcgtcccggttcccaactcttcacaggccatgtggccaccctcagggcctgggcccccaggaaacacgggctgatctgaacctctgggcttggaacaagttcctggtacctggtgaggaaatctggccctcggaggtggggcggggacaggaactgtgttctttttttttttttttttttttttttgagacgaagtctcgcgctgtcgtcattcaggctggagtgcagtggcgcaatctcagctcactgcaatctccgcctcccgggttcaagtgattctcctgtctcagcctcccgagtatctgggattacaggcacctgccaccacacctggctaatttttgtatttttagtagagacctggtttcaccatgttggccaggctggtcttgaactcctgacctcaagtgatgctcccgcctcggcctctcaaagtgctgggattacaggtgtgagccaccgcgcccggcccaggaactctgttctatttctccccaaatcaggtccagagaggacatgttccttttcctgcctagccaccattcacaaagggactcttaaccaatcctaaccaacgctcccacatgtcctcggggccctgaagcccccgagggggaccttgcagctcgcagttagcagaagggggcaggcgcccatgacccaccatcccccgacccctcttacccacagagggtctccctggagaggacccatcatggccagaaacagcggctgctgcagaagggcgaagagcgcgctgatcagagactgcagtcccgtgaggctgccgaactgggtggaggggtacctgcagggcaagcgacagctcacagccatcctgcctcctgggctttgcttggccccaggtgtctggtgaccccgggctgcaccgttggtgccagagaagggtggggtgccagccctcggattccttcctgctgggcagttctgtttttttttttttttttttaagatggagtcttgcactgtcgcctgggctggagtgcaatgacacgatctcggctcactgcaacctccgcctccccagtccaaacaattctcctgcctcagcctccctagtagctgggattacaggcgcccgccaccacatctggctaattttttgtatttttagtagagacggggtttcactacgttggccaggctggtctcaaactcctgaccttgtgatctgcctgcctcggcctcccaaagttctgggattacaggcgtgagccaccgcgcccggccctgctgggtggttctgcaaagtgtttctctttggaccagctccaggccccagactctggggagggcccaccccactcagctgtgcccagggcctgtgggtgtctggctgagccgagtggaaagcgtggtgccagcggggacctgcggtttgggaaacaggcccagagaggagtgtggaggctgggcttggctctgcagtgccctcgtccagagaagcattgagtaatcgcggaaactcagcaccacagatcccgcccccctccctcagaccctgccaggacagccacagcttcctccaggcctggggaggggcaggcggagggcaagcggagctgggattaccccaggggctgttgcgggaattgggagagagttccgggctaaatcttagcacatgtcaggctctgctggcccagaggtgggaaaggaatcccagcaacacatgagctggtcccacatcagagactgtggatgatgatgtttgagtttcagtttttgggtcaaggcctgagccagagaagaaggaaccactgtggttccttttatgtttctggggcttcttggaaaaagatacaggtttcattttagccagggctggagaaagctatggccagagctgggcgcactgaggctctggatgggcccgtctggtgtattctggactcagtcacccatgttgctgcccgtgatgagggcaactggaacttccgcatttagcttcaggcagccagaacctacccatccttcccagtgagcagccagggccagccccaggactcggctgtagtggcccctgaggccataatgagctgcacaggtgcctgaccctggctgggggaactgacttcgtgttgaatgccaaggcttgtgagcacccaactgtctgcccactgacctgcttcccacgaggtatggcctttccctgaaacacccagcagaaaccctggtacctgtcccctgaagcaggaagatgagcccttctgggacaggctgaccctgcctcagagtctcagtcccaccagcaacctccccccggccattcccacaccctcgcccaccaggccacctgcggcttccaggacttacacggcagcgtacaggcccccgacagcggagtggatgaatcctcgcacgattgtgtgcaggatgaaggagaggatctgggggaggaaaaggcgactgtgggcataaggccttaagggaccgtcccctcagcccccgccctccaattcctgggggccctcaccccaggggcagtgtcagcctggagttggatcaaccccatcctccggagccaattgtgaattttcagaaattttgcaagccagtcgttaacacagtcattttttgtttgtttgtttgttttgttttttgttttgtttgagaagaagtcttgctttgtcgcccaggctggagtgcagtggcgtgatcttggctcactgcaagcttcgcctcctggattcaagcaattctcctgcctcagccttcggagtagctaggattacaggcccacgccaccatgcccggctaatttttgtattttttaagcagagatggggtttcaccatgttggcccggctggtctcaaactcatgacgttgtgatccacccgcctcagcctcccaaaatgatgggattacaggcatgagccactgcgcccagcctaaccgagtcattattaaaaattaaattataggctgggcaaggtggctcacgcccgtaatcccagtgctttgggaggccgaggaggtggatcacctgaggtcaggagttcgaaaccagcctggccaacatggcgaaaccctgtctttactaaaaatacaaaaaattagctgggcgtggtggtgggcacctgtaatctcagctgcttgggaagttgaggcaggagaatcgcttgaaccaagaggtggaggttgcagtgagctgagatcacggcattgcactccagcctggtgacaaagtgagactctgtctcaaaaaaaaaaaataataataataataataattaaattataagccgagaatggtggctcacacctgtagtcccagcactttgggaggctgaggtgggtggatcatatgaggtcaggagtttgagatcagcctggccaacacagtgaaaccccatctttactaaaaatacaaaaattagccgggtgtggtggcgggcgcctgtattcccagctactcaggagggtgaggcaggagaatcgcttgaaccggggaggcggaggttgcggtgagccgagatagcaccactgcactccagcctgggtgacagagctagactctgtctcaaaaaaaaaaaaattacataaatttatgactaaataaataaattatattaaagtaaaggtaatgaatactcaaaactctgaaaactcatcacttcctggcctggtgcagtggctcacacctgtaatccccacactctgggaggcctgggaggatcacttgagcccaggagttccagaccagcctgggcaacatgtcaagaccccatctctgcaaaaaaatataaaaattaactgggcttggtggtacgtgcccgtagtcccagctactcaggaggctgaggtgggaggatcacctgagctcgggaagtcaaggctgcagtgagccaagatcccaccactgcactcgagcctggctgatgggagtgagaccctgtctcaaaaaaaaacaaaatgaacgaacaaaaccatggaaaacctcatcccttcctaattattttacttggttcactagagcctgtgcacgcatcaggctttcctttttttttttttggagacagagtcttgctgtgtagcccaggctggaatgcagtggcacggctcactgcaagctccgcctcctggattcaagcaattctcctgcctcagcctccctagtagctgggattacaggtgcatgccaccaagcccggctaatttttgtattttttgtagagacggggtttcactaggctggtctcgaactcctgacctcaggtgatccacccgcgttggcctcccaaagtgctgggattacaggcgtgagccaccgtgcccggccaggcttttcacatctactgtagaaataccacgtgtcactgtgactctccagttccacagtcagtggcaacacatgggcagctggaaatcagccacggtgagtgcatgtgcaccgtggaagtcggcaaacactagaaccagggccctgctgacagacgtgtatgggcacagcactgagcaagaggttgctgaccacggcctcgagctgcctttgcccacctcggactgtgctccagggtctcccaagcctggtcacccggccctcccagcaggtggctgccctctcacctccctcgtgaagtgtttcttcgctttttgttttgttttctttttgtggtttgttctgttttgtttggttttgttttgggacggtctcgctctacaccccaggctggagtgcagtggtgtggtctcggctcactgcaacctctgtctcctgggttcaagcgattgttctccctcagcctcctgagtagctgggattacaggcatgtgccaccaggcccggctaatttttttttttttttttttgagacaaggtctcactccggttgcccaggctggagtgcactggtgcaatctcagttcactgcagcctcaacttcccggggtgcagtgagccgagattctcccacctcagcctcctgagtagctgggactacaggtgcactccacaacacctggctaatttttatttttagtagagacagggtgtcgccatattgcccaggctggtcctagtaaagttctgtcgctgtctgtgggaggccccctgcccaggaaggctgctgctggcggactccgccaactccgagaggcactttttaagagccatcctcttggccaccaggtccctgtggtcgccttgtcttctgtacacagccctgccatcccgctcagcagccaggacctgttcccaggaatgtgggtggtgggggggcaggggctgctcttggcagtgttgaaagagggctgtgcccagtgcccacacacacacacacacacgcacgctgtgcaggcctccccacctcaaatgccttgttgcctttttacaacttttctttcagtgagacctacataaaacaaaaagatgactgtccccactgagcactgcccctcgactggacaaggcggttagggcaaaggtctgccagtcttgcagagaaagcagcccaggaggccagggagggccggagggatgcagcaccccctggggccggcacaaatgttccacggcccgctgcgctctgcacgcccagtgttggcacgtacacacaacagttcccacggtggggcacacctgggtgttcaacgtacctcaaggcctcctgtaaaaagggagggactcttacttccctcctggacttgacccaagatgccatctggactcaggctacacctctctggaaggaaaagccacacttgcgtccctccaccatttgtaaatttagggattgggccaaaacctactgctagaccactttcacagaccagtgggtggagccaggcaggtgacaagggccaccttactcaaaatctctgtcaaaaatcaggttccagaagcctcaaaagtttggcaaagaaattcagtttttttttttttttttgagacacagcctcactctgtcgcccaggctggagtgcagtggcgcaatctcggctcactgcaacctctgccacccggattcaagcaattctcctgcctcagccctcctgagtagctgggattacaggcatgtgccaccacgcccagctaatttttgtaattttagtagagacggggtttcaccattttggataggctagtctcaaactcctgacctcgtgatccacctgcctcagcctcccaaagtgttttggttttttttggtttttttttctgagacagagtctcactctgtcatccaggctggagtgcagtggcgcgatctcagttcactgcaacctccgcctcccaggttcaaatgattctcctgcctcagcctcccgagtagctgggattacaggagtgtgccaccatgcccagctaacttttatattttctgtagagacagggtttcaccaagtcgcccaggctggtctcaaactcctgagctcaagcaatccacctgcctccacctaccaaagtgttgagattacaggcatgagccaccggcctggaatgaagcttttgaatccagatatgaagccaccatcaaggtcttcctccactctgttcagtgtagaaaccccgtgagactctggtgacaggggagcagatgctcccaccaacaccacagattggccagatctctttggacgtcagattccagctgcttgagccgatacaaaacaaggaactctacagcgaccccacacacttccgggaaatggcatgatggtggtatccacggttatgcaagacgcccccaaaaccaagacatgccttccggggaggagtccctttgcagaagacaatccaggtgtccagctcacctgcagcagcaagcacagagcctggcagggaacaggccctccgcaaataacaaagggctggtgggctgctcggttgagtggaatgaatgaaagtcatcatctgagctgggcacggtgcctcacacctgtaaaatcccagcactttgggaggccaaggcgggtggatcgcctgaggtcaggagttcgagactagcctggccaacatggcaaaaccccatctctactgaaaatacaaaaattagctgggcgtgatggtgcgcacctgtaatcccagctactcgggaggctgaggcaggagaatcgcttgaacccaggaggctgaggttgcagtgagccgagatcacaccactgcactccagcctgagcaacagagtttgactctgtctcaaaaaaataaagaaagtcatccgctttgttgatggcttccatgaaacattacacacttttgagtctttacatgttccttctgactgccccacctcccacctgcccctcccactccccacacccacctggagaggcaggttgggaatgaggcaggtcaccccaaagcccacgagcagcaggttggtgaaggcgaaggcccgcatggcattagtgatcttctggatctgccggtcccgcttcttctttttcttctcgcctctgtggagacacagaacgtgcaggggtgggagggctccccggaggaagccgggtgctcctgagaagtcaggcctcaagcgtcgcagcaggtaaactgacgcaagactcagaagccacccaggcacgttttagggactgtgtcggggctggaccagcactacggacactccccggcccttctcagtggcaagctgagtgtgactctcggagggggtctcgggtacaagaagatggccatccatatgctgcagtgctctgtgaaggctgagctaagacgacggggagagaagtagcagcgtgtgcctgagctggcacatggcaaagcctcacttcaccactggcttcaagttcacccaaatcttgcaggacgctgataagaagccagatacaagccaaataggggagtgaatgggtttccccttgtggggacaggagagggtaaaggggaaatgagcaggcagcagatggaactggagtggacacaaataacctcttggctgcaggacctgacctagatagcacagcactgttttttgttttgttttgttttgtttttttgttctttgggtttttttttgagatggagtctcgctctgtcacccgggctggagtgcagtggtgtgatctcggctcattgccacctctgcctcctgggttcaagcgattctcctgcctcagcctcccgagtagctgggactacaggcacgcgccaccttacccggctaatttttgcgtttttgtagagacagggtttcaccatgttagccaggatggtctcgatcttctgaccttgtgatccacccgccttggcctcccaaagtgctgggattacaggtgtgagccaccgcgcccggccaagcaccctctgcaattatctctcgtgaatgaacgattaccgatcccagtctcacacccacgcagacaccctggatgatccaagaacggaccccaggtgctcacagatgtgcagggagtcccaggcccaccacttcctaactgtgcggccctaggcaaactactgcaagtcccagcctcagctccctcatctgtaaaatgggtataacactggtccccacttcgccagggtgctgggagtcttcactgagatactgtgcatggagtcctcggtggagggcctcaggcaataaaccgtagcttattatattaaggtgtggagccatggaaaacagcgtttggctgggcgtggtggcttatgcctgtaatcccagcactctgggaggccgaggcaagcggatcacaagatcaggagatcaagaccatcttgtctaacactgtgaaacccctgtctctactaaaaatatatattaaaaaaattagccgggcgtggtggcgggcgcctgtagtcccagatacttggaagcctgaggcaggagaatggtgtgaacccgggaggcggaggttgcagtgagccgagatagagccactgcactccagcctgggcgacagagcgagactccgtctcaaaaaaaaaaaagaaaaagaaaaaagaaaacagcgtttaactcatcctctgatcttggagcccatcccttacataaagtaggactccagtaccttgtttaatcttcacaatcatgaacaactctattaacacataatatgtttatagcaactcactactcaaactgaccggaataaaccttgcaggcagataacaaagggttggtgggctgcatgattgaatgcaatgaatgaaagtcaccatctgagccgggcgcggtgcctcatacctgttaatcccagtactttgggaggctttaagatggtgtagccactgccaaggggtggagggagggtggtcttaggagcaaaatggtctgctagccattgtctgtacactttcacctgtgtctctttttcttccttcttactcaatgcttcttctttattgttttttctttttgagacagtcttgctctgttgcccaggctggaagtgcaatggcgtgatctcggctcactgcaacctccacctcccgggttcaagcaattctcgcgcctcagcctcctgagtagctgggattacaggcgcgcgccgccaccgcacctggctaattttttgtatttttagtagagaccgggttttaccacattggccaggctggtcactaactcctgggctcaagcaattcactcacctcaaccttccaaagtgttggtattataggcatgaaccaccctccctggccaatttttaaattttttgtagagacggggagtgggggctggccatgtttcccaggctggtctccaactcctggcctcaagtgatcttcctaccccagcctttcaaagtgctgggattacaggcatgagtcaccgcacctggcctcaaactttagcatttccattgcattccaaacaatttccataaagaggggagcagttgaaacgcatgctgagctgaatgagtgagtctctctaagggctccgggagcagctggagtgcattgctctctccctctgtcccacccaccctgtgcctgacatgcagctctggggtctttctgcaggggctgcgggctgggagccggggcaccggccctgcctacgcactggttggcgtctttctcctcgggctcctcggaggcgtcttcacactccttcagcctccagtccatgatgtagccaatgacgggggccgtcagcaggcacagcagctggagcacgccgaagatggaggtgtagaggccaactgtggaggaaggcgctgcgtcatggggacgcctggcagacagccctggagcagggactgggcaccagctgggaaggggctggtccccacaggctcttctggggtctgccccagaaccccctgtcactatgggtcttgcgaggagcccggagaccttaactctgaagttgaggatggagcacggggcaggtcaccttcttctcggttccaaatcccctgcttgtttctaagaaacagctaatgaaacccagagtgtcacaatggccttcccagagctccaggaagtcgctataacttgggaactcctgtgacggaggctaagtgacgggccgttagtttctgtctctagaaatagcccagaacggctgggcgcggtggctcatgcctgtaatcccagcactttgggagcccgaggtgggcggatcacgaggtcaggagttcgagaccagactgaccaacacagtgaaaccccgtctctactaaaaatacaaaaactagctgggcgtggtggcaggcacctgtaaccccagctactcaggaggctacaaggagaatcacttgaacccgggaggtgaaggttgcagtgagccaagatcatgcctctgcactccaccctgggcaacagagcaagactccatctcaaaaaaaaaagaaatatcccagaaaggcaccgctcacggggctctgatgtcagggcttccatattcaaagacttaaaatgacagtggattttccagggaagcagacgaggaatgttgattgccccagttttacccccacggctctagccaggaggcatgtctggagcttgaggtgaggagcttctgggttgaacagagactggctgggaggggacatcacagcattccctgacaatcccccccaccccccgcttacccgtggccatcactgcatcaagaaagcaaaagtgaaaaagcagaaagaagagaggttagtggcagaaatctcagtgctacagagagatgggagaggaggcaggctcactccatgcccagcacgcactgcatttcccacactgcgtttcccgcactgcatttcccactaagcgtgactcggggcgctcaggggaggcagagctgcagccaggcctctggaagtggacttgggacaatgcccagcccgggcccctgctgacattctcctgtctgctggtgccgggtcacaggcggactggtgaatcaggcctgtgacgttggcgggtagcgtgatggggaagtggcgggcatgcggaagacctggtgcaatcagggtccctgtcaccacactgcctgcgggaagcggctctgtcacatctacctcctgctgtgctcagagagagggaaaggtcaaagaacctgcccctgatgcccagccaaggcatctgacaccatgggtctcctccagatggccagagctggtctcccttccactccaagaaacggggaccatgcctgggcctgctccccttccttgggccatggcccccctgccacagaggcctggtggcccctgagctgctgctccgagtggaatgtcctggtctagaggcccttggctgctccagtgtcttaagacccatatgtgagtgctggctctgaccttgaacaagctcctccatcactccaggcctcgtttttcaggtgtatatgatgatagtatctatcataaatgatgacgtaaacagatgatagtatctatttaactcctagattgttatcaagtcaaggacaacaataggaaaacatgtcacctgtcaactcttacaaagggagggtaggacaggtggcccctgactagggggtgggggtgcagggggcacccgacccatctggccagccacagcctctgtaccctgctcccattttcaggcctcaatccccaagcactgttggccctggactgttttccccccttaattctgtttctcaatgcctgcttcttcccagtaagtgccacaccctgagggtgggtgggagagtgaggcagcagtgcccactttggctgggactgggcactgctgaggacagcatgggccacgtcttccccatctcaagactggctttttggctgggcatcgtggctcacgcctgtaatctcagcactttgggaggctgaggcacgtggatcacttgaagtcaggagttggagacatggtgaaactccgtctctactaaaaatacaaaaattagctgggcatggtggcaggtgcctgtaaccccagctacttgggaggctgaggcagaacaatcgcttgaacccgagaggcggaggttgcagtgagccgagctcatgccactgtgctccagcccgggtgacaagagcgaaaatccatgtcaaaaaaaaaagactgtatttttggctgggcattgtggctcatgcctataatctcagcactttgggaggctgaggtgggagaactgcttgagcccaggagtttgagaccagcctgggaaaaatagcaagaccttgtctttatggaaaaaaaaaaaaaacaaattagccaggcatggtggcacacacctgtagtcccagatacttaggaggccgaggtgggaggatcccttgagctcaggagtcggaggccgtggtgagctatcagttgcaccactgcactccagcctgggtggcagagcaagaccccaactcaaaaaaaaaaaaaaaaaaaaaaaggcggccttttcccagctgccagcaccctggctagttagggtttccctgaatccgcaactcctgtttgatggcgggtctcaaacgctgggaggcagcagagtcaccggtcagcggcaaggcctggagtctccattcggaaccagcacccgggagcctctgccgcgggtggtcgcggggccgtacgcggaggcgatggctctggtgctttgagccgttcctcagcagcacggcacaccccctcctgcggagccgcaaagctcacgagtgtgcggaaagtgacccggaccctgcagctgcctctcggccggagctagggctatgggtgttgggtgtaacgggtcacagaaggaggagggggaaaaccagtgcctcgtctgccacagaccaaccttcctggcctggcttcctctacttcttgaaattgactttttgaacatacgaaacagttggaaacattcctcctgggcagcaaaagatttctcagacagcttgagtaaaagacgctgactcagcagcagggagatgagcctttcgagggccagggaccagctctctctgcacactttggggtttccgccactccagggctgaatgtttatcaggctgggtgtggaggtttacgcctgtaatcccagcactttgggaggccaagaggggaggatcccttgagcccaggagttcgacaccaacctgggcaacacagcaagaccctatctctgcaaagaatttaaaaattagctgggtgtggtggcgcgcacctggggagccctaagaggtcaaggctgcagcgttcacatcactgcactccagcctaagcaacgcagaaagagaccctgcctcaaaaaaacaagaaagaaagagacatgatagattagggttccccaaagtgtgttccacagatatttttttttcttttgagatggagtcgcactctgtcgcccaggctggagtgcagtggcgcaatctcggctcactgcaacctccacctcctgggttcaagcaattctctgcttcagccttccaagtagcagggattacaggggcccaccaccacgcctggctaattttttgtatttttagtagagatgggggtttcacaatcttggccaggctggtcttgaactcctgacctcatgatccacctgcctcagcctccaaaagggctaggattacaggcgtgagccaccgtgcctggcctagactaccattttcacagtagaactggctgttatctggttccctttgctatcttttccttttgataaagctggatttctcatcccctaaaaacctgataactgattcttcacaagtcctagggtatcttcaccttgataaaaacaaggaaaccatcggaaaaagtggcacaccagggaggctgccaataaaaaggatttggagtgtttgtcccgcctggggatgactaaggctgactcagctcaggccccggggaagtcctgactttctctgtagaatcaaaacctctaatcagctgaagacctgccctgtttggaaaagtggactgtgggttatcagctgtgtttgttggagctgacaagcctcaactgttcgcaagctccgaggaagtctctgccctgccctgtttctcggtgagggatgcagatcccagtgtgggccagttgccccagcgtctccagccccgtcctgacctcgatgcccagggtgtccacgcacccaccgtgccactttctgggaggactttgggcttgacctgctgtctttcagccatgctcaggtggagcgttctgttctgttttcatttacagacacacacggcaaccctccccctcaggcactggaaaacacacaccccacaccccacacccaggaggctattttggtccttccctccctcctggaccaggaaaccctgatggggacacgaagaaacagttggggctggcagtgatgcaatagctctgacgggcagacagctcctgggatgcggcctttccatggcccggctggcccggctcagcttaacacattctggccggtggccagtgggctgggctcaggccggggagtgacagcgaccgaggctgcccggggcacctacctgtcttctggtcgccgctgaccaggaacttgaggatgttgttcatagcccccatgtagaagatgagccgcagctgcgtgacgcacatggtgaccaggctgagcagcaggatggggctgaacacgctgtgcatgaaggagggggccactgcagggagagggtgcggggctcagggccggggcacactgtccccaccaccggggggacacgcagatccctccacgctggaggccaggagggggccctcgggacgggcctggtgagggtaacggggttggcgctgcggtggggtcacctcttgggtgaaatcaggcaaatccctttccctcccccaggccttcctgagcgcctctgcagaacagggcgggcggggccgcctccccttttggggtgaggtgggaatggggtgagccgatacccacagagcactccctgcccgtcgcccggctgcggtctcaggcgggtacctgcggcatccggctggcacttcacctccaggtcgacggtggacaggcacagcttgtggccctcctgcagcgccacctgctccttggcactcctcatggagctgcccacactcaggcgccggcccaccgtggtcacctgcttgtagaactgcttccctgtgatcttgtggtcaaagcccagccagctgaacttgatcttcaccctggggccccgggagagtgtctgtgggtgctgcccgggaccccggctggggggcgggggctgggggcaggcgggacgggggcacctctacttacgagtagtccatgtcctccggccccgggaagggctcaaggggccagttaaagaagcagttgaggaaaaccagcccggagcagccggcccagaccacgaggacgacgatgaaggagacaccagcatcatagatgagctgacaggcaccgcggggacggggtgggggggggagggggcagagttagcccggggaggccagagccgcagcaggcaggggcgtctggccacccctgctgtccctgtgctgagccgcgcaaagaggcacagccctgccagcctgggcgttggggcatcaggcacccgccttccagtcctcccaccgtgcctgccctgctggtcatctgggcctggcgtgtgattagccccccgactcggaggccttcctgaccgccccgccatgaccacggcacgtcttgcaggctcatagtgatcggcccagcagaggggacggtgctcctggtccgtcggcttgtctggtattagcggagctccctgaaggcgggaaccggccagccccgtccactgatgcttccccagtgcctctgagagctcacatggcagaggccaaagaaatgctcaaggaagccaggcatggtggctcacgcctgtaatcccagcactttgggaggccaaagtgggcggatcatgaggtcaggagttccaggccagcctgaccaacatggtgaaaccccatctctactaaaaatacaaaaattagccgggcatggtggcgggcacctgtaatcctagctccttgggaggctgaggcaggagaatcacttgaacctgggaggtggaggttgcagtgagccgagatcgtgctgctgcactccaacctgggcgacagagcaagaccctgttcccccccaaaaaaaggaggaggaagaactttcgggatgctccccagtccaggggcatgagaatctctgcaagtccataggatggctggccccagagtcccagctcccaccacttcaatgcccaggtggccagcccacaccgtgtccccctctcctcgccaacagcattcccacacacaccaccgaggaaaggggcttttacttagtgtgagggtcagaggtgggagaagcccctacggggccctggcagacccacagggtctggggaacttgggctgatggactgtgaggtgtttgcttcgtcctgaccctgtgtgacttccacaggctcaaaatcctgcctaggagggaaacagctgaaacacttggccaagagcagtgctttggctggcggggagtaacggtacaataacagcaggctgggggttggggagcaggggagcagcgggagaccaggatgacggaggagacgggggcaagactcacaactggaaacagactcacccaccgcccttcccctgccccagccccgaaatgcaaaggcacctgcggcagatcctgcagccacatgcgtgattcccgtcccctgaggccccgcggttttcatttgtcgcccctgtgatgcccaggtgcatcctgcccgggtgggggtggtggagaggggccaccccgggtgcccacaattgcctccctcttcagagagggtggaaggagcctggagcaggcctctgcacagacaccagtgcaaaatacacgtgctcaccttgattcctggaaaggtgactgccgaggaggcgtaggacccaatcatcaaggcaataaacgtggaccgaaggtcgccgaacatgttgggcagctgagagataagaagcagagaaacctcagtggggaggatgcaccagggaaggggaggaggaggggacagagaactaggccccatgaggccccttcttcacctgcgccccttcctgtgtgactcacaggggcattagttcaggggcaatgaccgctcactgaaggtttctccttcatggactgaggctgatggggccaaggagggaggtaatgcagaatacaagcagttgtctgactttccggctggcaaccctccctatctctctgctcctggcagagcccaggagccttcttgtcttttcagggtaacactgagatgccagagaacaaagttatgagcctcaggcagccctcaaagggagaaagcctgttaaaaataagaatctatttggggataatagcatcattttataaataaaaatatcagcattccagaaagaccagatgtcagcaaaaactgcttttggtttggagagggtaggtttttggaagatgtcaatcagaattctacagttctcttcggtctgaggatgaagctggcccaggattcctgcttctgaatttcttttctttgttttgagatggggttttgctcttgttccccaggctggagcgcagtggtgtgagctcggctcgttgcaacctccgcctccctggttcaagtgattctcctgcctcagcctcccaagtcgcgagattagagatgcccgccaccatgcctggctaatttttgtatttttagtagagacggggtttcaccatgttggccaggctgatctcaagtgatccgcccgcctcggcctcccaaagtgctgggactacaggcgtgagccaccgcgcccggcctcctgcttctgaatttctcagtacaagcaggggattatcttcccacaggatgttcggcccgagcagttagcatcctggaaggccaacgggaagcaaggtccgggctctcttcccaacgaagccactctcggcatctcacatcagctcattctgggtacagggcaagagggggcccacctgaacaggacttcaaggctaactcttgctcattctaccgaaatccaggcctagggcaaactacatcctcccaaagaggcacaggttctctaacctcaagagacatcacactgtgtgtagcaaacctttcctgtccacacccagcgtccctggccttgggggctgccctctggatagccatgccaacctatttcattaaattcaggctgcttatggggacttaatctatgtcccctccaccctccccaccactccccatttgtcttgaatctttttctttctttctttctttttttttttttttgagacggagtctcgctctttcgcccaggctgtactgcagtggctctatctcggctcactgcaagctccgcctcccaggttcacgccattctcctgcctcagcctcccgtgtagctgggactataggcgcccgccaccacacccggctaatttttttgtattttcagtagagacggggtttcaccacgttagccaggatggtctggatctcctgacctcgtgatccgcccgccttggcctcccaaagtgctgggattacaggcgtgagccaccgcgcccaacctttttttcttgttttaagagacaggatctgctggacgcagtggctcacgcctgcaatcccagagtgctgcctttgacctcagagtttaagaccagcctggacaacatggcgaaaccctgcctctgtatctttttaaagttaaaaaaaagagagagagacaaggggggcagatcacctgaggtcaggaattcgagatcagcctggcaaacatggcgaaaccctgtctctactaaaaatacaaaaattagccggatgtggtggcaggcgcctataatcccagctacttgggaggctgaggcaggaaaatggcttgaacccgggaggcggagcttgcagtgagccgacactgcgccactgcactccagcctgggtgacagagcgagactctgtgtcaaaaaaaaaaaaagagagagagagacagggtctcattctgttgcccaggtgggagtgcagtaatgcaatcatagctcactgcagcctccaacttggctcaagtgatcttccccccccagctcccaagtcactgggacaacaggcccacgccaccatgccccagctagtggttttttttttggaggcagggtatcgctctgtcacccaggctggaatgcactgacatgcaatcttggctctctgcaacctccacctcccaagttcaagcgagtctcctgcctcagcgtcctgtgtggctgggaccacaggtgtgcaccaccatgcccggctaatttttgtattgttagtagagatagggtttcaccatgctgccaggctggtcttgaactcctgacctcaagcgatccatctatcttggcctcccaaagtgctgggattacaggcatcagccatcacgcccggcctttaattatttttgtagagatggggtctcactatattgcccaggctagacttgaactcctggcctcaagctcttctcccaccttggcctcccaaaataaataatttttgttttatcaaacctgcctgcctgcaagcaaattaactgttactgagcggagggagtttgaacttggcgacatacctgtctgcagtcactgctgcctgttttgcccacttttaaaaatgagtaagggatgtcagcaaaatttaaaacctctgtgcttcaaaggatggcatcaagaaagtgaaaagagagccgggcgcggtggctcacacctgtcatccccgcactttgggaggccgaggcaggcagatcacgaggtcagcagttcaacaccagcctggccaacatggggaaaccctatctctactaaaaatacaaaaaattagccgggcgtggtggtggacgcctgtaatcccagctactcgggaggctgagacaggagaatcccttgaaccgggagatggaggttgcagtgagctgacattgatccactgcactctagcctgggcaagagtgcgagactccatctcaaaaaaaaaagaaagtgaaaacaggctgggagtggtggctcgtgcctgtcatcccagcactttggaaggctggggcagcgggattacttgagggcaggagttcaagaaagtgaaaagaatgcacagaatgggagaaacttcttacaaatcacagatcaagagcttgcatctagaatatataaacatagtgcccaacagttattcaaaaaacaaaaaatagaacatataaagaacccctacatctcaataataaaaagataaataaccaatttttttttttagatggagtctcgctctgtctcccaggctggagtgcagtggtgcgatctcggcccactccaacctctgtctcctgggttcatgccattctcccacctcagcctcccgagcggcacctcccattgcaggtatgtgccaccacgcccagctattttttgaaataaccaattttttaaatgggcaaaggatctgaatagacatttctccaaagaagatatacaaatggccaataagcatatggaaagatgctcaacatcattaatcatagtgaaattcaaatcaaagccacaatgagataccacttgatacccattaggacaccaaaaagtcacagtgaggccaggcgcggtggctcacgcctgtcatcccagcactttgggaggccgaagcgggcggatcacgaggtcaggagttccagaccagcctagggaacatagtgagaccccgtctctaccaaaaatacaaaaacttagcgaggtatggtggaacatgcctgtaatcccagctactcgggaggctgaggcaggagaatcacttgaacccaggcgggggttgcagtgagccgagatcgtgccactgcactccagcctgcgcaacagagcaagactacgttttaaaaaaaagaggctgggcacggtggctcacgcctgtaatcccagcactttgggaggccgaggtgggcagatcacaagatcaggagttcaagaccagcctggcgaacatggtgaaaccccgtccctgctaaaaaaatgcaaaaattagccaggcatggtgacgtgcacctgtaatcccagctacttgggaggctgaggcaggagaattgcttgaacccgggtggtggaggttgcagtgagccaagattgtgccactgcactccagcctgggcgacagagcaagactcaaaaaaaaaaaagaaatgaggccgggcgaggtggctcacgcctgtaatcccagcactttgggaggccaaggtgggcggatcacctgaggtcaggagttcgagaccagcctggccaaaatggtgaaaccccatctctacaaaaatgcaaaaattagctgggcataatggcgggcacctgtaatcccagctactcaggaggctgagacaggagaatcacttgaacttgggaggcagagcttgcagtgagtcaagatatcgccactgccctccaccctgggcgacagagtgagactccgtctcaaaaagaaaaaaaaaagaaaaaagaaaaagaaaagaaaagaaatcccttccaacagaagacaaaagaaatgtgatgtgctcacacgtgcccaggcacgcccaggtgagcaatcttactctctgggtacctgcctcccaggtaggttgcagttcaaaggacaagcctcggttcccaagctcacatatttgggctgctccattactgcactgtagcaaaggcatctccgtggccatatctaccccagtgagaatgcaaatatttgttctgcttatgcggaaggagggaagtgttcctgcccggcatgccagcacagccggcgcaaagaaagaaagaaagaaaggggccaggcgcggtggctcacgcctgtaatcccaacgctttgggaggccgaggcaggtggaccatgaggtcaggagcttgagaccagcttggccaacacagtgaaaccttgtctctactagaaatacaaaaattagctgggcgtggtggtgggtgcctgtagtcccagctactggggaagaggctgaggcagaattgcttgaatccaggaggcagaggttgcagtgagccgagatcatgccactgcactccagcctgggtgacagaacgagactctgtctcaaaaaaaaaaaaaagggaggcccagagaaggcttggaacccaaccagaagggcaaatggaagcccagagcctggctcccttggtgcagggtcaggtgaggctaacatgtaggttgctgcagtcacctttgggtaaaaagagtgtctcaaacttttcaacagagctagagaatgttccggaaaagcagagagcttgctagctaggcattttccttctacctttttaatctcaagcctgcctgccttaaccctaacctaggctacagaccaacagagccacagggccctggggtgaccatgtggccctgcctggtcttctggagtcttctccccagcactagatccaggatggggaagagcagaacctggggaagaggccgactctccatctgtccatggatgaggccttgccctcaggcctggacagggcaggggcctcccagctgctccctttgatgccctgcctcttgccgcctggaacattcttaccagcaccaagaaaattcttcccaacatgttattctggtcagcagggccattccttagggagtagagtgcctcaggggaaccacactaggtagccttcaaaccaacactgacatcttgtatttttaattatgatcttttccttagaacggcaatgcctgggctgggcgcggtggctcacgcctgtaatcgcaacactttgggaggctgaggtgggcggatcacgagatcgagaccatcctggccaacatggtgaaaccccatctctattaaaaataccaaaaattagccgggtgtggcggcgtgcacctgtagtcccaggtacttgggaggctgaagcaggaggattgcttgaacccagggggcagaggttgcaatgagccaagatcatgccactgcactccagcctggcgacagagtgagactctgtctcaaaaaaagaaaagaaaagcatatccattgcaaaatgtttggagcaaagtataaaaagaataaggtaaaaatcaccctgaggccagacgcagtggctcacatctataatcccagcactttaggaggctgaggcaggtggatcacttgaggccagcagttcaagaccagcctggccaacatggtgaaaccctgtctctaccaaaaataaagaaaattagctgggcgtggtggcaggcacctgtagtcccagctacttgggaggctgaagcagcagaatcgcttgaacttgggagatagaggttgcagtgagcagagactgagccactgcactccagcctgggcaacacagttagactccgtctcaaaaaaacaaaaaacttttactaatgactttcaacatttttctacaacttaaaaaattatttggccaggcgcggtggctcacgcctgtaatcccagcactttgggaagctgaggcgggtggatcatgaggtcaggagatcgagaccatcctcgctaacacagtgaaaccccgtctctactaaaaatacaaaaaattagctgggcgtggtggcgggcgcctgtagtcccagctactcgggaggctgagacgggagaatggcgtgaacctgggaggcagagcttgcagtgagctgagattgcgccactgcactccagcctgggtgacagagcaagactccgtctcaaaaaaaaaaaaatcatttatatttgtcctttttttctatggggatgttaatctttcttttttttttttacagtaagctatatattaattgaatatatatatatatatattttttttttttttttgagacggagtctggctctgtcacccaggctggagtgcagtagtgctatctcggctcactgcaacctccacctcccgggtccaagcaattctcctgcctcagcctcccgagtagccagggttacaggtgcctgccacgacgcctggctaatttttgtatttttagtagagacggggtttagccatgttggccaggctggtctcaaactcttgacctcaagtgatccgcccgcctcagcctcccaaaatgctgggattacaggtatgagccaccgcgcccttccaatatttcatttaacataatttcaaagtaggtctgtgctctaaggtgagcaaaagaagagacattctaaatctcataagagatttttttttctttcctctttttttttttttttttttttggagacatggtctcgctctgtcatccaggctggagtgcaatggtacgattctggctcactgcaacctctgcctcccaggttcaaatgattctcctgcctcagcctcccgagcagctgggatggattatagccacctgctatgacatccaggtaatttttgtatttttagtagagacagggtttcaccatgttggtcaggctggtctcaaactcctgacctcaagcgatctgcccacctcagcctctcaaagtgttgggatgacaggcgtgaaccattgcgcccagacttttttttttttttccacactgttcctctgagtgaggaatcaggtttcaggaccctcaatgttgacaactaacattttacccttgagattttacctagagataccgaaagaaaagataacatctgaatacaagaatcgcgttgcatatttgctgcctccatagggttgttgtggtagcgactgattttccacccctcccagtttggtggtgtttgtttgtttgtttgtttgtttgttttaagtaaaatgtcagaaatgcaaaaatgctgcatttatttcccttaagacattgaaaatagtggaagtttgcagatttttaattcttcgtaggtctgagctggcactagactgctaccaaaggggtctgttccacacgctaatttcaggcttgcggaccatcagcaaactgcaatgaaacctgtgggcatgaatcttccagagtggtagaatctcattcccatatgcccgccaagtttccaggtgtagctgggaaaacccaaatgttccctggatcccgagatggctaataagcactcaggcctgctacaccaccgaacagagccccacagccagagaggcacacggcctgcttcacacagccgacaaccccgctggaaacaaccagtgctgggagccaaggccaaactgatgcaaaggcgctactgagccagagcccttctgcaccgagactaccccaggcatgcaccgccctcccaaaggtccaaaacgatgcaaaggcgctactgagccagagtcgtgcactgagactaccccaggcatgcaccgccctcccgaaggtccaaaccaatgcaaaggcgctactgagccagagtcctgcattgagactaccccagacatgtactgccctcccgaaggtccaaaccaatgcaaaggtgctattgagccagagtcctgcactgagactaccccaggcgtgtaccaccctccggaaggtccaaaccgatgcaaagccactattgagccagagtccttctgcaccgccctcccgaaggtccaaactgatgcaaaggtgctactgagccagagtccttctgcaccgagactaccccaggcatgcactgccttcccgaaggtcccaaccaatgcaaaggcactattgagccagagtcctgcactgagactaccccagacgtgtaccgccctcccgaaggtccaaaccaatgcaaaggcgctattgagccagagtcctgcactgtgactaccccaggtgtgcgccgccctcctgaaggtgcgtgtgggtcgacaagggtgcacaagcggcagggggctgcatagcaaggtctccttcagctttgttttaattatttttatagagacagggtctcactctattgcccaggctggtcttgaactcctggattccagcgatccttccaccttggcttcccaaactgcaatgattacaggcatgagccactgcacccggccaatctttgtatattgattttgtgaaggctctttatgtattaaagacattcattcacaggccgggcacggtggctcacacctgtaatcccagcactttcagaggccgaggcaagcggatcacctgaggtcaggggtttgagaccagcctggccaacatagtgaaacctcgtctttactaaaaatacaaaaattagccggacatggtggcaggcacctgtaatcctagctacttgggaagctgaggcagaaaaatcgcttgaaccccagaggcagaggttgcaatgagccgagattgtgccactgcactccagcctgggcgacagagcgagactcttgtctcaaaaattaataaaaataaaataaaatgaagacattcacagttctatatactatgaataaattttcctagtttgtcatttaacttcttaattcatggtgttttgttttttcagtttttttttttttttttgagatggagtttcgctcttattgcccaggctggagtgcaatggtgcaatctcggctcaccgcaacctccacctcccgggttcatgcgattctcctgcctcagcctcccaagtagctgggattacaggcacccgccaccacacccggctaatttttgtatttttagtagagacagggtttcaccatgttggccaggctggtctcgaactcctgacctcaggtgatccacccgcctcagcctcccaaagtgctgggattacaggcgtgagccactgcgcccggccgagggttttaaagatcataaatagggtaggtattaacaatagttactattatgatatgtgttatgacttcataacagggaaaatcttctggtcaagctgctcctgggcatagccaacgagggaagtgtcctctggcaggaaccacagctctgggaggaagaaaaggaagccgactacaggataaaacacaaattagtattcccctttaaataaataattagtgtccacagagatggcctttcttctcctgtccttgttattctgttgtgaccacacattgactgctgtcaggatgtttatgctttgggtttcactggtcaaggtcatccttcatgttctcttcagagaggtttcatttgacacaaatgctaggtactccctaaaagctgaaacacacttttgaccacctatttaaaaacttttattggtcaaaaaacaccatgaggccgggcgcggtggctcacacctgtaatcccagcactttgggaggccgaggcaggggatcacctgaggtcaggagttcgagaccagcctggccaatacggtgaaaccccatctctactaaaaatacaaaaaattagccaggcgtggtggcgtgcacctgtaatcccagctactcggcaggctgaggcaggagaatcgcttgaacccaggaggcagaggtggcagtgagttgagatcgcgccattgcactccagtctgggcaacaagagtgaaactctgcctcaaaaaacaaaacaaaacaaaacaaaacaaaaacttaaagattagaaaagtcaagggactcccccaagctagtaatggtcagattggggattcaagccaggccaagcctctgtgtgtaggccccaggccacgctgcctctctggagtctcctgtggctccggccaatacacacttcagtttggatcccacggcttttacatgtgccttattaagatccaatctgcgcccttcaactagaggtttatttttcattcatttacttatttattttttgagacagagcctcactctgtcgccaaggctacagtgcagcagcacaatctcagctcacttcaagctccacctccctggttcaagcgattctcctgcctcagcctcccgagtagctgggattacaggcatgtgccactacgccacgatgcccagctaattttttttttgtattttgagtagagatggagtttcgccatgttggccaggctggtctcgaactcctgacttcaggtgatccatccgcctcggcctcccaaagtgctgggatgacaggcgtgagccaccgcgcccggtcatttttttaaatttgtttttggagatgaggtcatgctgtattgcccaggctggagcgcagtggctattcacaggcatgatccctctactgatcagcaggacacttttgacctgctctgtttctgacctgggccggttcagccctccttaggcaacctgggggtccctcaccccccggaggtcaccacactgatgctgaacttagtgtagacatctcatcaacacagcacgctattgtgcagaactcctgggctcaactcatctgcccacctcagcctcctgagcagctgagactacagggggataccacaatgcccagtccccaactagagatggcttacattccttctgaagctccttttagacccatctgccccctgccctcacctcctgctgttgccttcggctgacctccccatggtccagcgccacagcatcggatgggcttgcatttgcctgtggactcccgtaggtcatcctgacatctgggtcactccccacattccccctctcgctcactccgtccccagcttccctgcctccaccggtctcagctgcgcataatggctgttcgaagccgcggtgccggagtgagggctgagcgctgagcagagcgccctagcgcgggcctcgagggctggcggaggggaaggaccccaggaggggaaggaccagctttgctgccaagcaggaagccggagctgtttcctgactcaccaccacactcacaggtgggagtgcaagcccctcttcccgccctcaggtgcttcccacagccccctcgccgcctctgcctccgtgcgggtcaacctgtcctgccagcccgggctgttcactcactgcctccacgcagcctcagtcacacagggaagcccgtgactctctctctttcagccccctggctgcagcataaacaggccggactgtgtgaccttcccagaggggaaaacagcagctgcaggcggcccctcccctggcattctggccatagagcatgaccaccggacaggagtgcctgcagggccaaggccctgggacagtgcgggcgcgggagcttctctaagatgccggacgtacgtgccttttggcccagggcaggccatggcattgctggcaggcagaaacaaggggcaaccgtggcacccccggccctgactttccacatccacggactcccgagtcctccctggcctgcaggaggctggggagctgggtggtgggtgggggctgcggagctgggaggtgggtgggggctggggagctgggtggtgggtgggggctggcattctggccctcgggtcccctccagagggagccttgtccccaagtggctggagtacacacccagagttctgtacaacctgcacaggccgggatcccggaaccagactgcacaggtagactctgccaggctgggctgtttcctacccacaacaaccgggcacctccaagcacatgctgcccgggacaaggtccttgtggtcacctttctgcttcagtgctgaagggaggggaagggtgtgctcccctcccccggccacctcctgtgccttcccggccgggtccagtcctgccaataccgctgccctttccgtctgaacgtggtcacatactgcagcaaattcatgaggcagaaccctcagatggcaaattctccccaaaccaatggcaagtagctgactgcctgagcttccccaaggtacaggacagaaagagaggaaggtggggaggcacagcaggcactgggcactggcaagtcccgctcaccaggcacctagaccctccagagctggccgggggccaccgcgggaccctctcctggaccctccagagctggccgggggccaccgtgggaccctctcctggctgcagacgcggggtctactgagccacggcactaaactcctgtcccctctctgggggcatctgccatcctgccctcctctccaggatctgaagagggatgtttatcctcttcacttccctcagatcccacctcccatgaaatcatgccttcctcaggtttaaagtcagacttgaaggaatcaaaagggaaaatccacagagaaatgtctcatcggggagcctggcaacattttgaaacccgcttttctgtgtggcttctgctgagaaatccccatcccacccacggggacaggggtcagagtaatggagtggaaatggcaggttcacaattttggctacagctgctcccatctctaagcaacccaggctccgggttggagggtggcgaccccaagatgcggcctcagccgccggccgtgtttgtgctccagccgatgaagcgagtgcaaagggctgtacaaacgcgaggcactgaacaaacactgagcgtgccgtccagatgtcccgggggaggctgaggatccacaccgtggggagtgctctgcccccatggagtgacctggcgtccgccctccacggatggcacgcgatggcccaggccctgtgctgcagggccctgggagagccagcactggctactgggcagcctacctgacgcgacagccacccttgcccctcggagcctccacttgggagggaaataccaccatgggtgccgacctcttgggctctggaaggatggctcatggccatctccttctggactacaaggaaaaggcgtgtgcccgcttggagccccctctcctaccagtgggggtaacagctcgcagcccctggtcatctgtatttagaccacagcccatgcagcacaaaggccccgggacccaggaagtccccgaattaaggcttccacagcgccgtcccctagagtcctgggttatcacagagctattatccacagccccaacatggttgttgaagattggagttagaaattcctaaaggcgaccctggagactcctttgtcccccaaattagaacacgggtgggagacacaaacagaaagtgccattgtgccctgagcttggcgtctctgggagctgatcccgacagttctgctttctgaagtcctgggttgtatcagaatgagattcggctctgctcagcagaagccccagtcagcccaagagtgttgcttaactgcttcagccctgtcctcactgacctcatttcccttttggggtctgttctcaaggagcaggcactggagccctcatcagaggcctcagggggcaggggaatgcccatggaactccctccaccctggggggaggcagaaagagatgacttagaaggagagctggcccatgcaaccagagggtgtgggtgtgaatggtgggtgtcagcacatgccctcagacgaggaacagtgacgtagcagcttcctggggcctctggaccaagggttggcaaactttttccataaagggccagacaatagacttttttttttttgagtcagagtctcgctctgtcacccatgctggagtgcagtggcacaatctcagctcactgcaacctctgcctcccgggttcaagcaattctcctgcctcagcctcctgagtcgtggggactacaggcgcccaccaccacatctggctaatttttgcatttttagtagagacggggtttcaccatgttggccagcctgctctcaaactcatgagctcaggtgatccacccgcctcagcctcccaaagtgctggggttacaggcgtgagctagtgtgcctggctaagacagtagaccttttgggctttacaagccatatggcctctgtcacgactgcgttgactctgatgagataccacaaaagcagccacagacaggagcaaacaggcacagctctaccccatgaagttttgtttacaaaaacaggcagtggtctggatttggcctggcaatggcggtttgctgactcctgctctagatcaaaaaatgaaaaccttgaagaacaaaccaacagcctcccttagacagacctctggtagccaaacgcttcaaatggtgatcaggtgactctcttgcctggtcactctctagcctgtgtagctttttgcctccagtgggagagcaaagagtgaatagaaacgctcctgccacagtggtttgtgtgttttgtttttttttttaagacggagtctcactctgccacccaggctggagtgcagtggtgcgatctcagctcactgcaacctccgcctcccgggttcaagcaattctcccacctcagcctcccgagtagctggaattacaggaacatgccaccatcccaggctaatttttgcatgtttagtacagattgggtttcatcatgttggccaggctggtcttgaactcctggcctcaggtgatccacccaccttggcctcccaaagtgctgggattacaggtgtgagccaccgcacccggccaccgcagtggtttttagccttcacacagacctgccagaggccagtgaaagtaatggaccctcccctccagaaagacacagctgagcagcacctacacacgctttgttggcatggaatttcaagggtgtgcacggctctcctgaagcttactcatggaccatgtagagacctgaaaaccccagggtaagatctcctgctcactcggaaagaacactagtgtctttgtatttgaaagagctcttacgagtcactaaatactaataataataaaatcaagagcactgtagaaaaatagacaaatgacacaaagaagcaattcacagaagaaatgcaatttaccaataaagaggagaaaaaatgctctgtctcactaataatgaaataaattttaaaaatggcatgtcgtttttcataggatcagagtggctatgttttaaagaggaatgacatggcactggaagggacatggaggaaaagacactcgtgtacgtgctggtgggcctgtggtggcaggcaggcttttttttgagacagaatttcactcgtcgcccaggccggagtgcagtggcgcaatctcgactcgctgcaacctctgcctcccgggttcaagcgattctcctgcctcagcctcccaagtagctgggattacaggcgccctccaccaagcccagctaatttttgtatttttagtagagacggggtttcaccatactggtcaggctggtctcgaactcctgacctcaggtgatctgcccgcctcagcctcccaaagtgctgggattacaggcgtgagccactgcgcccggccagataacatttttagaagactatttaacagtacatattaaattttaaaacatgctaatcctgtggcccagggctgccaggaacttattttacagaaatacatgtacagggatgctcacttcagcagcattcataaattggaaaaattgggaaccaagccaaaagtccattagttggaaacaggttgaataaatgatggtccatctatattaaagaataatatacagaactgcttaataataaggcagatctctaagtactgacaggaaaggatgtaaaagatacattaagggaaaaggcaagttatcacagttcttttttttttaagaaaaaaaaaaagaataacactggtacatgcagatcttttaaatactgaagaaatatattccaaactgatgaagacaggctgatagaattttttttttttaaacggagtttcgctcttgttgcccaggctggaatgcaatgccgcggtctcggctcactgcaacctccgccacccaggttcaagcgattctcctgcctcagtctcccaagtagctgggattacaggcgtgtgccaccatgcccgagtaatatttttgtatttttagtagagatggggtttcatttcaccatgttggccaggctggtctcgaactcctgacctcaggtgatgggaaccttctcagcctcccaaagtgctgggattacaggtgtgagccactgcgcctggcaggctcatagaagtttagtctacaattcatatttctgaaatgttaaatttttacttttatttttgggacaaggtctcgctctgtcacacaggctggaatatagtggtgtcattgtggcatactgtggcctggaacttctgggctcaagccttcctcccacctcagcctcccgaggagctgggactacaagcaactgccaccatgccctggctaattaaaaaaaaaaaaaaattggagagacaaggtgtctcgctatgttgcccaggctggtctcaaccctggcctcaaatgatcctcccaccttagcctcccaaagtgctgggattacaggtgtgagcaactgctcccaacctgaatttttaaaataaaatcatttttgggccaggtatggtggctcacacctggaatcccagcactttgggaggtcaaggtgggaggatctgttgagcccaggagtttgagaccagcctggtcaacatagtaagaccccatctgtaaaaaatgaaaataaaaaatgtaatgaaaaaaattttgttttataattataaaacataaaaaaagacaaagaattcttactggcctattagctccaaccgcagggtcccttttaaagtctttctttttttcctttttttttttttgagggggagtcttgatcttgtcacccaggctggagttcagtggcgcgatctcggctcactgcaaactccgcctcccggcctcaagcgattctcctgcctcagcctcccaagtagctgggattccagggacccaccactgtgcccagctaatttttgtatattttagtagagacggggtttcactatcttgggccaggctggtctcgaactcctgacctcatgatccaccacccccatcggcctcccggagtgctgggattacaggtgtgagccaccgcacccggcctaaagtctttcttaacagggattcttggtcgtttttcagacaaaacacctctcggcatttcggggtgtgaggtcctcaagctcaaggaccatctcgttcctttatccctgaaattcaggcctgccgtgacagaggcgtcgcgtgactaaaataatggaggtgaggccaggtttttagttttcatgctgatgaaagagctgctggttttcggccgagcgccgtggctcacgcctgtcatcccagcactttgggaggctgaggcgggcagattgcctgagatcaggggtatgagaccagcctggccaacatggtgaaaccccgtctctactaaaaatacaaaaattagcgaggcgtgatggtgcacgcctatagtcccaactactcgggaggctgaggtaggagaattgcctgaacccgggaggcggaggttgcagtgagccaagattgcgtcactgcactccagcctgggcaaccgagcagactcaaaaaaaaaaaaaagaaaaaggaaaaaagaagaggtccagaagcccccagagctccctcaaagctaaacaagaacccttcaatggcacgacaagggaaatcagaaaccagagtgtaccacaaatagtaatggtaggtactgtgtcttagaaactttttcaccggtaaactgatgcaggcgaggtttccttgatggacagaagcctctctgaagaagctattattctcacttctttcccaatggccagctcggaatggcacaattgcccaactgggcgagcccacagagttcccttcttccctctgggagagactttttggttcctcttttgactttcttttttgttgttgtttttgagacagagtctggctctgtcgcccaggctggagtgcagtggcttgatcttggctcacggcaacctccgcctcccaggttccagcaattctcccgcctcagcctccgagtagctgggattacaggcatgcaccacccgcccggctaatttttgtattttttagtagagacggggtttcaccatgttggccaggctggtctcaaactcctgacctcaagtgatccgcctgcctcagtctcccaaagtgctgggatttcaggtgtgagccaccatgcccagccccttttttgactttctttctttcaaccccaccttccttctgcctccctgacatcaagaaggagcatattttgtgatgtcctggggctcccaacaagggggtgcttagtaccccgagaaaacatctcccccaggcgactgtctgtgcccgggcacggaggaaacaagaggagcagaagaccagatgttccctgcattttccatctggctccggacaaaggcaaaggttgaggcagttccacgggaggcgggtggtcaggctgctccatgagccgaagctcccggagaccctgatgacagctgccgaggaaaacaggaaaagaaagtgggcggcagcgttttgtcttcctgcctctgccttccttgggcacaaggctagtgagctgcttccgcagcatcaaagcccagatcagaaggcagggaatgtcggccaggccaggtggctcacgcctgtcaccccagcgctttgggaggccaaggcgggtggatcacctgaggtcaggagtttgagaccagcctgaccaacatggcgaaaccccatgtgtactaaaaatacaaaaattagccgggtgtggtggcgcacgcccatagtcccagctactcgggaggctgaggcaggagaatcgcttgaacctgggacgcggaggttgcagtgagccgagatccccccactgcactccagcctgggcgacagagcaagactccgtctcaaaaaaaaaaaaaaaggcaagggattgtgaagccacgccctgctgcctgtggacctcagctgaggaggccctgccaggccacctcgcccatagcccctctactgtttgggacacccaggcacatgcaggcacatggaaggcaaggaaacagaaaccaatcaaagcggcctcaaatttagaaacagattactgaactacagagctttaaaaaatctgtactcactgttaatgaggtgaaggtcatacacatcccaccaaagccattcagagccagggcgatgaagatgagcacggagagagctgcagggacatggaaagctcgtgagtggagaccccagctgagctccagggaagccgggaccagcccagagtcctgcgcggtgcaggctcccagtaaatccagtaaacgcaggccggggttagtacctgacatctggggagtggaactgcccctttctcaccccctcctctaggcctatttctttttcttttttaatcgagacgtagttttgctcttgtcacccaggctggagtgcaatggcacgatcctggctcactgcaacctctgactcccgggttcaagtgatcctcctgcctcagcctcccaagtagccgggattacaggcatgcgccaccacacccggctaatttttgtatgtcttgccatgttggccaggctggtctcgaactcctggcctcgggtgatctgccgatctcagcctcccaaagcgctaagattacaggcataagccaccatgcccagcctcctcttgcctatttcacaaagcgtgggctcttgaaaaagctgcacacccatcttcttttctccaattaatattagcagtgtccaggcgcagtgactcacacctagaatcccaacactttgggaggctgaagcaggagaattgcttgagcccaggggttcaagaccagcctgggcaacaaagtgagaccccatttctaaaaaaaagttaaaaattagccaggtgaagccaggcgcggtggctcacgcctgtaatcccagcactttgggaggctgaggcaggtggatcacgaggtcaggagatcaagaccatcctggttaacacagtgaaaccccatctctaataaaaatacaaaaaattagccaggcgtggtggcgggtgcccgtggtcccaactacacaggaggctgaggcaggagaatggcgtgaacccgggaggtggaggttgcagtgagctgagattgcgccattgcactccagcccgggcgacagagggagactctgtctcaacaacaacaacaaaaaaattagctagctgtgtgtgtgcgtgcctgtagtcccagctactctggaggctgaagtgggacgatcgcttgagcctgggaggtccagggtgcagtaagctgtgactgcaccactgcactccagccagggtgacagagagagaccctgtctctaaaacaaaacaaaacaaaacaacaacaacaaaaaaacaaacagcagcgagcaggaggcctaagaaaccaaaaatacaggttcctgaaaatcagtagatgagcctggctaagattttggtgaaactcgagtcctcttttggtgtttgctctacaaatccttgaacagggttggggaccaggtggcttctaagccatccttcatgctttggcctgtgctgcctggaggggactcagcttgtgacttctgcacacaccgatgaccatgcccctgcagccggcctggttcttagaacttgcctctcaggttggcatcagtgagggactggcttggtttggtgatgagatggaagttgctcataccctggaagctcctgtctggggtggctgctctctgatctcgccgtctatttgagataagtaactgagtagaggcgtaacaggtgtcccctctaacttgagcagggagcagcaggcccaggacagtgtccaagagcaggtgggcctgggagcagctcagggcactctctccccggtccctgacagaagatggagggagaggacactcaccgtttggtttacttgctccgtacgcaatcagcaagcaggaaaccgcgaagcaggcgctaaaaccaagcagaaacgcaatgttatttaccattatgactttattcagtgttattgttttgtttttgtttttggtttttggtttttcttgagacagagccttgctctgtcacccgggctggagtgcagtggcgcgatctcggctcactgcaacctccgcctcccaggttcaagcatttctcctgcctcagcctcccaagtagctgggatattacaggcgcccaccaccacgcgtggctaatttttttatttttagtggagacagggtttcaccatgttggccaggctggtctcgaactcctggcctcaggtgacccacccaactctgcctcccaaaaagctgggattaccagtgtaagccaccgtgcccagcccattttcatttatatttttgtatatgtattataaagcacattaagaatggcatagggggccgggagccactgcactccagctccagttgcttgggcaacaacagcaaaactccaactcaaaaggaaaaaaaaaaaaaaaagaatggcataggggccaggcacgatggctcacgcctgtaatcccagcactttgggaggccgaggcgggcagatcacaaggtcaggagatcgagaccatcctggctaacacagtgaaaccccgtctctactaaaaatacaaaaaattagccgggcgtggtggcaggcgcctgtggtcccagctactcgggaggctgaggcaggagaatagcgtgaacccgggaggcggagctcgcagtgagccgagatcgcgccgctgcactctagcctgggcgacagagggagactccatctcaataaataaataaataaataaataaataaataaatatgaaaaatataaaaattagctgggtgtggtggcaggcgcctgtaatcccagctactcgggagggtgagacaggagaattgcttgaactggggaggcagaggttgccgtgagccgagatcacgccactgcactccagcctgggcgacacagcaagactccgtcttgaaaaaaaaaaaaaaaaaaagagcacagatatacatcatttataattccatgtgcttattatattgggggtacgtgttgaaaatcttttttctggtggagctataaggtcaaacgggctgtggaaaccagtgttgttggttttttttctcatcagatggatactgtgccagcttcgtaacaaggtttgagggaagcatgtctcacacatgcgagggaaaccccaattatcatgcttatgaactacaaagggatgggaaacacatgttcttagtgacaagcagctccggtccctgggcggcctggagcctggagcttttcttattcggtactggagcacggcgaggaccacagtacctgctgattcggtggcggacggggtaggaactccattctggagggccttcagggagctccacagtacacctgatatcaggtacgaccaggatacccttctgtggggaactcagcccagggggtccacctgcccactccctgccccctaagggacccacactgacctgcccagcagcctgagcttcctcgggccatacttgtccatgacgatacccaggggcagggtgatggcactgagcagaaaggagcccacagtgaaggccaaatttagcatctcgtcctgggcctggcagctgagccagccgttcatccagctcacctcctcgtgccccggctctgctgtgccgcccactgtgccattggtgacattctctgtgtgaagagggaaggaaaccctgacctcagggtcatgacagggattcccaaagatcagaagggcaggtgcccattcagagtccccccactgggaatgccagggctggctggcggcctctcgagggctcaggctaccccgcagcaggcttggatggccatttggcccaagtcccctggagtgaaaatgtagaggttcttaacttttgtgggggccatggaccctttgaaaaatccaataaagacctccccagaaaatgcacaccaaggtttatccacagtttcaggagctttgtgtgtcccttgaagagcaacgaagcccaggctgagagtcccattcgagagcatccgccaccctagaacggcagacctcagggcccagccttggctgtggggccccaggctggtgagaaccttctcacggcagctatgtccgtggggacagactgcagccagtatggaggcagaacccagaccacttgggaagcacaagcactggtctcaccccaatagcctggttctcctctgtccatgtggggagactgcggcgcctccttcaatgggaagtccagctgccttctcaaacatagaacagatgccaccttctccccctgatattttctttttctttttttttttgaggcggagtctcactctgttgcccaggctggagtgcagtagcacgatctcggctcactgcaacctccgcctcccgggttcaagcaattctcctgcctcagcctcccgagtagctgggattacaggcacctgccaccgcgcccggctagtgtttgtatttttagtaaagatggggtttcatcatgttgcccaggctggtctcgaactcctgacctcaggtgatcctctcacctctgcctcccaaagtgctgggatcacaggcgtgagccgccacacccagccgatatgcacctttcttattttccttgccggggtcacagtggtgccatcccgtggccatgcctagacctcgctgggtgctgagtctggtgtgtttgccacacccagcccttaatggcccccttcaaagtccacccagcaccaaaacaacacagaaaggaagagaaaagtgctgtggcagctgaagatgggagggtggaggacgggctgggaacgtggctgaggagctctcctggccgggactgctagttaagagatgctgactaatcctgcagaaaacaggagccgactttgattagacatgaggtcacgctgggagagtcaaggaaacgctcttcttccggtaactgcctgccttccaattgcagccctctggcgccagggctgtagcgccgaggtttgcaaaagcttgctcaggcctctcggggttcctccaaggttactggaaaggatgcgcacaggtggactcgtgcttcatgccaacgtgtggccaaggagccccgccggggccgtgtggatgaagagcgtggaactggaatctggtttctagcttccagtgtttgattctccactttctacctgcatgaccttgctctagctcagtttccttgtccataacatggacatcatataatgataagatccacctcctagagtgtgggggaagatcaatgagaaaaattcagaaaaccttctggagctcacccaggcatagaaagcactcaataatgaatagctacaagttgctgctgttctcgtggttatcatgatcattgctgctattggaggctccggcggggaatcacggcaccatcagctggcacagagccggatgcagtggctgtggggagcacagtcccgtcagcgtgtgtggaagcgcaaagacatgtctaatcccccactgggctgtgagccccgaagggcagggcctgcactgtggtcacttctgtgtccccagtatctcacccaggtcttggcctacaatagctgtttactgaataaataaaaacaacagggccaggtgtggcggctcatgcctgtaatcccagcactttgggaggcagaggcgggtggatcgcccgaggtcaggagttcaagaccagcctggccaacatggtgaagccccgtctctactaaaaattcaaaaattagccaggcatggtggcgcatgcctgtaatcccagctactcaggaggctgaggcaagagaatcattgaacccggtaaacggaggctgcagtgagccaagatcacacaccactgcactccagcctgggcaaatagttagactctgtctcaaaaaaaacaaaaaacaaacaaacaaacaaacagaatcaggccgggtacagtggctcagtctgtaatcccagcccttcgggaggccaaggtgggtggatcacctaaggccaggagttcaagaccagcctggccaatatggtgaaaccccatctctactaaaaatacaaaaattagccgggcatggtgggcgtctataatcacagctactcgggaggctgagacaggagaattgcttgaagccgggaggcggaggttgtggtaagctgagatcacaccactgcactccagcctgggcaacagagtgagaccccgtctcgaaaaacaaaacagaacaaaacaaaacaaaaacaatggcaccagatcacaatggccaaaaagatcgagagaggaatcaacagaaccacgttgaatcgaggggggatttaaggagatcagagccacgaggttaaccatgtggagccacagaaatacaacgtcaccaaccagattcccacctcggccactttctctcggttttccaaaaagaagctctaccacacggtcagccaaacacatggcagacggggtcctcgagcccgtcagggtggagctcagagcggtcatgtacaccgccacagccgacaggcctgggccactcgcccatccacagtggggcagcttctggaaaggaggagctgctttgtgagttggtgttggtttcaaatgtcagctctgccagcagcaaaggaattggctctgaagtcagggaaagagggtctctacaaagcaacagccatttccaggttgacatgcagataggagcaaaccagcacagaggtgacagagaggatggatggagagagcacgccagggcccaggatgggtgacttgtggggacagtgactgcacaggggccgtggaataactgagggcttggggggctgcacgttctactgctgcaagcaggagccacggggacaaggaatggagtgggtgaggcagcactgcctgagtaaaggcaccagggacctccagttaccccagggaggaaccacagctgggtctctaaacccatgggttttctcatctagagccagaagataaaaatcccaaggctaggccaggcacggtggctcacgcctgtaatcccagcactttgggaggccgaggcaggcggaccacttgaggtcaggagtttgagaccagcctggccaacatggtgaaaccccatctctactacaaatacaaaaaaatttagccaggcttggtggcaggtacccgtaaccccaactactttggaggctgaggcaggagaatcgcttgaacccaggaggcagaggttgcagtgagccgagattgtgccactgcactccagcctgggccacagagtgagactctgtctccaaacacacaaacaaacaaacaaaagtcttaaattgattagagatctggtcacccctttaaccacatagggaagaggcaaggtcagggtagaggcaagggtatctgtccttcccatcttttaccctggagcgactacacacaggggcagggaccttgcacgtaggccaacagccttctcgtcttaaacaaatccctgccgatggggccaccaggccctctgcccggccgcctgcctccaggccgtcccgtccagcaacagaggcgcctggggccggggaggtgagcggcttctccttctgcttgtggagcaatttgagagtctccctcctgctggagggaaggaagcccttggtgagcccagaagctctgttgacagtaaacagcccacatgcacccagcagatgcccaaacagacacacccaggctgttcctctccctctggtcccacctgggccaccgtgggtcaggagagagacaaacagattaagcacccaggaagtgccaaggcgtggggtggccctctgctcccagcctggagcttgaccccgggccagcctgctctgctcacccccggccaggctgctctgctcctcacctgcacctgtttattaaacagatgcctcctctggggtggccagaagtggcccagcccagcctggccagagaaggtgaactgagaagacaggcaagagttggtgtggccagtgagtgccaagaacaggaacagggctgcttaggaggagacccagggccagggaggacgtacaccgttcagccccactcacagaagacgcacaagatctttacagaggaatcagggagaaaagagggtgctgtggccccccaggctcccctgaggcaaagaggagcctccccacaccccggggagacaaagggaggggggcctccaagatgatgcttgagggggccaagaagtacctggcttgaggtcccctctaaattcctgagctgcccccttccctgactagtcgctttccgagccccccctccagggtgcgggcccctggacagcccaccgatggcccctgcccaggatctcccgtctctcaaatccttagtctatccggcaacaggaagcagcatctcagtcctcagtccggcaggggagatgtaggtgagaggtcggctcagacacagagcaaacaacaggcaggagggcacggacaggcagaggccgtcctgggctgaccagggcctggcccctgagcagtggtcccagcagcggctgccgtgtgtgcaatgaaagtgtgtgccagctgccatgctcaacgggtgtgcccacgcccaccccatattccccacgaggatactgtcagagtgtccccgagggatgctcagagcaggtaagtcacttgcagaaggtctcatgggggtccctggggaagctgggcttgactccaggctgtcagaccccaaagctcccgctcttaccactcggtctgtgccgatgctggcctacctgggctagaggctcatatcccagagagaaaatgctgagagaacagagccgggaaaaggctgcccatgtgccggcaacaccaggaggccctgaatatcgcttggtgggaatgggactaagactctcccacgaggtccctgagagccagcctaagctggacaggaccttcatggacaccagaagccaggggtggccagtggatgtctgtgagggaaatgaggtcacgaaccaagaaggagggaggctggggcggtgggaagagccaaggccaccagctcttctctgagacgcatcctgaggctgccggccccagcctttaaaccttcttacccattgctatggaatttttaaaattccaaataaactgggggaaaagtttaaaagtcatatttatagcaataaaagtgaaaggctggatttaagaaagctatccggctgggcgcggtggctcacgcctgtaatcccagcattgtgggaggccgaggcgggtggatcacgaggtcaggagatcaagaccatcgtggctaacacggtgaaaccccgtctctactaaaaatacaaaaaaatttagccaggcgtggtggcgggcgcctgcagtcccagctactggggaggctgaggcaggagaatggcgtgaacccgggaggcggaggttgcggtgagccgagatcgcgccactgcactccagcctgggcgacagagcaagactctgtctcaaaaaaaaaaaaactatccacacttgcctgtgggtgtgaggagagactctaaaaagagaggcccttgagctgggcgcagtggctcacgcctgtaatcccagcactttgggaggccaaggctggtagatcacctgaggtcaggagtttgagaccagcctggccaacatggtgaaaccctgtctctactaaaaatacaaaaattagccgggtgtggtggtgggcacctgtaatcccagctatttgggaggctgaggcaggagaatcactttaacccgggagatggagtttgcggtgagctgagatcatgccattgtactccagcctgggcgacagagtgaaactccatctcaaaaaaataaaataaaataaaatacaaatacaaatacaaaaaattagccgggtatggtggcaggcgcctgtaatcccagctacttgggaggctgaggcaggaaaatcgctttaacccgagaggcagaggttacagtgagccgagactgcgccactgcactccagcctgggcgacaagagtgaaactccgttccctcctccccatcccccaagaaaagaggtcctcgaggcagcagagaaatctcctgtccacatctgcagcttcactcagcccgtggggatcaagcctgggcctgcttccccaaggtgggcggcagcccctctgcccttgcagcgatctctgtgccagggcgagctcgcagggacctctgtgccagggtgagaggctctctcccaccaccacaggtggagaaactgcagaggtcaagagcatacaactggggtcggccttcatgcccatggtcagactgtgggtgacttcctcaggcagaggccgtgatgacttctggtttctatgccacccaaacataccagcatgtggcaagccctcagcaattcacacaagcctctaacaggggaattggatggtcgccctcctctatctccctggcttcctcctgtcttgggaataaaattcagtttccccgaatggcctcccagtccctgcagcccccgccccttcccacttctctcctctcctccagggtgtaccctcctctcctccaggctgtaccctcctctcctccagggcgtaccctcctctcctccagggcgtatcctcctctcctccaggctgtaccctcctctcctccaggctgtaccctcctctcctccaggctgtaccctcctctcctccaggctgtaccctcctctcctccaggctgtaccctcctctcctccagggtgtaccctcctctcctccaggctgtaccctcctctcctccagggtgtaccctcctctcctccagggtgtaccctcctctcctgaatcacccctcctcaacctccaggcttccacctgaaccgcagagaggccctcccacccagcaggagccacatctccgctgctgttctagctcctggcgccctgctttcttgggggcccgaccaccccctggaattatacgggttacacaggtatgcgtgtgatgacttgtttcctctgcacccagcacggcaccttcgtcaatgtttactgaatgtttaggttacaagaaagaggggattaacgatccacatgtaggcctggagcggtggctcacgcctataatcccagcaatgtgggagcccgaggtgggtggatcgactgagcccaggagttcaagaccagcctgggcaacatggtgaaacccctatctctacaaaacatttaaaaattaactgggtatggtggcttacacctgtagtcccagcactttgggaggctgaggctggtggatcacttgagcccaggagttttgagaccagcctgagcaacgtgatgaaaccctcatctctacaaaaaatttgaccgggcgtggtggctcacacctgtaatcccagtgctttgggaggccaaggcgggtggatcacctgaggtcaggagttcgagaccagccaggccaacatggtaaaaccacatctctactaaaaaatacaaaaattagccgggcgtggtggtgggcacctgtaatcccaaaaacaaaaacaaaaaactaactgggtttgatggctcatgcttgcaggcccagcactttggaaggctgaggcaggaggatcgcttgagcccaggagtttgagaccagcctaggcaacatggcgagaccctgtctctacaaaaaatacaaaaattagctgagtatggtggcgcacacttgtagtcccagctactgctactcgggaggctgaggcgggaggattgcttgagcccaggagtcaaggccgcagtgagctgtgattgcaacactacattccagactgggcaacagagcgagaccctgtctcaaataaaaaaaaaccatccacaggtagccgcagccccccaggctgaccctgaccctgttgaagcgggggccactggacaacagagaaaacgaagaaagagctcaggagtgggccgtcacgttgccatcccagaggccaagaggacacagctccaggaagccccgtgcttctcgggctgagaacccaactggtctcctgccctcaccagggggacgagggaggcatccagcagccaacacctggaggacgttgtgcaaaacccattgccaacttcccgcacccaggtccccaaacccagcctgccacgtctcccagcaggcaaggaagaacaaactgcggggcagccgagaaatgagctgtttccttccttctgccacctcaccaggctggaacccaacacggtgtctgtggcgagattctggctggagtcgtaagaaagagttctaagaacctttcaacaggttcaggcaaattttctttagagaacaaactaaagcatcgtcctagagtgacacgaagctgacaaatttgcatctcaatcagccggacactgctcaggctttcacaagtctaattcaataaattcaaaaatggcctatctgcttctctgcaattcagccatgcaccaagtttgaaaatgttagactgaagcagaaaccttcaccctaacttcgccaggcactcccagacgagccaaatgcggggatttctggcctgaaagaaaactggtgatgcagactccaagaatcaaggagcagtgtgaccagagagataagctgtgtggaatcagcagccttcccgcccagaacgtgggctcagcatgtttgccagataataagaaaaaccaaaattggaggcaggagcaaaagttcgggataagaagttgatgttcaacccacaatcctgacccttcaccttcactttggtttagtggagttacctgtcaagtctgcccagggcttaaaacaccaactcagcactgcgctggcacaatctctgggactcctcccacttagacagaggaggaagctgaggttgaggcaggaatgaaaggaccagacccaattctgccaaaaccatacaatcaattaaatccgtggacattctattaaaaaaaaacaaaaaacaaaaaacaaacaaaaaacacctagaatctgaccttccgacatcatggtgggttaaaaaaaaaacacacaaaaaaacacctgcccacaacagttctctggtctgggtgagacactaaaagctttctctggggacgatgactttttttctgctttttttttttttttttaaaccctgtgtccagcctgaaagagcccaccagggaggcaagcaggaagggtcacgatctctaaggggggagagaggaaaggagaggaagaagtaaacactccaacctgtgcctttcggggacaggcattaatctcctaacaactcttggccaaagcagaaagcttgttcagggaacaaggtctgactcttcccaactcccaagatttcttgctgatgtggggaaagacctgccaagaacccttaggctattaggaaatatttttgagtggctaaaggctaaaggttagttataaatgatatactttctgtcctctccccgcggcctctgcattctcctgctttctcctgccctgaacctctccagctaagcctccctccctagagactgggacacacaggaatctccggggcagatcagagaagggaaacagggaggcttccacaaaggattacacccagcatgagctggtccaaagctttctcttcctgcaaagagctctagaaagaaaaggcctgctgctggggattcaggaagtcaaacctgggctacctccatctaagggcactctagcactggcgacagggattatgtgagctcagctattatgcagctaccgttgggatcaaggagaaggcagagggaaaatttcctgtcaaggttgcctaagaaggagggtaggaggctagaggctgggggctgctgtggccctcctgtggggctgaatttactgccctgtagtcatcaggaccctccaacagggtatgaaggtgtgaaggtaagtgtgtgttgggtggtgcagatgtcatgtagagaagcatcctcagcctgccttcagcaattccagtgacaaggcaaagaggagagaacaaccctagcatcatttccataaacgttcctttcttctcttccccttcatccccatggggttggaaagccacggagatgtcctcagagcccgtgggggaaatgtcctttggagaatcataaggcagcaaaaatagacaagaaattgtgtccagcaagcacttaggagactccacaatggcctgaggaacgtctagattctagatgagccctccctggggtggaggcaaggccacttcctctcctgctgcaccccagccccttaatctggagttcctctttctcacaagcagacagcaacatgtttactaccagccaagctatgttccagggctgggaggagaggagagcagtccagcactgttcgtagcgggtggaaggaacaccctggacagcaggtggggttctgggtggatggcaggcccaggctctgcggccttgcgcaagacagatcgctctgagcctcgatgtcttcgtccacaaaacaggggcaatgacaagtacccggcagggctgggtgaggatcagatgggccttctgataccctagaggcactgggcaatgcggtgctgtggctcgctaggtcttcgcccccatcccgccccctcccaaagccccagctccaggagccccccgcaaccccaggcgcttgtctcacctggctcggtacacaggtaggagtaaaagccctctgacttgagcatgatgagcagcgagccccagcccaggaggactgccgagaagaggaggttctccagcacggccgtgcaggccatccaccagcggcgccgatgggcagtggccagggtgggcgccatggtgcggcgcggcgcggctccggctccggctccggctctgcaccacctgcgcacagaactcggcgtcagcggccggcccttgcccagcccctgcggccgcccccagcagccccgaccgctgccgcagggctcgggattgccacccctccccggccgcggcggccggtgcgcgcagcagaggaagcgaaccccagccctgcccggacctgggacaccccgagcccgcggccggctcgtaccgctgccctccgctacgacagagccgccccggccaggcagggagacgtctcccgcagctcactccgaggtaaactgaggcatggaggcaagaaggggctaacgcatgctcagggccgtggaactagtcctggcctgcagcaggactgacatcgcctggggccagcatggaacgcagcgtgaggtgggcaggggcagatccgagggctgcctctcccagggaccctgacaggtgccctcccgcccgcgcccgagacccttccccagagctggtttcttcaaccacaagatcagcgcccagacctacggaacggcccgccccggcgcgctcattggccggacggcgcaggaactgccgcgccattggccgccgtctaggtcgctaggcgctgcggccacgcgaacccagcgtgggagacgaggagccggttcaaaccggtggcgcgagccagccgcgcgacccccatctcgggcgttcccccggcaactcgcccgtttccatggcctcggacccccgcgcctccattccccagcccgcatctgttcgtcatctcttccctggcggcccctcatcgctccatctctctcctcgttcccacgttttctccctacgccccttcggcggccgcttctgcccccgcgccctcgccccggccgcgatcccctccctgctgcagctcacccggctcctccggcgtgtgtcgggcccgcccggcgccttttct

SEQ ID NO: 1603 - DNA, 31914 bp, Homo sapiens
ggggctgtctgggctcggggcgcggcggcagtcagctctatgttcgcggtcttaacctctcctctggccgagtccttgcaagaagtgaattacccgaccctggtgagtagctgcaggagtcagacctcttggaggcggcggcgccagcagcggcggcaggcacgaggtccaccgcgggcgcctgcgcgctcgcccgccagccaatctggtggccgctttcctccgggcgccctttgacccggcgcccctctggcaggcgctggtggcgcccagcggcgagcctgtagccccctcgattaacctaggctgtcactcttaggcctgttttagtctgcgttagttttactgccttttacactgctttatccccacctcactggcctcgtcgccgcctcctctttgaaacggtacctcctgtcgcctcggattttccttgtctccccgacaaggtggaaatttcgggtcggatggaagcctttttcagcaccttctccttgtgcccccagactgcctctgggccttgagccgaccgggagagtagaaggatcgaggcctgctgggctctgggtgcaacggaaaggtagctgtcgcctctgggcatcgggaggagaccgcccgatggcgaggccgctagagatggtttttcagttcacctgttaacgtgtttggcactgtcatcttagactcttagcctttgctaagtcgggatgcaacagtgctggattagtgtttttgttgttcctttttccaaagaagcaacttgaagtacaggcaggtataactgtttggttttgttgttgtaagaccctacggataagtgttaggagaaaatgtggaagtgctataaaacaacaacaagggggggataatgttgattaagaacttgaaaataagaaaaatgggactggaataggctgttcacgttaaagtattgaggcagtagtttgaaacaaaaatataaagtaaaacctagatattggtgatactgtatcacgttgtttgcaaatcactttcatgacaatacatctatttcaggtgtatcacacctgaaaaaaacatgagtgctgtgaatttgtggattttcaggctcaatgcagaaaaacaccccccaaaacaaaaaatcacaacaatgaaaacaccatttccagagctgttgctgttattcgtgtgacgaatagtgaatgtatgatcataaaatagaataagctgtctttagatgaagtttgggcacagtttatggagtaggtaacagttaatcattgtttattaggtacataatccttaattgaaaacataaccatatagcagcagctttcatcttgtgtcacaaaaataactggtgtatcctctaaatttgatttgtctaataccttaaaggaaggcagaatagcatggacaagaacttgagttcttgagccagactcgatctgctccttgctaggtgattaaccttagattggtttcttggccatttgctggcccagagatttttgaaaaagttaccaactgctcagcttcatcatttgtaaaatgaggttaaaaaaaattctgcggcctggcgcggtgcctcacgcctgtaatcccagcactttgggaggccgaagtgggtggatcatgaggtcaagagatcgagaccatcctggccaaccaacatggtgaaaccctgtctctactaaaaatacaaaaattagctgggcgtcgtagcgtgcgcctgtagtcccagctactctggaggctgaggcaggagaatcgcttgaacccgggaggtggaggttgtagtgagccaagatggcgccactgcacttcagcatggcaacagagtgagactccatctcaaaaacaaaacaaaacaaaacaaaaaacagaaactaaacctcactgaatttctgttaaccagagggtacaagtgtttacaataaaactgacctgggcaaggattgattttgaaactgattttgaaagttccagatgtgtcttctagtattgagttatatttatctccggtggcttcatacaaaataaaattagaagaaaacaatatattttttaaaaaaagcaccagaagtctgtgtgatttaatttagttaattgaaagggaagtctttttggcttttgtgagttacatgataaaagcaaataatttttgaagtactaattcataccaccctgcttctgaatctcttggggtctcttagctagctggatatgtccaataattttttattagacatcactaagcttcaagtcagcatttcaaaggattaaaagcacaaaactcaaaaaatagaagctacaggttcaaaagaacctattgtgtatgagtaatgtaaacagtcttttgaggagaaaacagattttcagtagccaatactttgagtaggtccctgccttggaaagatatatctgcaataaacttgtaatattttctctatggtgacttataatacttttcttttattgaagctaaattagttcctccacccctttcctgcaagatcagacattttaggcatctcaagggtcattgtggttttacagcgttgaagatgattttttttattaaattggatttttaaaattattggatctttacgattctttataatatgttcagtatacaccgtaaacttatcaagtgtgtatacggtcagtagtctatatatacacacacacacagatatacatatatatatatacacacacactgcctgaataccaatgaaacagcaaagagccagaaattaacttttttaaagctgaacacttaatgaacactatgtgaaagatatgttatgctctactagaatgtgaagataaagactccatttctgaaacttaaggagcaatctagtaggtgatataaagataaatgcacagcatgatataatacataaggaatgacaatttggccgggcacggtggctcacacctgtaatcccagcactttgggaggcagaggcgggtggatcacgaggtcaggagatcgagaccatcctggctaacacggtgaaaccccatctctactaaaaatacaaaaaattagccaggcgtggtggcaggcacctgtagtcccagctactcgggaggctgaagcaggagaatggcatgaaccctggaggcggagcttgcagtgagcggagatagtgccactgcactccagcctgggcaacagagtgagacgccgtctcaaaaaaaaaaaaaaaaaagaaatgacaatttaaaaagtaaatactgttaacaataaaatatatgaggaataagtacttttcactgtggaattaggagaggtatcaagaagaggcagcatttcaactttgacttgaaggtgactggtatttcaatagttggtcatatagagaataggcatttagaataaaatgtgttatattttaattgcttgtcggacacccatctttaatcatcatcataaacaattgctcatttatttagtcttatactaagccacatgattttgagagttttacaatattaactaatttcatcctcacaaaaatcctatgagtgaagtaataactcattctatgggtgaggaaaggaactcagaaagatcaggtcagttttgtaggtcagataactaaaaaatggcacagctggaatttgagctcaagcatttgaactacagagctcatattttaaatctcaatgcccatctgtgtttatttaggttgagatgacttaattgagacatggaggttgagccagagccagcagatcatctcttaaaattgagcttgtgtgtcatctataatgatgtgataaacacacattttaattgaatgaatgaagtaatgtaaaatgagaagacagaggatcagcttaagaaattacattcataggcaagagagagagaaaaaaaaacagcttccataaatggacattttgtgctttgtattcatgagtgtatccagaaaatgaacctaagaaattttttagagtttccaatatttcttcacttttcatttatttataaattcattagtatttactgtttgattaaaacattactgtttcaaattgtcttgcatgattcacagaatagttttatcagtaggcaaaacagataccctcttttttaagaaaaggctaagtgatttacccaggatcacacaactaagtgtgactgatttgaatttacatcttaagatttattatatatcttgatctttcatgaatctcgccattcagctgaagtcaacgtttcaaaaatgaatgccttactaatttataaatctgttagttatttctcctttctctgtaactcttccaacattcattaccattgtttttttccttatagaatacctatccaaatgttttccttctgaagtattatgttctacttttagaaaacagagtaagaaaatatcactgttgtctcatccagacataactattttacatgtttaagtatatttccttctatgtgtatctttaatacagatatgatattatatatcatagtagttgatatattacatccaaaatattatttttgcttcatgtctcatcaaaattttccctttcttcaatcaaagggaaatgtttgttgtgatgtcaatgatttgaaaatttcaggacaacaaattacagtggcatgccaaaatggttgtatcatcttttttttttttttttttttttttttttgagacggagtcttgctctgtcgccgaggctggagtgcagtggcgcgatctctgctcactacaagctctgcctcccaggttcacaccattctcctgcctcagcctcccgagtagctgggactacaggtgcccaccaccatgcctggctaattttttgtatttttagtagagatggagtttcaccgtgttaggcaggatggtcttgatctcctgacctcgtgatctgcctgcctcagcctcccaaagtgctgggattacaggcgtgagccaccacgcccagcccatccttttatacctgttagtgcaacaggactgccacagctcacatgtagaaatttcacttcacagagtcatgtagtgcagggtttgaaagactttgtgacttagccctttccagaaataagcaggtatgttaacagctcacattcttctatttactgctgggataaatagcacaaacaatttctgtttacttttcctgcatattcaccatatggtaatattttaccatatttgcttaccattatacacaaacacacatacccttacttattatacgttgcattgtatgtaagccatacattttatatatagtgtatgtatgtggtgtacatatatgtatgaatatgtgtgtatttatgtatatgtgtgtatcctctctttaatatattgtctcatggttcctcgtgattagatctggattaatttttaacaagagtaccacagcagtgattctgtgtttttctcagtacgggttcgctgaagactaatggccatacttatttatccaaattaactgataaagtcaattttgatcactagtttaaattggtgttttggtaggttttccactgttattatttccccatttgtaattaattagatatcttctggaggaacattttgtcagtatgtatatagttattaaaacaaaatctccagacctgtctacctattcctttactaaaagttcatttacatagctttttattagagagggagggaactgatgtgatggaatgcagggatgggtaagagttaggataccaggtaaagtgtcagaaaagatttagtaattaatattgtttcccaagagttttataaatttaaatacatttaattatgtatatataatcatacatatttatatctaaatatatatgacatgtatccatatataacataagatgcacaatatgtaaatacacatatatgtgcatgtatgtgtacatatgcacatacacacgtttatgtatgtacctgcatgccttgatatatttacagtatgcatatcgtatatacagtatacatatatacatatatgacgtatatatgtacacacaccatatttacttaaagtttgaaacagacaaaatacagttaactttagttagatatgcttgtgtgcggtgggaaaactataaagaaagaagaggtgaaatggtaaacacaaaattcaagcagttgcccttaggcagggagaagggcaggactggtgattcagagggagcacgagaagtggaaaggagcttttaagctggcagatttctttttgaatgtttactttatatgttttaaactagacatgtcttttatactattcttttatgttattctttatattattcactattcacaattaaacaagattaaccttaaaaataattcttatgattttagctgttaaagaaatatacttggttagtttagtgtttcttaaatacatgtagaatagtgttgtgggaagtcagggaccccgaacggagggactgactggagctgcagcagaggaacataaattgtgaagatttcatggacatttatcacttccctaagaatactcttataatttcttatgcctgtcttactttaatctcttaatcctcttatcttcgtaaactgaggatgtacgtcacctcaggaccactataattgtgttaactgtacaaattgattgtaaaacgtgtgtttgaacaatatgaaatcagtgcaccttgaaaaagaacagagtaacagcgatttttaagacagcgataaagtctgactgcctgtggggtcgggcaaaaagagccatatttttcttcttgcagagagcctataaatggacgtgcaagtaggagaggtatcactaaattcttttcctagcaaggaacattaatattaagaccctaggaaaagaattgcattcctcgggggaggtctataagcggccgctctgggagtgtctgtcctatgcggttgagataaggactgagatacgccctggtctcctccagtaccccaccctggtgaatttgaggtcagactggttctctgctctcgaaccctgttttctgttgtttaagatgtttatcaagacagtaggtgcacagctgaacatagacccttaccagtagttctgttttgccttttctcctgtttccccagaagcatgtgatctttgttctcctttttgccctttgaagtatgtgatcttgtgagttactccctgttcttggaccccctccccttttgaaattcttaataaaatttgctggttttgtggctcaggtgggcatcatggtcctaccgatatgtgatgtcacccccggtggcccaactgtaaaattcctctctttgtactctctctcttatttctcagactggttgacatttatggaaaatagaaagaacctacgttgaaatattggggatgggttcccccgatagaatagaagcagcagtttgtaggaagtttcacttgtctttcttttctattggagttaagtcttttttaacttaattctctataataacagcaccgtatcatagaactcattttataaagcagtcaatgtcagcattgtgccaaatacctttctaataagaaatctgtatataaaaagacttgaatatttcattcatatggtgtatatgtacctatatacttatactcatatatatatatatatacacacacaacaataatgtcttttcttaatcagccaagaagcactgcattaatatatgtccataaacatacttactaaaacaaaaacacatataataccctttcagaagttataaattactgtttataacctctgttcagtaagattttcagagtcgtaagttaattttatttttggagacgttttcttgcactgtcacccaggctggagtgcagtggcacaatcatggctcactgcagccttgaccttctgggctcaagcaatccacctgcctcagcctcatgagtagctggggaactacaggcacacaccaccatgcctagccaattttttaaaagtttgtgtagggatggggtctccccgtggttgtccaggctggtctcaaactgctgaactcaagtgatcttcctgcctcagccttccaaagtgctgggattacaggcatgagccatcatgcccagcctaatgaattttttgaaaaaattgggaatatcttacttgtgattattctttttttctctactgtcatttaaaaaattttgtctgattctatttcacttcaaaatgttatttaaaatttgtaatttttcccttttatgaaattgttagttaaaaattttttagaaaatctgtttaatgactgggtttttcatacactagtaagtatttcctttttattaactgtgatttgtaaattttacacttagatttagaaaattttagttcaggccaggtgtgtggtgactcatacctgtaatcctagcaatgtgggaggctgagacaggaggatcgcttgagcccaagagttcaagaccagcctggtcaacatagtgagaccttgtctctacaataaataaataaatgatttttaaacagaattttagttcacatacatagaatgttcccttcctacattcagcatacatgtaatctgttcaagtaatgaaaaacatattttaatttcttaaataaaatttcctaaaggttcgtctgactaaacgtaattggcatgtacatggtgatatatccaaatgaatattgccgtttattctagccatagacccttattgtacacatttatatatgatgatataattaatgtcttcactttcttaatttcaccaatatgtgatgaaatcagtattaattattcaatgtaatgaaatttatggattttagttttcgtgttgaatatattggaaaatactgttgataacacttactaattatcttttttcaataaattgcagcaaaacacttactattttggagtttaaagtatgtcatcatggcaaagtttcggagaaggacttgcatcattttggcactttttattctatttattttctctctgatgatgggtttaaaaatgctgagaccaaatacagctacttttggagctccttttggacttgaccttcttccagaacttcatcaacgaactattcatttggggaaaaattttgatttccaaaagagtgacagaatcaacagtgaaacaaataccaagaatttaaaaagtgttgaaatcactatgaaaccttccaaagcctctgaacttaacttggatgaactaccacctctgaacaattatctacatgtattttattacagttggtatggaaatccacaatttgatggtaaatatatacattggaatcatccagtgttagagcattgggaccctagaatagccaagaattatccacaagggagacacaaccctccagatgacattggctccagcttttatcctgaattgggaagttacagttctcgggatccttctgtcatagaaactcacatgagacaaatgcgctcagcttcaattggtaattattgtatatatatatatgtgtgtttgtgtctgtatatatgcatataaatgattttttgtgtaactttactagttaattttctcattattattaattatattgttaagctcatacctccaaattaaactgtatgtatgatcttaaacatccaggcaaccacattttaacactgcccttagtgtatattgtttaatttttacattttggagcatttctggatatattgttgatttctaatttaattcactttctcaattttattaaattatgatttacataaaatacaatgaatttcccactttaagtttatagctcattgatgttactcaaaagtatatacctgtttgaataccaccccaatcaagaagtaaaatatttctatagcccaaaaagtctcatcataattcctttattcaggcctaccttctcccctaccgctgaaaactgtatacatatcagctggatctgatttctatcagatctgatttctatcactggagaatagttgtgagtgttctattactttatgaaaatagagtcattcagcatttgtatgtgtgtatgtcttttgctcagcacaatattttgaactgcacttaactatatcaatagcttagtcatttttattgatgagaagtctcctattgtttgattttggcaaatttgcttttatattcacctgttgataggtgtttgggctttttcaaattttaggcatgtagcatgtaatttagtcctgcttttctgtttcttaaagttattctgtcagtcttaatgtctgtttatttcatttatgtttaatgtaataatgatatgattttaaatctgccatttttctgtttattttccatttgtcccacacgtctgtttctttttttccttctttttcttccttctcttacattacatatgcgtattattctgttttatattttcttctggcttatgttattcatttgttttatttataactgtacctttttacaatacgcccctttaacttaactgattcttattgttgttcccaccgcttctcacctttctcttctccttccttctggcactccaattacatatatttagatagagtcatattgtcccacaggtgaattacagaaaaaatataacttggtgcctgaaaattcttcagtttgttaatatagtctttgtaaaaccttccagtttcagtttcatttatctttttagtgcccctaccagtagagctagaacaagaaattgggtattcttacatttttccagctctacataaaggtatggattcaccatggagctgatatgtatttagagaaacacaagagtctttgatgaacaaaacaatgtagaattctatgaatctatatcagatatgtgcaagatgagttgttttccttgtatggactaacttttttcaagtatttataaaatttaactttatagtatagttagagatttagtttctatgttctgtatgtattatgacataaaatagcttgggtcagttaagacagcattgacttctgtgtggtcaatatgtatgtgtgtgtgtctgtctctactaatttgcttttgggaggagaatcttttcaaatgatattttttctattgtttacaaaaaatttgtgtcacatttaagtctttattcaagactgtcttgatatggctaaaaaaactatgctagattgacagaggaaatggttgttctttaaagttttaattttcatttgcaatttgaatagtatacaatgagggttttttcccctccattataaatataactaatattaatacatatttgtaatacataaacatatataaataatatatgtggtaaatataaattttaaatagaaatatatgtgttacactatttttggtatagtttgtgatcaggaagaaaagtttcagtaaacatttttatgcctattcatatttataaagacctttttccctgtataatattttagtattgtatcatgtatatgaacattaattatttctaaacattgacagtaatacagtcatttcaattttaaatgttgacagcttcactacggatgcaaatattttactttttgatggattttctcctagacaaaattaaaaaataaacttgataataaaagtgacataatcaatttataaataaagaaataatttcttaatgagttaaatattgaattatactcattgttaccaggcagaaaataatttgactgttggaatactgactcaaaaccctaatttaatccatggagctggcatgctgactcaggcattctttggattgaagaagatagtaaatgaaggctgtttaaattgttgtatggttgactgtgctttgactacatatttaacattcatatttttcctttgatataaatggccttctttttatcttaagttgaattgctgtgtgaagtaattatgctgttatatcgcagagtacaagttggttgattttctgcttttacaattaagtgtggttggcataaatcctaatggctcaacccttcattgaaaagaatgataaaattaaaatgaactattaatgttatgtttaaaatccaattattatatataatgtatcagatatattacaatggcatatggtagatttgtatccttttcaagtcttttaagtaaaatattacgtatcatgtattctatcctcttgtattgctgtattacaactctaaaagtaacagatgaatgccttcttttttttatacagtttactaaaactttagtagactggtcagaaaatagcccccattttctgatgtggacatcgtaattcccacaatctgtgaatatattattttatttggcaaaaggggaattagggttgcaggtgcaaaagattgctaatcatctgaacttgagatggcattatccttcattatttgggtacagctaatctagtcacataagtccttataaatagaagaagagggaaaagagagtcagagggatgcacgagagactcgaccccctgttgctatctttgaagatggaacaagaagttcatgagccaaagaatgtggtagcctctacaagcttgaatggcaaggaaagggattctttcctagagcctccagaaaggaatgtcatccagtccaatacctggccttgatcttagcatattaagacccatgtcaacactcctgacatgcaaaactgtaaggtaataaatttacgttgttttaagcaactaaatttgtgatagtttgttatggcaaaatagagaactgctacatttagcaaaacataatgtactctatgactttaaaattatcttcccattgtttcagtttagcactaaatatttattgattttccatgacgttccaagcttgtgctagattctagggacataaaaatgagcaagtcacatttcccagttcctttgttttcatcattgttgctttaaaaacactggatggatttcaacattagaatatttcctgaaagtatgacatatttgttttagtaaggttacaattcttacttctgcatctcctgcctttaaaaatttatacataaaagtagaagtcacaatgagatgaattagacacataaagtttaaatgtacctaataacatctaatatgatgtcataaaatttccttttataataactatttgcattaagtttaaaggttatatttataactgtagagtggtgatattccataaagctttcatattgctatagatgcccaacctttggctacaaaaaaaatttgaaagtattcattgcaaggagacagtctacttgcaaataatatatacttaatgtgtaatgtaaggtcttcaccactgatattccctatgtttccctcccatagtttgctattgtcgtaattctgtcacataagaaatggtattttactatcattgctgtaggccagaggttggcaagcattttctgtaaaggactgcctaatatatatttttgattttgtgagtccctcactctctctctttgcaaccactcagctctatccttatagtgtgaaaatggttataagcaatagatagacaaatatatagatgaattggcctgtaaaaggcaagatttggccgatgggtcatagtttgctgatcactcttttcaataatcagttgtttttcacagtgattaaaagtaagaatgttttttacatttattccatttctactgttccccatccatattttaatgtagatccaagtgtatgtctaatatcatattctttctctcttaaaaatttcttttatcttgttttactggtctccttgcaatgaatattttcaaattttgtttgtagcctttattttgaaagatgtttcatcacctatggaattctcaatgggcaggttttaggggattgttttcttttggaattttgaaaatgtattccatttctttttttcttctttttcttcagtctttcatggtttctgatgagtagtctgccgtaatttaaaaaaatctttttatatcctcattttcttggatggatatgttttgttgttgctgttgttgttttctggctgcatttaatttttttctttttttcttttttctattttgttttttagcagtctaaacatggtatggttacttgttactcctgttattttttgttatttatccttcttggtgttctctgaatttttaatctgttgctttgtgtcttttattaattttgctaaattcttagtgattattgttattgttttatgagatggagtcccaccctgtcgcccaggctggagtgcagtggcctgatctcagctcactgtcactgcaacctctgcctcctgggttcaagcaattctcctgcctcaccctcccaagtagctgggactacagatgtgctccaccacgcgtagctaatttttgtacttttagtagagacaaggtttcaccatgttgtccagtatggtctcgatctcctgagctcgttatccacctgcctgggcctcccaaagtgctaggattacaggcgtcagccaccgtgtccagcctgattattttttcaaataaacctcctacttctgggtttccaattacatgtgtactagaactttgatatttatctcgcaactgttaaatgcattgttctattgttttccccagtcttttttctcattatggtaatttggataaggtaatttcttttgacttgccttgaagtttcctgattatctcctcagctctgttaatgagcctattaaaggcattaattcatctttttaagtagtctttcattcctggcatttctgttttatttgttcttatagttcccatatctctgctgaaatttgccagatcttgtgtgttagctactttgtccattagatcctttaagatattcattacagtaattttatattctctctctgatgattccaacgtatctcatttgtgagtctgtttctattgattgctttgtttcttgtcagtgaattgtttttcttgcttttttttctgtaccttgtaaaattttgttaaaagtatgtcaccctgggtaagatagtgaaaattgtgttacgtctagaaatgagcttgcctttttttctcttaaagctttagtttgaaagaatgtttgagatgttcaaaagaagctctaaatttcctatgaacacataacaagttttctggggctcaaggtatccaaatttatccatcattatactgtcttcttgttattaagtgttatttataatcactttttaggtgttttactctgcatgatgcattctctcatttgtgctttttaaaacaggccttatcctacattttacagatgtggaaacttaagtaaaataacttacctaaagatactcatctatcaaataacagaataagaactcgattctctaggcctatctgatttttataccctatattcttaactgttatcctatttgaatgcatcactttactaacaacaaaaaaaattgactatcaattatattgaaggtcctgtaataagtggcatggaggggtgacatgagcaacatgacatgagtttttgcatttagtttgctaatatttcaagaatggacttcaaagagcatcctagagtttgctaagcaattaggatgacagaaatacagagtaatagattttacttataagtgatactcagttggcttattttatagacacttctctggttactatcaaggattcactgccattgtaaattcccaacactcctcagaagtacgacaatcactggcgtggttcccaggctagtatttattcagtgccacagtccagaagacactgtataatgattaattgggctgtggatcacagtatagggatagaattagatatctggaagtcataattgatgcaataaagaagctgaaatataacaacattgtaagggagaagaaagaacattcctccaaagccatagagtatacttgcaaagaggataaaagaggaagagaaattactagaccaagaatgggatggttaatttattaggagaatcagaataatatggcagcgctatccagtagaattttctgtgatgatgaaaatattctctatctgtgctgcctaaaacagtagatacatagtcatatgtggctattgaacacttgaaacgtagctagttgagtgtgcaagaaaacttaattcttttaaattttaatttatatggtagatatgggtattattttggagagcataggactagaatgtaatcaagcttgaggaagagagtaaagaaatggtggaatggagatgatagtataaagatggaaaagactggctgggtgtggtggctcacgcctgtaatcccagcactttgggaggccgaggtgggaggatcaggagatcaggagatcaagaccatcctggccaacatggtgaaaccccatctctactaaaaatacaaaaattagccaggtgtggtggtgggtgcctgtaatcccagaggagggattctatctgtaatcgatagaatgaggcaggagaatcacttgaacctgggaggcggaggttgcagtgagctgagattgtgccactgcactccagcctggcaacagagcaagattccgtctcaaaaaaaaaaagcaaaagctcatgtgtgtgtacatgtgtatgtgcgtgctaggagaggggtatggttgaagagggagggaaaaatgtgagggaaaaaacagagaatgttgtagttaaaggaacgaatatttcttgaatactgtagtctagtaagtggaattttatgtgtgtacttaaaatatatcctgaaaggtaagaataatctgtgttttgatggtgaggccacagaagcaagaagttaacttgcccttagttcatgtagctgataagtggtgagatatttgaatacatgttcaaagcgcatgcatattctactatactgccctgcctctcacaaaaagaaatagaagagtggtagatgaattaggaaaagggcaaaagtaatgattttctgcatttttaaaggtaagtgctttttatcttttttaaactatgaaggtaatttttagaagtgtgtgtaatggcgatacctgaagttgttgcatgttgctgttgtcttgtttctgccaattcttgtgcatggtgttttattctttgtgttcttaattatctttgattgtatactatttattgttctttatgaaatactttttgtaaataatttgaggcccaggaagaagatgccttcctccagaaaggattttcttttgcttctgcctggtgactgtttagaataccatttctggttaccttaaattaggtctaaagctagaggattgtacaagcattgtgaacctgcagtttaattcactgcttttgagagttggtttacttgtaccaattttgcttggggcaaacagacctccttgctcacttatctttctggtttcacattttcccttcaatttggccaggacatttcttactctcttcagctctttaagacattttctccccgtgttttatataataataatggttattttcatggagagtgcttggtttactattagaccaactgttattttagactagtctgctattattagaaacaggaatcttgttttgtttttacttttatggaagaatgttttgcttataattttcatgtgattcatagcataatctttctgttgtttaatattttttcttattttgttcctttcattttctgcataaaataattttttcgtaggtcccatgttgagaaaactttttgttgtcattcttattttcattggtgatattcttcttataagctgggctagtaatcttacaagattgtaagtgatcgcttataaaatgttggattgtctccagacacttttctcaccagcatttctctctaggatatgccttcctctggctagccagtttccctaaagcctcatatgttataggttattttttctatgtttcgttctagttgccattcttattttcagagtggataggggacataaggattatttttccattaactttgattttgttgtcctagatgggacttacttatttgtacatggcggctagcacaaaacttaggtcttaaaatttagttctccagcagtttcttaccttcaatttcttaatttccatatgcttctcttttggtaccattattatttatttctctgccttaaagagtctgtttatttatctagaaatttgtgcaatctttctaatgactgtccatttctttgtatacgtaatgaggctttgaattaattcatcttaaatattccgtctccagttagtgattttcatgtaatttatgcttctaacacataatttatcagttcaaaaataagtaggcaggcactacagagaggaacagtaattattttactatgttagaatcttctgttaaaaggtattgatctacacaaaaacagcatataaatgtttatagcagttttactcataatgggcaaaaattggaagcaaccaagatgtccttcattaggtgaatgtataaaataaatacaatggcatattatgcagcagtaaaaagaaatgagctatcaagttatgaaaaggtatgaaggaacctaaaaattcaagttgctaaatgaatgaagccagttctaaaaagctacatactttgtaattccaactatatgaccttctggaaaaggcaaaattataggcagcaaaaagcttagttattggcaggggtgagggggagagggaacggggatgaatcagtatagcacaggaggtttatagagctggtaaaactagtttttcagctactctaatggagagcatatggtataatagatttgtcaaaacctgtcgaactgtacaacacaaagtgtcaaccctgatgtaaactatggactttagtgaataaaaatctttcaatattgggtcatcaattgtagcaaatgaaagatgttaattataggagaaaccgtgtggagggttggggcaggtaggaggaagagtatatgagaactccatattttctttgctatttttatgtaaacctaaaacttactctaaaatgtaaagtctgttcacttttacaaaagcttattaatgcctgataaagaggtcataaatattgacaaagtgatcaaatagccatatgtattctgaaggaacttaacaaaaccacctcgtataaatatgttcttctattgttaactctttggtacttactgtgcctttttaagaatatctgcattcatgttcttgtcttttccctttctttttggtcttttctattaggtgtactagccctctcttggtacccacctgatgtaaatgatgaaaatggagaacctactgataacttggtacccactattttggataaagctcataaatataacctaaaggtattttattttattttcaagctatacataagttaattcttttggacaagaggagagtaataacaatttttgaaatagtaattttaattaaaaatgataatgacttagaatcttttaaatactatatttcataaagaaaatttctataataggaatttcaatcttatctaaattatattttagagattctttactatgtttctaatgttttatttttttatagtagaaagggattgaaaggttcttttgtgaagataatatagtagtgaagatttatatgtctaaatatcttagatgtcaaaaatctaaaaacaagtattaaccatgtaactttgcatatttataaagtagttaaaaaataaacttgctcaaatatttttcaaaatccaattttcatttaaaccttatttaatgtgcatacacatacacacctgagtaaatatagaatacagcagaaagatcaagtatatttgatgcagaaattaatgtgtgttgcaaatgagggaacacttctgacagtcttaagattttatttcttttagaaattaatgaatcatggaaacaaataggagtgatgattaaaagtatttaaatagcactacaaaagaaaattttatactgaatagcaagtaaataagcactgtttttaatatccaaagatacattttaaaaattggtcatgtattaggtagcaacattaattctaataaattcataaaaattataaccatagagtctgcattctctgaccacattcagtaccatggaatgttaataattaagtccaaaccatttagaaagtataaaattattaaaattttaataacataattgagaataactctgaaatttaagtgatataaatagcactgagattattgcattatcaataccaatgggacctaaataataagacatagtagaagaaagaactatgatagatgaagtgtgaaattaattaaatagtatacaagtccttcaaaatcagtagtctggataaattaatctttactattgtccacttttggggaaaaaacaataggcaagccattggtgagattaaaaaagaaaagaaattgagaaaacatatcagcaaaaattgaaaagaaatatacctatagtttcagaagagagtttaagattttatatcagtctatttaaaatttatatggtagttttataggaaaatactaaaattaattttttttggtgcagaaagaggtttaaagaatctgaattgactatcctagaaaaaaacgtataaaagataattgaacaaatgtcttccccaaagtgtcaggtttacctctcagttgtattcagaatagttgatttttatgataactgaaatacagtgtcaagtatactcactatctattgctgcataacaaattattccaaaacttggtagcttaaaacaataaacatttgttacctcacacaatttctaagggtcaagcatctggaagtggcttatttgggagtgtctggttcagggtctctgaaggaggttacaggcaagctattggctggtgctgtagtcatctgaggctagaggatccactaacagactttctcatgtggtggatgacagacctcagttctttgcagcaggtgaactggagactctgtacttctatatatgggcctccagcttcactagagtgaaagatctgagagagagtctaatataggggctacagggttgtttttgtttgttttgttttttgacataaatcttggcaatgacgtgttaatacttctgtcccattctgttgttttatctacggataaaacaaccatggcacaatgtgggagggaactgcaaagttatgaataccaggagatgggtatcggggggccatcttgaagaatggcaaccacagaaaacttccaaatttattccacaatagcacaatttttatttaaaactaagaaaggatagaacaagaaagagacagactaatcttaccaatgaaaatagattcaaaattcctagagggaattttgagaagaagtgtttattagcaaggatttaagaatggttccaatcatatgaaatctgaatctaaattcaggtctgcattcaatcctggctcaaccaccttgtagctttataaatgacttgtgtctcagcttcttcatctctaaaatagaaatagcaacaaaaccttccttacacacagaatggttataaagattatattagataatatatgtaaaacatagattgctgtctggcacagagtaagcactaagtaaataaaacttcattgattatttaaagaaggtaaaacatggttatcttaagagatactgaaaattttaggaaataaaaattcattgttaatgaagtccttagtaaccaaagttctttagcttgataaagggtgtctcttagtatcttatttcaaacactatatctgatggatatactacacctgtagtcccagctactactcaggaggctgaggcatgagaattgcttgaacctgggaggcagagattgcagtgagctgagattggtgccactgcactccagcctgggcgacagagtgagagtctatctcaaaaaaaaaaaaaaaagtgatgtaggttcttttaactagagaccactctgagattgcaaccactcttaaaatttgctgaagctttttatttgctctgtaacttcttgcagttatattctaatggaggacaatctggtttgtccaatactggtaattgagccctgtaagatatgttatggaccactgttgaaatatttcgtttcaaataaaaatgtgaaacattagttttgtcttaattttccttttgcagcctagagattgagtagttattggagaatagaaatggaactgtagggagtgagaaagagctaaataggcaagcatttttttatttctgtccataaagctgcctcttctttctgatttactatcctgaaactgttaagacagcatctctcaaattagctgtctagcaagagctgtcacctgccatgtcccttggtgcctttcagtgagttcttattggcatttgaaatctgcaaataggcaagcctccaggttctggtgcccaggctgaggttgggtaagtgattgatttatcttccacaaaacaagcccaagagctgcttttctgtccaggccctgccaaaatcctggaagatggaagctcaagaaactggctattttagtactttcaggaagttttgaaagagaaaatgaaaatgttatgatatatgaggattggttggctttttctcctgtttaaagtgtctgtgtagagaaggagagtgtggcaaagagctcgaccactaattgcctatttaatgttgccagcatacttgatctctctgtgctagggattttatatctaatgatcagaaaaacttggaacacgatagactaatgttttccaaaatttttagaacagtttcttggcctcgtgtatggtgaggaactatgtatagacaaagaatagacctggaatcatgagactggagcttgttctaactgagtagctctggaatcttatattagttccttgatcttcttggcttatccccttcatttgtacaatgacaatgaaaccataagatagttttattggatttgtctatgatttctgttgttgtggaacagacatttttcctaactcaataaaatgcagtaaatcctgtttttttaaagaatggaaaactttcccttttcttgctaatataaggaaattttaatatgtttaatgaatgacagtaccttactagaattattcagtgtgctaaggcaatctgataggaaaagattaatgatgttgtagattgtgtgctgacaaattggagcctccaatgcacataactgaccacatctaaaacttttaagtgtaaaatgcgttcattagtaacatctcttttttcttgctagtcttcaaagcatggaaatactaaatggatggagaatttttagggaatgaatccgtctcacagttaaacttttgttatagttcattcattttgattatataatgtttttactaatattagtcattaaatattttgtaattgtaattttgatttgttaacttcaaccaagagttattttaagtaagtgccttttaaattataaacaaacatgcaagaaaaggaaatgattggtgctttagttatttttcattatctttagcaaatgtgactaggtttttttttggaagtgtaaatgagtgaaactaaaatttaaatcttgatttttcaaagcgatttagtttctgttcttttaaagtatacttgtctgcatgtttgctagagcaaaggctgttgcacttataactgtcatttagtaggctggttttgcagagagtgtaaaaatcagggctggattccttcctctatatcctgcaccattaagaacacagcaacggaacaattttttgagtaagacatgacagaaatatttggtagattccgtcattgtttagcaaataatctggttttccttcccctgcatgcaaagagtaagtatacttcctgccctgttgttgttgggtttggccttatggcttgctttggctgatgagatgtgagaagagataatgtatactatgtgcttgcatgattatgctcttattctcttttataagaaaagcatgcccctttctgcctaggactcagaatgacagacacgtggagctgatttgaaccagcctggagcagaaccatcataagccagttcatagattttatgttcgaaaagcaaatgtttgtcttttagagccactgagattgtggggttgttacatggcattatctaatcaaaacttgactgaattaaatcattcatctaagtaaaagaaaattaggcagattcagtgattttttttttttttttttttttttttttgcttaggattataggggaaagaaccaactcagccctggtgatcttctttcattttaataaatttagtatgttattttaaagtagcatattttctttctactttatgcagaaatcacatttcttatactaggtttatcaacatccattatttctttgcatatggctctagagtcattttatctgcttttcaggcttatgcagatttcaaccatgtgaaacatgaatataagtatgtccgtgattcttttttaaatgattttcacctacatttgaaacatgttatattagtcatggcctctcctttttctttttccttgttaaatgaatattgtgaattcatggcagaaactttgggaatcttacctaaatccagtataagtgacagacttaagagtttaactgttgtttgtttttgcatgcaaatcattagtccatttatttatgcatgcattcattcatttagcacctgctacgtgtcagatacagtcccagatgctgacaatattaagaagaaggatgaagtattatctctttccctaaaatgccttgtaatctactggaggtcagacacaaagacaagtaaatttcaggaagagaaaagtatgaggtattatggcaccacataggagtaggaagacctacctcaattttgttgtggcaggggataggggagtgtgcaggggtgaaggtagagaatagagttggagaaggagaaagttatcagattttcattcaaaaaagttcattttattaaaatttatttattaaagttattaaaatgcagggtagggaagagacaggaaaggtcaaaattaaaaacatgaaatgagggaatgtttatattcttattctttaaagataagaaagacatttcattttatgtatagaattctgttattttaaaatttattttaacattgatctaattgatttttccaaatggaatagagagatggagactagatcacatcattaattaaaattgcaaagtaatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaattgcaaagtaattttattataattaagaaattagaaatacatgagggaaaattttaaatattttatacttatcaatactatatttactttaaatatattgatctgcgctttacaaaaatagcatgctatttgttgtttgcagctgtaaaagcaaattcattttgatataggatatttcaagttggatattgcttaaatatggtgtcctttatgtataaaatggaaatttagaaaacacagtgatgtaactgaaggaagaattacccaaggaaacattatgtaatagtatgaaaatacctatacactaggcaatttgctttcaactgaatttaaaaagcaaataccaaagttattgagaaatctagctgccctagcagttactaccctggcaatactaacaatatgctgcaaaaattaatttgaccttagttttttatgacagaaacttacttttataatattactgtaatctcatttaaagtagaaaattatattttttttaaatattatttaactttaaaattaattatgtgaaaacaagtagcactgattaatgtaaaatacattttgctttaattgggtaattgaaaacagaggagtttcatattgcaatagaagtctctagttccataaatacatcatagagcctgaaacctaaaattaaaacagtatcaatacatttattagactgccataaagatttttagttgatgttggtaagtcagtaaaactaggaataaaagtgaaaatcctcattctttgttttatgaatctgaaatagattgtcatctaagagaagtatcttctgtattttttaccttactagttagaagtagcatacagaatggttttactagccataattagtttgtcttgatttatgtatagccaaccttaagttaaaaaattttagtctgtgcacagtattttaaaaatatttgtaattactgctctctatgtttacatatatatatataatgtatgtatgtgtgcgtatatatgtatgtaggtgtgtgtgtgtgtgtgtgtgtgtgtgtgtgtgtatgggatatccaaaccataaatacctaggcatcatgaaaaatgtcctttataacactagtggatattatttttaagcgatttcattataaattctttaatagaagttaatgtatattattttgtaaaatgctgttttaatgatatggaagaatttatatgtaaataaatttgctaatgacttctatttaaatttaagcttaatggtcacatgcctgaaaaaaatccagatttttctggaccatatttttttggtctttttcctaaaagaaacatatatctgaatatagagtatttcctatatatattatatgggatacaaatatgtaagaaacatttttataaggagtaaacataaaaagaagcattgcacagcagttaagcatttgaactcggaattcagatcatcaatattacctccaacaaactgggtgacctggaacaacttactgaacctttcttaaggttctgtctatctttgattacctcactaagaaaacagaaataccttagggagttgtgaagattaaccaagataataatataaaatgtttagcatgttatttagcagtaaattttattggtaaaaattctctggtagtttctgtgttcaataaatattcatctttaattaaggtgattaaatcagttactttattaaatatattaagtatacttctaattttacattatagataatttatcccctaactgattttattgtttgttttaggttacttttcacatagaaccatatagcaatcgagatgatcaaaacatgtacaaaaatgtcaagtatattatagacaagtgagtttcttcaatatttataaatattgttatattatccagtgataattattgttttaagaatagtacattaaattatatttgagatttgaatgatttatgattattccatttttaataaaattaaattgttattgtaatgaatgtcaccatcatttcgaagaacattgctgaagtttcttataattcactttctttttggaagattgctgtttttactgttttacaggtttataggctatttatgatttctgtagttttgatattttaaaatgacattattttctaaaccttcagaatatagctttatctttttaaaaagaaggttcagattattaaaagtgaactacttcttttaacacagtagacccagagctgatattttcatttatatctagcctgatcaaaaagaatttattaatacagttttcattttttgaaagaattttactgataatagtctgtgacagatgccatagtcttacaaagaaacttgtcagcaacagtagaacatttatcactgatagataaaaaagcagtttaggtattatgtagagtattatttataatgtagagacataggctttttatggcattagtcatcatttgtaaacctcaatatgagatggttaatacttgtttggtaatgcatccagtatctcattttctaatgtgtaaaattaaaaatgcatttttaattattacacttacacaactgattcccctaagaaatggagcagtgtgctcaaactgcactgactccttcattttcagtaaacagtttttgtctgtggcaaattagttgtgaatattcatttcacttttatatatgcttattttctagatatggaaatcatccggccttttacaggtacaagacgaagactggcaatgctcttcctatgttttatgtctatgattcctatattaccaagcctgaaaaatgggccaatctgttaaccacctcagggtctcggagtattcgcaattctccttatgatggactgtttattgcccttctggtagaagaaaaacataagtatgatattcttcaaagtggttttgatggaatttacacatattttgccacaaatggctttacttatggctcatcacatcagaattgggctagcctaaaattattttgtgataaatacaacttaatatttatcccaagtgtgggcccaggatacatagataccagcatccgtccatggaacacgcaaaacactcggaaccgaatcaatgggaagtattatgaaattggtctgagtgccgcacttcagacacgccccagcttaatttctatcacctcttttaatgagtggcatgaaggaactcagattgaaaaagctgttcccaaaagaaccagtaatacagtgtacctagattaccgtcctcataaaccaggtctttacctagaactgactcgcaagtggtctgaaaaatacagtaaggaaagagcaacttatgcattagatcgccagctgcctgtttcttaatgcattgattaaagtttaatagttatcaaaatcacctaatttttaaaaatagctttcgttttgagttctggaaagaaaactgtcaaaatcagtatatactattagttatatttaaaaatatttttttaaattctttacagataatattatacttgttacccttcacaataccacatgagaaaatatctgagacaaaatgtatacaaatatattccttatggcataatttattgcatttctgactgaaatcaaaattctgatttgatggcaattgaattttcattttacaatagataaatgcttgtgctacctaaagcacttagcacacagttaaattatatttacatcctagacccaaataaataggattgtgtgtatatttgggatatctattgaagaaaaaaagaaaaccccttaaagataatgtacatgcttcatgtcatgtctttaaaataatttaatcaactttattgtcttagtatttagactctggataactctacaataatgaggaaattcttaagaataacaaaatcactgtaccttcctctcaattttgctgtgaacctgaaatggctttaaattaatactcttattttttatttaatttaattacataaattaaaccttaccatgaccaaattgtgttaggacggcctgctatctacagcacagtgtgtcatttgcagatttgtggttacctataccacgctaggtgttttgacatgtttagtgtttctgctttacagtgctgaattccatattttagaagctatgaaagtccttttatgaaaaagttactgattgcttctcagttattaggaaaacagttgtttcacaattattatgtagatatgatgcccaaatatcatttttagtatatcttgtcgatctttaagttgttactattgtgttattcatgtctttaaatcagataccaaatattttttaggaaagaaaaatgttattactgtcattaggttgtcttttaatactttaagttattttgacgaaaagtaatagagaaaatttacttagcattttagattctagagacatggaaatgaaaattattttatgtctagagtaggtcctgaagtttggctttacattaagtttagcactgtatcagaatgaagaaactaatattttacataaaaactaatactttcaattttttatatagtaatatccccattttgtaaatgttagacttttatcatacctgtaagttaaaatacttgttatcaataacttgtcatgttgtgacaaattgatcacttgtgtacgaaaaataaatctccttaaaaactaaataaaatgcactgtattcttacagttaatgtttataactatagtaaaaaattaatatatatcctattacataaatgttatttcttaggtgttccattaagaagagcaatagaataatgctaaaaaataatgcctataaatcttcagagtataaagacatccattcagaaacaaaaattagcactaaattttttataaaatagaccagatgacaaaatttattttatttttaaacagtggttttgacacaaattatgttattgaaaagcattattaatgtttaatttatttaaaattttggaatttgccatttctcagagaatgatcaggccttaggaaattaatacagtagtagtaatcattttctaggggaaaataaaagaataaatcactatactgatattttgatacaagcaagcacttacatggtaatcactatatagatccaacctgtggattttcttcttatgtccatttaactagaatatattattttaggtataatttacaaatgtcacacctaataatcttttataatataccatatttcattaaagttttgttagagaagtatctaccacagaggagtttttgtcattgtgtacgttgtgtatttgaacccaccatgacagaaagtaaattttaggaaatagttatgagattaagggaaaatctataaaaacaaggttagcatattctcaacacagataccaccactttctttttcccattatagacatggtgaatccacacagcatacttcatctctgagctttgttgtgattcctcaacacattaccctaaccagccagcagtaacagatttcagagtaagataaagcagattctgtcttcattgcaaaaagttattctcaatggaagaatggcatctgatctcataattactagtttatattaatatagtttttttctccctttttaataaaataattacagtcatccctcagtgtctgtgggggattggttccagttacccctatagataccaaaatctgcagatgctcaagtccctgatataaactggcatagtagttgcatataatctatgcacatcctcctgtatacattaagtcatctctagattatttataacacttaatacaatgtaaatgctatgtagttgttataccatactggttagtgaataattacatgaaaaaaaagagtctgtacatcttcagagtttcagtcggcaatttcttggccatggatgtagaacctacagataaggtgagccaactgcattaggaaataactctaataattctgttaattcttagagaggaaaactttcaaaatcttcctcaggtatttattacaactgcctttaccattttagttgtaacacagtttaaattgttatgataacaagtaaataagagcaaagaatgtatttcttaattcaaaactatacgtttgaattcaatatggtataacttaaagtggtataatacatacaatgcatgaatcataatggattcttttataagttattaatttttatggtttaatcagtctaattgttttgactgttatagaaaccaaatattttactgtttcttttaaggactaatattgtcaaaaactgctgttattaacttcacttgagttgtttaacttccttctgttttaagattgtaattaaaaattactattttgttatatggaatggttaatttttacctaataaaaacatagatgaaatacattg

SEQ ID NO: 1604 - DNA, 1193571 bp, Homo sapiens
cgctcgcagtttcgccctctcttccgctaatgattgcattattatgctcccctctctggggggtctcgcccctcttgggtcgctccggagccccggcctcccctggctgcatttcttaaaaatttgggagcctgggagtgagttttctccgaggcgtgtgtgagaggcggcgggggtgttttcctgcgcgaggggcgggtgaagttcattgcccccacttttcccgcgacctttttcggacccgattttggatcgagttgaggggggcgcgggcgttttcggggggcggggggcgcggcggagaatggccgcggggagggctccccggagcctcccagtctcttgatcaaagcattccgctattctgatttattgcttgcttggtgagttatttttttttcctctaaaggagacctgtgtgttcagccattactttgctcggcgctgctcccaggcatctccgaccctcggtgctgtggggagccccacacttgggctcctcgcctctcgccctcgctccccgtccctcctcccctctctccgccccttcccccttttctttctcctctctttcttcccctctctcccttctttcggccgccgtctcccccgcgccctcctcggggcggagggaagccgtgaagggggagggagggctcggtgtcaatttttttttgtgtggctgcggccgtagcctgtggcgggcaagcggggagaccccggcgcagcagaaccatggatggcccgacgcggggccatggactccgcaaaaagcggcggtcgcggtcgcagcgagaccgggagaggcgctcccggggcgggctgggggccggcgcggccggcggcggcggggctggccggacccgggcgctctcactcgcctcgtcgtcgggctccgacaaggaagacaatgggaagcccccgtcctccgccccgtcccggcccagacccccgcggaggaagcggagagagtccacctcggcagaagaggacatcattgatggatttgccatgaccagctttgtcacttttgaagcgctggaggtaagggggaccccccttcccccgggttccctttatgcacgaccccactcggctgcgcccggctctcctgcctccctcgccgcgctccgggctgtctgtctgtctgtctgtctgtctgtctgtctaggctgaggtcttattgttggtggggggagctgggggcgcgggcagacaggcagcaggagggagtcgcaaagccgtgcctggtctcgtttcctcgctcgcctttcccctgcgccccctccctgcaccccctccacagcagatgggcagaaagaaaggggttcgggcatcacaacaatgcgccccctctccacagagagctctgcccccactccttcctcctctccctccccaatcatggcttcttggctggtggaagtctctttgctgggtttggggcgcctgtggacggttctgtgtgctttctacagagtcatatgttcgtgtgtgtgtgtgtgtgtgtgtgtgtgtgtgtgtctgtgtagtatatacctttcccgggtgtcctcgggactggagactgatggggttttgtgatttctttgcgcctccccccattacccccccatattctttttttttttttttttttggtgaagctggggaagggggcgttttctcctggttgggagaaaggagggaggaggggagagaagagggaagggtggaatagctctctgtattctgtatggggttctgttacagaaagggttaattataatattatctatacacatacataggcacatgtgtgtgtgtacatgagcaatttagttaaaggacagaaaaaggtacaccagggaagactggtgggagggaagaataaaatcctagctgctatctgaagggcttgtcaccaattgtccctctccctttccttttttgtgttttcttttttttctttctaagtgattggctttgtgtgtgtctatgtgtgtgtctttctttattccttgggcacctgcagcgttgattttcaaatgcacattttccttccagccaactggctcctagggtagggggaaagggaaaagggagggagggggagactgtccagggttggggggaaactgtctttgcctggacctgtctcctttggtgtggtattggtcattggcctctataaatttaaccgcctaatttcctcccccacctccctgtccccaccccccacacaccatgcacacacacacagaaggctttgagattctgcagagttggtccacctttcttaagcacaaaaccaagatacggtttatagttggcttatagtgtttcatgcacctgatgtgatggtttgaggttcctgaaggaaacttttccctttccatttttttttttgcgttattatggtattgtttcacatgctcagatgcaagctttgttaatgacagcttaaatctcacatacggtaactgtacaggtttagattgctggttctgtttatgtgtttgggtgtcagctttaaatatttttttcaaaggaaggcttcctatcagtgttgtccttttctgtgtgaactgcttttggtttgggctgctggtggtgatggtggtggatggtggccagtggttgggagtaagggaggtattggtggtggtggtggtggtgcaggtggtggtgatggtgatgttggtggtattggtggtggtcgtagattttgatgttagtgattgaatcagttactctctggttctagaattggtgctttattggccaaaattttgagtgttgaggttcaccacttattagaataattccaactgtggctttaagtttgccaaggtgggtggtggttaccatacagtgtgacctctttctgtctctctctcttgttttaaaataggagttgaaatggcagcatgttcctattagaacatgctgcttggaatttggttcatcattgctgtctgtggttgttttggaaagtacttgtaagagctggttacaagtggttctgctttctgcatggttatcctgagctcagcaatcaagaggggccactggattcccacgaacatttttggaggacaagtagggatatatgtgtgtgtgtatatatatatatatatatatgtgtgtgtgtgtgtgtgtgtgtgtgtgtgtgtgtgtgtgtgtgtgtgtgtgtatatctcacttatgcagttctttttgatggttttatttttaacaaataggtatttgactgggcttgtgatatatatctatttatttggcttttgcgagaaaatgtgctcattttaatttattttgtgcctaaaaaacttgtaattttaaaagcagaccaagttcaaaatgtacagttaataccatttctttctttgctctgattatttttttctgctacttttctagattaaaatccaggatattttggttagctgaatactatgtcaccttcatatctaaatatcatatgtctatctatgtgtaggtagaaaaggtctaacttttaaaaaagtttacttaaaattctgtagaaaaaattaaacatacagaagtagacagaacacccaacatccaggtttgagaactaccaactcatatctcatcttgtattttctatatttcatctatttcctctcccacatatgatctcatccatatttctcacacagaaatacttctgtatgaatccctaaaccataatgactccaaaaatcctcagaccccaccaaaacccgcacagcagtattatcacacttaaatgaatgtataacagttcactaatatcaaatatcctgtcagtgtttacattttaagaggcccaacttttgtagggaagccgtaaatacatttgtcagattaaaaacacacaatgggaaatagaaatcatcatatatgtctggttctttggcaaaaggtagttttgttggctgtgtgctatcacattgtgtccatgctggatggtcagaacatatgtgttagtgattgttaaattaaaacctctggtggtccactctattcagtctggaagatttattgaactatcaccaagaaatgtgagggcttattgggaacaggcaactaaactatgagcttggacaaaaatgtgtgttgggggagtgtttgtaaaagttaagaattattatagatgctaagagttatcctaaatacgtagtatgttttcgggccttgtgtttagaaatgaaatcagttgtcaccacatgtcattaaggctgctgctggtatgatattgtgaaaagaaaccagaaatattggcttgcacagctaggtttatagcttgtgccagttcagagcaatagctggcaaacagtggagtagcatactttgtgtgttaatggacacattatttgactccatgattttgttctgagtagctggttttggacttctcttttaaaaaagaggctcctaactcattatgaaatgtgctaatataaatagttccagttcaactgattttactgatactggagtaaaagtgataacttgcctaatgagaacctgcatttttatcttgattattttttgctgttgttggattcttttttgagatgatgaaagctttaggggtagtttgacaagtctcacattttataggcagtgaaactggctgaaacagtttcatattcacagggacacttctcttgagtaattgtgccctgaagttcaagtgtatgattatgaagagcctcatgatagaagataagagggtaggcgaggaggctaaagttgaacatggtgttcttttcattatgcagttgagaagcagaattaacgttggtatatagtatattgtttgtttggatattcttcgagtgacaggatgagagcaaaaatccccagataagatgtctagttttcttaaaaagtggcttttagcaaagtataaatgggaatgttggggtcctactaccatcagtgtgtcctgatgtgttagatagtgttggctttctgctatttgggttttttttctgtgttgtgtctattaggaagccacgtgagtaccatggctgaaaacttgactttgcaaatccattatttttcccctcattcctcttttgtgcactgggttcttagggcagcctccttttgtacagctgaccaagggaagctaagatgaaatttgtggaattagcagaaaagaggccaattggagctttataggcttatgaaagtaaaggaagactcatttctagtggttagagcatcaaaccaagactttgatgcggtcttcacttcctggctctgttttcagggcttcccccacacatcagtagcataagtgggctatacagaatttggtgtacttataacatgccatgttaataggctctcacaatttattatggtcaaatcactttagttgtttaaaaaacaacatgagtcacatgccttctgtcagtctgcagatatttatggagtgcttaatatgtacaaggcactaagaatatagagaaaccaaacataaatctagcgttttgagaaagtatgtagtttagttgataaagccagcacctatgaaataattttgaaacaggtacttgaatgcctgatatcaactaagcgccataggcttttagagacaggctagtgagataggctgaagtgttccagaaggcttcatgggtggggaatgggacctagaagggtgaagtgatttggatatatggggaaggagttggagctagggagagcattctaaaggaataatgaaggcacaggaacaagatgctacatggttaggacttgggggcaaggaaaggctggtggaaatgagtacaaaggtggtaagtaaagagtgcttgttagtggggcaggagacctgtggagacccacatgccaggcttggcctgcctaactagtgtggcctttgaaagttaactttctaaaagcatcatttcctttatccattagtggagaggtttaaactagtttagagtaaagcttctcaagctggaagggaacatagctttacaggatgttcataaattgttttttagtctgaaacagagtgatctaccgccaaatagtttctgaaacttgatgggctagacaaaattaaatggatgccatgttctgtcagaattaaaagtctattgtgtgaatgtgaattttgaatatcagagaaggcaatgtgttgtgcctaatttcctaaatctattttgaccacagagcacttttattctctgcattgtaatctataatccagtatgggaaatactagaaaggatccaaaaaagtccctccagatcttggaatctggtgatctctgagtctggggtgagtgggctgatggtagacgacttggaaaaccaggcacagaagcttgtagtcggtgcgtgggagctgcttcttaagcaggagtggcaaggggagtgaaagtgaggaagatgtaaacagtgagggagactagtccatgtcttttcctgctcccctttcctgcctgacatctgcctttttactgattgttaccaaccccaccaggaggtgaatattggtgagtggttctcattaatagctctttcagtgtgatgatactagcccaattctgatgccaccaagctgcccttcagccaatgttttatcctctttgtcccttctggtttcatatattgctgctctttggcaacctgtaaaaaaaggttggttgggaaaggaggttgacattgatgttaaaacaacgatttcaaattatctgcctttggcttgctgtatatgaagtggtagttcaaaaaagggtcagaaccgctcttttgctgttacatagccaggaaaagctgtggaactgtgtttctgttgcatttttcactttcttttttggaaaatttggccatgggactgtaaaataaatgggtcagttccagcatttgacttctgaaagtatgcatagctttaggatctgagaagggatgagagaatttggaggaaaggaagggtgtgaatagtgtgtgtggttatgaattcaagtattttactgtacttactgagtttcattattttactttataaggcagagcatcacttgaggagtatttatgtgagatgtggttgaacgttgtgatatgatgattccatgcagcttttgttaattgtggagattaactacttgcaccttttttttggaattagaatgtaaatgaatccgtgaatttaaaaaatgaattatgaggttaggaattgagcctttgatcctgagagtagtgttctgtagttctcactgttgaaaaagggttaagaaaacagaacagtaaacatgattcaaggagtgttgagggtgatagattctgagactcttctacaccacagttttatgtattatcaaagataaatggtgattatttagttttaaagaatgttaggattagaaatgaggtccccagatggacacaacaatagttgaggctagctattaggaataatttaggtctaagagctacgagatttggaagcctttggacgagaaggtctgtggcatttcgggtgtttgtgtatgtgtgcacgcacctgtgtgcacgcaaagggtgaaggatggtgggttagtggctttacattttattttattttacccctatcctgtatagtagtcataatatactaaatgcagcctaactttgtaaaagtgtttcatgctgtttttttcctcctcaagaagcaacttttttttttctttcagaattaggattaaacccaatatgctgcagatgtaggataaagaacctagtaatgggagagcaactgttaattttagaaagttctgaaaagattcaggtagatttgaaaacttagatcattgaagtttagaagagcaatatgataatgaatttggtaaaacttgagacaggagaagatcaaaaataattagtgagctggggcagaactgttttctcttatataatcagaacctgttccatgaatgtagacttttttcccctctgggaggtgaagaggacatagaatttaagactggtgagaccctaagtgtgtcttctttcttccaaatctgagctgtgttctccttcgtttcttctaacacaatagcagagtaatgatagtttctattatagctttgcatctgttggtatgcaattaatacatactgtgaggtcacaaagaataggccctttttatgctattagtatgaggaggggaggagtgagttttctagaatttgactgcccctgcttgtttaggaagaaactagacaagtacaggcttctgtgtcttagtcctgttcaggtctctgattccatccattgcaaggggctctggaccctgaaatcatatgaattggtgccttctttgaaggtgtttatttcatatattagtgtatgtggctctcttagggtccagttagattccccgctcacctgctgcccacctccctcctttcctccctttctctctccttcatatccttcttctttctctctcttcctttactgaggtagagctatcaaaattatgaatgctgttaataaaaggtaatgcatttaggacattgtgtatgaaacgcagaaattcaaaaatttttaaatttcattatttgaactgtgacaatctgcttgaggaactctaatttagctctctaaaggtgaattgcttgccacagttttcttggccattacagctcacttttctaatttctcagcttatgtctgaattctagttagtttgtttgccagagcaaaccttataaatgatcaactacatacaaatatttttaaaatgacttaactgtcattttagcttgcactatacctcacggtgccatacccccttgttacctctggagccctggaaaacccatgtgcagtaaaatggagtcacaagagaaaagcccacagtttgtaagtaatggaaaattgctaatgcaagttgggattcatttttggcaaaaagtctttaaattgcaagtattgtgtggctgctattaactgaagcacagcctgcaaatatagattgtgactcttggttacatgggtgaaatctgatattttctttcttttattttgtttttttgagacagtgtctttctttggttgcccaggctggagtgcagtggtatgctcatggctcactgcagccccaaccttcctgggctcaggtgatcttcccacctcaccctcccaagtgctgggactacaggtgcatgccagcatgcccagctaattatgtattttttgtagagatagagttttgccatgttgcccaggctggtttcaaactcctgggctcaagcaatccaccctcctcagcctcccacaatgctgggattacagacgtgaggcactgcacccggcaagaaatctgatattttcaaactgtggctaagttctaaacctgagactgagttttagtcattgccagggacaagttgtgatgacgcctgagggatctcattttccttgttgtccccacacctaccctcgtctgcagcacaaaatctcattttaagtttttgtaaagtttctgatggcagtaatattttagaacttaaaaggaggaattaagagattacagtcccatattataagtatttcttagttgttatgttgaagtagacttcttttttcttgttttcttctagatctctttgttcagttatactcgttggctaaaggttgctggttaaatgttgtttagcgaaatattctatagttaaaatctttacaaagaaaaaagtaagaatgaagatgtggatagcacaataattgaacattagattattacttgttttctagccacatgatagaaattgcagtgacttccacccattctgtctgtacatgttcagttggcaaagagaatgaaggtcctggaccgtgcttttctaagaaatgattttatatagttgacattatactttcactggagcaaaaagggaaacaagcatttgattagtgtgtcttactgcatattgtggtctgctccctcatttgttacggtggtcactatgattgcttgacaattacagttttgagattaatatgcagagctaaatctttaggaggtatcctaaagttaggacctaaactttttcatagcagccttttgatccattttattccagccattgctagttgatgtgctttctaagccgtgtggcatcagaggcacagatgttgtctttagtgatgtagttctacctctcattttgcaaatgaaaacaacagcccacaggggttaattgacctgttcaagatcacactgggagttagaggctctcactgttaccctatgaatctaggagtctgcttcttgtaagttagtactggggagtcccaaggattgggaaccttggaaggagattttttaaaaacaaaaagtcttactacaaatgtggatgagcacccatgattgtaaagcttcccatttcagctaagaaatgttctgatttacacaatatcaagaacctttaaaaagcgttgttctctccctgcgctctctcccagtgtatcaccctgaaattagttggcctttctctgtaggtacattcatcgtttttaaacactgcctcccacctcccttttataaggatgtaaaataaaaaaataaatattagggtggtttctcatcattgaatgtctagtggaaagataaaataattatttggaagtaagatgaccttaatgtggcccatgtaaaatttttaacataatttctttgtgtaaaatattttctttagcctagcaatctgtggaaactcagagcaacttcataacattggtagcaggatgtatggagtgagtgaactttggagtatagtggagttgaaggctcaacgaaaattttcttcgaggaaatacttaaaatattaaatccacatgacgtgttgactaaggcatcttgtctgttcattgctgaaccagaacatttataacaactgtttctcatgtgtatgtattcatagccattcatataatgaaaagaagttttcatgggattgtaataacatatcaagatggatgtaattaaaacagaagcagattgacaccctgaattaaatgtaaaccataaaccaggatacctgagcattgtgccttacatatttgctgtagggggcagtcagccaaatatgcaaataaaaagacattgatgaatcttcctgggtgtgtatgtggttgcagagaacccaactattttattaatcttttatcaagcattgtttagatttgcagcagccatggaatgtattaatttggcagaccaaatagcttaggaccagaaagtaggaaataataaagggaagacatgattgatacgctgtcctataaataacacatgcgactgacaaaggggctgagtaatctttagatctgtgcttcatttcattaatggagttgttaaaccaggatgtttgagttgaacttcaatcagagaggctctgcctcccatttaaaatgcaggcctacctctactcactctctggactgatatgttgacaaaattggtgtaaatcgaatttttgtaaattggatcaaatgcactaggggaatcttgctgtgaaaaatatgagtcctttttatcaactatagtactcctcctctctgcagggaggctgggattttggtggagtgagtctcttcagatgggcattgcttcctctgagacagtttcctgcacgtgttcccggtgctctgttccccgtgctcctggaagacagtgactgtgagatttgcattttttcttcaggttttatacctcacttggtcggtgcttccaggaataattggtggtgatttgaataagcccgcatcattcagatttcagagcttggttttcaagtgcttgctaaggagggctcccagctatgaatatggaatatgatttccatatctgttccattggggagtccaggcgtgtcataaccacttcagagtcatgattgtatcgagacaccctagctgtaatttttctatatgacagttcagttttaaaattgtaaagatgccaaaagcagggctgcattgttattagggaagtcagtgacatctgttatatcttgttaaccaggggaggaaaatgctttaatcaaaacatctaattataccctatgaactgatgaaatatcctttgctaaatttttggaattggccttaatggaagaagctggcctctatcagaactgtgaagtaaatttaccctttttatttggaaaaatatttattcctaaccatagtgacataagggtattttaattgtatcagattacttttatatgtctgttgaaaatagttatttttcagaagttgttcaagccagcatcacgtttttgtttttgtgctctctgactcccttagcatatgaggcccccagagggagtttgtatttccagatgtgagcctaggaggatatgtggtgtcttagagccacctggggagggagcaaatgataattgcaggtgagatgcagggggataattcagcctgtgtgctgggaggtgcgatttcacacctgaatgttgagacctgctgtgttagacacttgtgttgttttaaaatgttttattactctaatatagaaatggaccagattgttccaggtcaccttcagttgaaagaatataaatgtttttaaatattgaagtataatgtgattccagaaatggttcctgtgtttaaaagtagttttacatatatctgaaagcattaaaatctgtttaactcagcatgtctatactgcctctacctctgttgatcattttttaaaaattgtaggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaattgtaaattattttggcaatgtggctttccactttgaatcattcaagcttcaaactgtccagtaaaactatccttttatctatatttcaaaactagaattaattttaactatagctgttagttgtttccagaatcactgacgatgattataatattaatgatagtacattattgatagtcttaatgctgggatatggattatttctgagaaatgattaggtctgagaaatgctttatttcttagttttgggggtatttcatctttctgacatggttttcccatgtatggagatcttggggcccacctgaaggagttttttgaagtgttgactgtgacactatgggcttcatgtttactttgggatctggtgggaagttcaagtgctattaatttttccttggtctgttttatgctttgtaatggctttctgtgtgttttttgggagttaagactagaaccttggaaaagagagagccagagttttctccctatatttctattttaaaacttttttttttttagacatgttctcgctctgttgcccaggctggagtacagtggcgcagtcatggctcactgcagcctcgacctcctgggctgaagtgatcttctcacctcagcctcctgagtagctgggaccacaggcgcgtctcaccacgcctggctaatttattatttgtagagacggagtcttcctatgttgcttaggctggtcttgacctcctgggcttaagcgatcctcccatcttggcctctcaaaagtgctgggattataggcatgagccactgcgcagcattttatttcttatgtattgttattctctctgtattctctgcctaaatgtaacccctgcactctttctgtatatatccttctggggatatttgaggctttcagaactgtttctttcttcactcagtaatctatgcatagtaggtactcagtcattgcttatttacagttgacaacaattccatgaaaagaaatttttgaagagggagctgctatttactattcgccttgtgccaggcattgtgctagcaattttgcattcgttatcccattgacgcaccccatgaaaaaaagaataataatctctgtttgatagttgaagaaactgaagcacagagccgttaaatcaacttggccaggatcagtataagagaggcaagaaatgtagcagtttttgcctgacttgaaagcttgggctccttatccctttactcattttcatacagatgcattttgtgaaagatggccacatggtctctagtagaccacatttgttcattgttgtgctgaaaattgttacaaaggattttctaggtataataataggatttagggaggggagagtacttattgtccaggtctttatttcctttgaaaagttggagcttacagttaggttgctgccactcatacaatatatctgtaacatattcgttgttgttttttctctgtttcactgtttctccctgttataaaatctgaccttttcccgggttatactactcaggtagattttaaaccattgtcaaaggcaaggattcaggctgatgatatagagggttattgtatgtcagtgtctgttctaaacccttgcactcatttatctcactgaattctaaaagtagctctctggaacacaaatgtaaaattggaatgaggactagcatgccctcacagattactgtgcatataagcttatattctgctatagattctgaagtattttgtcttgtctgcttttaaactgttctaggaagcagcacttgtcttgagaatctatttcacaataaaagagaccttgttttgagggctaggtgtatttttttaaaatctattaggaactctattctttctggtaaaagaccacactaaatagctctttttgcttttcttgatatctgtatcttgaagataccaggtgacaaatagtccattgatttcctctgtcattgtttcctttcattattctaagcagatttgcaaattgttctctcccatttcccattccaccctgttaaggtttgtttatgctacaaagagtatgctaatgaatataactgttagatttacttcttaaggaaatcccaactgcatttagagtactgtacatttttgagaaggctcctcctcatttcccctcggctaagatgggcctcctcacaggtcattctctgggacttcacgattcagaactggtccattaccattcatttacaaggaatgggggttagtataaagatacacacacagaataccctcactgggcctgaattttctaaagatttctagatgaatatgaagatcagtcaagttacacacttctctcaagagtcactctccgtctctttctttctttctttctttctttctttctttctttctttctttctttctttttttaagagatgggatctcactctgtttcccaggctggagtgcagcagtaatcatagctcactgcatcctgaaactcctggcctcaagcgatcctcctgctgcagcctcctgaggacctgttggtgtgtgtcaccatgcctggctaattttttaatttttttttgtagagacagggtcttgctgtgttgcccaggcattctcaaactcctgggctcaagtgatcctcctgcctcagcctcccaggtagctgggactgcaggtgtgaaccactacccctgctaattttttttggaggggtagaaatggggtcttgcaatgttacccaggctgatctagaactcctggtctcaagtgcttctcctgccttcacctcccagaatgctgggattacaggtgtgagccactgcgcccatctgagtgtccgtatgaagagaggtggcagtttcttcttggaatcaccatgctctgagacacacagtcttgcctttctctctccaactgtctcaataaacacaattgcccctttgtatgtcccgaatggaaataccatactagaattctattttacagattgtaattgttggggagacccaagtcaaaacatgttctttgaaatttaaatataactgtaaaaggaaccacaaagtctagggctttaaaggtgatcttttatgctttgattttatgtatttgtaaaatacaagttctatattgactctagggcctgtctcagattgtaaacccttagatagtaactgtgtctttttaactgttccttgtatccttccttgcccctctggtggtctataatacccctgttgtgatgattttgattaaagaaacatagtgtgaagatgggctgtcagggatgggtgtcagtttcacttcagggtagtgggtgccatctattttctgattacaggtgaacattactttagcattatttttttttgagacagagtcttgctctatcgcccaggctggagtgcagtggcatgatcttggcctactgcaacctctgccttctgggtttaagcgattctcctgcctcagcctcccgagtagctgggattacaggtgcccaccaccacacctggctaatttttgtatttttagtagagacaggatttctccatgttggccaggttggtctcgaactcctgacctcaggtgatctgcctgcctcagcctcccaaagtgctgggattataggtgtgagccactgcatccggcctattttagcattcttgttgtagatttctacatctgctgcccatatttcagctgtactcttattttgtttagtatggtgtacctgggattagggacagacaaatatgtatgctcagcctgatttggaaattacattgttgaaatacagcccatatggccattgtaaaatggttagtgctgcatataattgcctttccaatgatgtgctttgtcattacttccatcttccaagaagcactcctgtagcatgctgacagcaatagcatcattagaaaacatatggacatgcaaaggcattaaatcgtctttagtttaaggattagattacagtgttagaggataggtcaccaggcttgcaatcgatgactcttgcttagttcagcactgctagactggatgatagagatttgcaaaagtcctatttacttgtctgctgagtgtatttcatatcttccctgcaattgtgagaaggtcctttagctgtgtataagcctctatcacagtattgcagccagttggcttctcaggagtgtttttttcaactattcatgtcctgtgcagaattcttttctaggatgctccctcaacctctgtttttctgaatgtgagcccaaagcaggctaagccaggaattattttatttgggggtcatttagatataaaaagagactaagtggtggagtcaagaaagtaccaggtggctgccatgttgcccaaatatttcctcccttgtacagcatctatctccacatgggtctcaagtccacctcccttcttcctttcccctcttagaagcaatgggattattgcagcctagaggctcagtggtaggtcctagaggccgagggaccatgtgatagagcctggaaagagaccaccccctgaatcctgccctttgtagttggatgttttttccccccacaactagataggtttactatctggctgtaaatattctagggatgcaacagttgtgggacatggtatgatttgaattttcagggtcctttttgtagttgccagtgaatagtaagtgaaatcgcagaatggaacatcattcatcaaatttaatatttcttctttggagtttaacagaaataatgtggatttggggactttcagagtgataagggactttggagatcctcatgggcagtggttttgggtacctcagggtacgctgagtcatttgaggggagatcctgactttattaaatcagaactccacctttacctgtcttctatatttatacttatgtattaggattacattctctttgagaagaaaaaagtgtctggatttgtttattctttcattcaaaaaaaatttattgacagcttctgtgtgctaggcaggcagtactccaggcacaggaagtaccatagtaaattagaaaaaatagatatctattttaatggagtttatattctaacaaaggatggggggacatactgtaaataaacaaatatataatatgttgggaggtgacaggggattttataaagcagggtaaagcaagagtgagaacttagcacagcaggtcctcaaataacattgattcttttcattataatgttgatgagaaaaaaaattgattcctggccagggcaactgtgtggagtttgcaccatctcctcatgtatggtaaaattgctttcattatgcatcgtgtcacgtatttaactgaggactcacttgtatgtgtatgcttacgtgatgctttatccagggtgggttagataaggctcctctgaggaggtgatatttgagcagaaacttgaaggaagcgagggagcaagaaatacagataacccggaggagagctttcaaggaaaggggagaacaagtgtaaaggctttgaggaagaaggagtggcatggtatgtgagcaacacaggagatgttggcggctggaacaaagccattgaggaggggacagagagtggggaggggcctgcagtcactttaactgagtgacgccagaagcttagaaacagcagaaagcaactgtccaaagccctcatttcccaactgaaagtgtttttgaatttccccaaggtcacccagctgatgtataaacaagagcacatctggagctcacgttatattcttttaaagtagcttctcattgtaccttgtgccaccactccaggtcttaggagacatggggcatctttttggagacaagatttgtgtctcctttcctgttagtgggtatggctcctccaagagatgtgcttcaagactctacagaattccagtgcccagtcatcacaaagtgggaaacggctttgccagtgccagaatcaccaccatttggggaattattttaaccacaatggctcatgtttatcacaggcttactgcttgtgatgtttgttgtacccagagctttacatgcattaacacatctaaccctcacaacaactctgtataataggtcacattatcattattttagagatgaggaaattgaggtgcagagaagttaagtaatttctgtatggtcatgcagatagagttgtagagttgggatttgaatttagactatttgcttcagggcctgcactgagcctctgacaaagaggagggggatgagcttgtctctagataaactaattggaatatgctcccctcgcctccattttaagatggttctaggtagggcctagccttgggagtaataccaacttgtcacaacccacttctgtgactccaggtgttagtttgtgtagaggatttcacagccagtctggctcagtactggcaactttgctgattttaggtggattcctgattcagcaggtacctttggtctttctgagctgagtttgactggagcgtttttcaagacctgcatgagagtgtgttacggaatacaggccagtgttttcaagtcagcggacccagttttagctggtctgtcttttttagccccagtgaagtaaaagccccagacaccaccagtgcccataatccataggaatgtaaaatcatctttttagtactggtgcttttgaggaccagtacactatgtgcttgctttaaatttgtctaaaaatgtatgcatatgtagatatgtgtatatatgactatgaaatattttctaggtatggaaaagtataaagcataacatagccaacacccatgtacccaccaccaactttaaaaaaccttatgactttactgtaattttcttaaaattgtaggttatttttagtgagcaggaaccacagtcaaccgtaagttttagagtccaggaggctcaaacctggccacacattagaataccctggggataccctggggagctttaaaaaagtccttgtacctctgggagggtgcaggaagcccccacctctatcatcagaattttaaaaagctccccaaggcgaggattctatcatgcagtcagggtaagagacctgctgtttggagggttgtgtttggtttttcttcactgggttctcagatgcctggtaccaagccatgtgtggtactcctggactttatatttcattttcttaaagcattttttaatgtggttctactttcaagattctggagggtaatgtcctggggagttcctctccttagactcttccctcttcagcaccttatgaggcaagctgcggatatatttacatattcattacaaagcataagcatcaggaacttagagagtaggagtgaggcattagagaggggactaagaaattcagaagtattgggagctactgtctgttgaaagtgtttgagatgagtgaaagttatagcattaccttggaagtcagggggatgcagggttacatttagaaaacctggagtcacacataccttcacaggaaggctctgagctgtgggatggtagttgagggcctttttggtctacatcacaggtttatcagtgaaatatgtggtaagatgtacaaataagatgtgccccaccaccagaatgatcagttctgtgtggacacgtccgtgactgtaccctctttcagaagtgctatcaattatgtgttatgtgtggcctgattatcctctgtgggccttggctccatgcagcacctccatccccgtctgcccactcattcattcaacaaatagttgctgagtttctcttctctatgccaggttctgttctaggcacttgggataaaaacagtgaactaaacaaagcttctgccctcaaggaatgacattctggggatgtgggggagaggtgggtgagtgggtggtgttacattctggtgtcgcattgttttttgatgtgtctaacacagaaaaagatgtgtaactgtaatcctcctttagaaagctctaggggagccatttggcaggtagggaagtgttttgcctaatttggcttaaattatgattttttgattctgaggattttgattacaaatgccttcatgaatctacttcttcaagagaaattaagtgctgagacattaaagcttccagggaccttttgaattggttggattttattagcagcttaaaatgagcatgacatacagtaaggttcaagcttaggggagatgctgaagaaataaggatacttgattttctttccacttgaagtggaatccactaatccatctgtgctcataaatttgagagaaggagggcggaaaacgaaagtttatttctagggctctctactgggcaaggctatcaggttaccttcattgaaaagacttaatcagaagtgaaacttaaatctgttacagtcttccacagctgtccagggaattgggcactgatgaataccgtcagatggacccctgaatagagggaatgccttagaggtcatgtttggagttagtcaataaaatggatctcgagaagaaaatagaaagtttgagggaaaaaaattactggaaaagaaatcttaaagcttttgggttagatgttagatggatgacgaaaacagtgggtgatatgatttcctttctggattaccatcttcatcagatattgttgtcgactacagaaaaaatattcccagcacgtaaggactctttatacctgtgagctcttaaaaagaatcatctaaaatactaaaaaagcaagaatatgttgtttcactagcttttgattcctaaagtagattttgacttccgggtgtgggaaggtgggtggaaaatgagtttttgttaatattcaaaggcatgaaaacatttttaccagtttatgttttcctggtgcatttagaaatctgtggatccttggggatggtgtatgcaggcaaatagagaatccagtacttgtgaatctgcctgaatccacaggtttgggaataagggcagggacttgagggttcacagatgtgaaggttgtacacagaactcatgcagagagatacaagatctttttgttccccctttgattagaaagaataggacatgaaagtacttaattgtcaacttcgtcttcaccataagcccagtattgatgcaaaaatgataataataatgagaacaagcatttattgagtattgggtattctaattgcttaaatcaactcatgtaattctcacagagtggttctatgaggttggtgccgttttgattcctgttttaaaggagaggaaacaggcacatagagtttacacccaaggacgagtgtgtcagtggtggagcctatacattctggctccagaacccgacttgaaccactacataagggaactaaataaatgcttcttaagagttttattctgatgttgcttttactgggactttcactcttttttctacccaacccaccccacccctaccccactcgcctccactttatctttggatgtcttcagaatctataatatatcttaagcttgcaccttattacagatgagaaaatagagagctataaaattatgttatataattgttctgtatgacctagtgaatctttggtagaacagggatgtggaacccaggttttctaatatttaggtcactgctttttctcactgcactgtatggcttccattaaaaatattttaaactaactgaactaaaaatttataaacttaatttgtgtcactcatacttctgtggatgaactacattaaaataactaggtgctgtgagattttgctctagggaggagggtggtagacattttaggagctaacatttgcctctggggttatttgacctcctcctgaggatgtctttctaatctttggtaggcgtacttaaaagtgaggagaaagtatttgaggaaatacaagagccattcgcagactttagtatgatctgtgggtttatggaagggcttttttttttctttctttcttcatttaggccttttttactttaacctccagtggggacacaactaacttaaatcttaaaaacaaataaacaaacaaaaaccctaaatacaagccttctttcgctattgtttggcaaataagatttcacaagagggtagaaagaactgccttgattcttggtgttttagactttcctatagtctagttttttgtttttgtttgttttttcttttggtcctgtgattccttttgttgttacctgtttccttggctaatgctttgtttaaaaacaagtgctctggtattccaaaacaaatttccagcaggcttcccgattgtgttctcagataaaagaccccagggtagtgctttaacttgaattttggttgcctatgcatgcctgagagcaaaattcagtttactaggtggcttccaacccagattaatatggttatatctaaaacgagggaatatacatttgaaacaggaaatgtggattggatttaccctttcaaagagccctaatgtgaatgtaatgagtagagttttgtctggggttagatactgtgggctccagtttgtttttgagtttttagctgaatgaatgactttagtcctgtcattaaacctctggaaatttaaactttcaacaatgtaataatgataatgaaaatagggaaaggctcctagactgtgctgtggaaaaacacatgttcagattttactgaagacccagaatcccatgtggccacagataatttgatttcacagtttctatttctagatatacaggatggggttgccagcagaagttacatagtgataataacatatcagcttcctttttagggaagatattgtaattgtgagaaaaatattcagaaaagccttggccaaatattgtttgtagttggtaagagaatactcagttattaaagcttctgcgaaccttttccaaataattacactttttccctaaaggaatcctcccacctcagcctcctaagtagttgggaccacaggtgctcattaccacacctggatgggtggatggatggagatatatatatatttgtagagacggagtctccttatgttgcctaggctgtgttacattttttgtcacacatgttgggtatggagaatttggagtaggtagtttcagatttgcacatcacaagttcttgccttgtgcagtggtttctaaaccgagttgcatatctatactccatggtaacttggtaaacatactgattcctggaccctgtgtctgatctactaaacattaatccctgctctgtggctctggaacattagtgttttgttttctttttggggtttgtgacagggggacaaggtctcgttctgtcacccaggctggaatgtagtgggacagtcatgactcactgcagtctcaaactcctgggctcaagcagttctcctgccttagcctcccaaaaagctgggactaccaccaccacgcccagcaatttttttttttttttttttttttttgcaggggtagagacagggtttcaccatgttgcccaggctggtcttgaactcctgggctcaaggaatctagctgcctgggcctctcacagtgctgggattatgggtgtgagacactgtgcctggcctggaacattagggttttttgtttgtttgtttgtttgtttttaacatcaagttccagtatagaagtttcagaaacactatttcttaaaatatttttgagtgttttcctggggcagtggtaatggtgatggtttacaataatttatttctatgctatgtaacttttctgaaaagaaaacattcctgtgtatttggttttaaaaccttatttactgtaaaatagaacacatcctggaaaaagtgtagtgtacagctcaatgaatgatccaatgaatgatcacaaagtgaatacccaggtaaccagtactcaggtaaagaaatagaacattgccccctccccacaaaaaatgatttttattagattcctcaaattttcttttctattcctcctcaaatcccaagaaattagagatataagtaaaggttgatgaaacaatataataaggtgtaagtgaaaaaagcattgtcttttggtaggtggtgtttcttaattactcttttcagtaagtttttggtgatgttaagtttgtgttgtttatctatgttttgattcagccttaagccagttcttgacagtgactgtctattaatgctcacagctgatattaagattacgttctaagatctatcttttctgcaatctgtttcactgaaaatattctcatgatagttttgaaaatgcgtaaggacagattatcttctgactctaataaacaagtgagtcttgtcattactgtccaggtaacttaggaaacctgtctcagtagccaggtatctttatctggtacatgataaaatgtggtttcttagttttttttaaaaaaagttccttcctcctctctatccacccagaataatctctcctccattccaacccaatcagaacatttaaagccctgatggtttttcttttttccactgaagaatcattcaattcttagtgagagaaggtctagctgtattaaatagcaagcttgcccattttctttggaaagggatgctcatggtaaaaggacctcaagcaaaccctgcacttaagctgtgtgcaagtggagggagagagctgtctgcagccacctgccagcagctacacatctgtgctctgctagcaagcatgtgggctctgtggatgtgagagctgctccctttcccctctctgcctcatgctcccccatcttagtgatcgccactatcaactaaacaggtgacaagactccaatcaccctgctctgaatggctctccatcttcccaaaagtataccagaggcctgttttgtttcagtacattgattaaataaatattcctgtgtgcacaaaggaactgaaatctgttatggcactctgcagttatctgtccattaatagtggagaaactactgccagttttctcccctcggtgcccccgccccccaccccctttcttgtcactaccacgcagattctcaaaggtgccagtaacagataaattatctgacctctgctttcaggcttgtgtgaagcgggaggagtggtgtcatgctctttggtgaggcatgccgttggggcagtgcccaagtgtatggataataggagagcccgaatgatttagattagaagatgctttcttgctttggggttgtgggacctttgtctctccccttcaattcttagcagaagcggactcagaaaggtctttcaaattagcttgcctctcttttataggaaaagggtgcttctggccctgaagtagttctgtgtgtctactgtcagatgtggaagccacaaagtgcctgtgaaacttggtcccttgcgtttatttacaagtttctttcaaatggcagtggcaggaaggatctttaccatttgggcagatagccctagtggttgatgggagggcttggtggaagggcaggctttgtgaaagatccaagtgtggaatggtaggaattctagccatggtggtgctgactggtttcctttcttttttggcggggcaggggctggggtggagtgttggttaaaagaacacctagataaaaaacatgacggatttcgaaagtgttatttgggctgcgcacggtggctcatacctgtaatcccaatactttgggaggctgaggctggaggatcccttgagtccaggggtttgagaccagcctgggaaaaacagtgagaccctgttctataaaaaatttaaaaattagctggatgtggtggcttacaatggtagtcctgtctactcgggaggctgaggcagtaggatcacctgagcccaggagattgaagctgcagtaagctgggattgcccactgtactccaacccgggtgccagagtggggctctgtctcaaagaagaaaagaaaagaaaaagacagggaagggaaagggaaggagaagaaagaatgacaatggaacataggaaattagggttgtagagaagactctatgaacattattgtggtgtgaaggaatggcatgcagagataagtgtgatggaagggaggtgttgaaatgtttacagctcctaacatctaccaccaaggagggggcacccctttgacagaaacgagagggtgttcctgagtagttgtgacattaaaaaaaattgcagggaaccttgtagctgcatggatggcagagacacataagtagggaaaaatgttggaataggtaaagtgaaatctcttagtgtgtgtgtcttccaactgactgtgggtaattagttggaaatgacattaacctgagcttaattgtaattttgcatagtaacaacataccagctgttcactgtattctttcctggaggtgcgatttaattattattatttttttttgctatcttttaagctccaattttctgttatgttttacttaaaccccgcctggttgccgtgtccacagtccccacagtttagcagtaatgtcatttttgttgctttcatgcccactgtgtgctgagggcttgggatgctcttgattttgctaatgacttggatttataaagggccacattggaaggtcactgagaagcatgggtgattggaaaccttgtgttttgggctcttccacaaggttttagtttattatataaatcatatgcataattctaggcctatcagaggtgctcaaagtatcaagtgaacaagctgaaagagaagttaattactgaacagtgattgttctgatataaccaattattggatcattaaatgtttattaccttttatatgctcctttcccccataagggcagtttcttttttaagtcattaaaacagaaatgggatcttaaaaaaattctgcttaaaaaatttccacgagactgaagtattaaaaaggtcttgtgtgatctgacagctaaatagcctgtttttctttggtctgttgaattagtaattaatgaaatgtattgcctgagcagagaaaataagattagttttgtttaggaagaaaacaaaagcaaaacattaacccccaaatgcaggttaatattaaagtgcagtataagaaatagaaataaaacagtcttcttgaatgataagatgcctaatggtaacatttgtttcattcattcattcgtcactttcttgagcaccaacattatgtttagaaggaatgggtttatgtaaatacagaggaggcaaggtgccctgtccccaaagacacatgggttagcagagcagttaaaccagacactttaggcggccaggcacagtggctcacacctgtaatcccagcactttgggaggctaaggtgggcggatccctgaggttgggagttgaaaaccagcctggccaacatggagaaaccctgtctctattaaaaatacaaaattagccaggcgtggtggcacatgcttgtaatcccagctacttgggaggccgaggcaggagaaacacttgaacccaggaggcggaggttgcggtgaactgagatcacgccattgcactccaacctggacaacaagagtgaaacgccgtctcaaaaaaaccccaaaaaaacaaacaaaaaaaaacaataaaaaaactcagacactttagtagctactgttgcaatgtagaaagtggtaggataataggtacaggggcatttctttggggaggagtggttatgaagacaggttacttctggaggctgaggcatcctgtggattaagagtaggggagagcatggttatgaagatgaatcttgctttttgaggtcacggtgtcctgtggattgagtagaagccccattacttgggttcacagcccagctttgccactacctagctgtgtgaccatttatctcagtttccttgtgtataaaatggaataatagtaatgcaaccctcacaggtttgaggattaaatgagttattatatgtgaagtgcatataacagtttacagcacataatgaacattataatcttaggttgtggttatgtcatttttgtgggataatgtgatagaacttcttaggggagattgcatttgattgaatgatgaggagcggaaagatgtttcaggcatttcttgtattgtcccatgtagccacatacctaatttataatgcctgcagtaatgtgtcggtaatgtgtgcttatgtagtgccattgtcaaaagattacaaagggcatttacagacgtttattctaagaacagtcccctgaaacgagatggtttatgcatattcttctgaagtgtgagagggtgcagagcaagcccatcctgttcttccattgaggtgtgcttggagcctgtgtttgttgtgggtaatttagactcacagagagaggaaacttttaaatcttttaaattatatcttaaattcttaagttatatttgcaaacaaatgtggtaaatagattttaaaaatgttttctgtagcttctagcaatagtggaacttgtttattcctgaggtaccagatcataggcagttgaatttagaggaagtttataataatgaacatttgtcgtaactgtgaggttgccactctgtattagttttcacactgctaaaaagaaattcctgaaactgggtaattttataaagaaaagaggtttaattggctcatcattccacaggctgtacaggaagcatggctggggaggcctcaggaaacttacatggtgaaagttgaaggggaagcaggcgtgtcttcatatggctagagcaggagaaagggagagggggagatgccacacttttaaacaagcagatctcatgagaactctttcacgagaacagcagcaaatggagaaatctgtcccccaggatccagtcacctcctaccaggccccacttccaacattaggggttacaattcaacatgagatttgggagggatacagacccaaactatatcttattatcctcattttacagtgaggaaaccgaggcactgagatgttcaggagtgttgctgaaatcaaaaagaagtgttgacccaggatctaaggtctttattgcatttgcgtaaaccatttcatttgatttgtgtgttttacaataaccctttgagaaaggtcagtcagctgctacgtgcattttgggaagtatcgtttatgagaagttggtggggcatcacagtgagcttagcatggactgaaaattttggggtggctgttgtatacccttttgctacttcaagcaagacacttttgggcctcaagatctataaaataacagagtttggaggaaacattgagtctgtaaactatgaaattcttgtgtagcttggagtgagacccatgtgggaatctttggcagccaccgtttaccaccttaacttttctgagcatgttttattattggtaatatggagctgtggtactccctttcttcagggctgttttgaacataatgcttataaaatacctgacagaccttgctagctctcagccaacggaggtgggattcttgttaattgtttcaaactaggggtcatacaggtagctgagcctgggtgagaagtccagcttcttaactcctctggggctggttctcttcagcacccaagccatattgctggggataaggaagacattttaatgagatgagccccaacttctcattagaagctgcagtcctgattctttctctagatcctatcaggttgccagttgatccagtaagtaatgtagtaaatgtaatggatccagtaaagagtttggggttttcatggagtaatttcctaaaatcaccgcagtcagtagcctgtgagccacatgagggcaggggacttgctctctgtggtgttcaccttgtataatgcaaggtgatgggacagctggcacatagttcggagtctggcagtatttattttgtgaaggaaggaaggaatgaacaacctcagtgagctgtagaaaatggtatgagaaagggaacaggatttttaaaatttcagttttgtgggacagaggaaattgaggcactgaatcaggcaggttatgcccagtctctgtggtcaccaggccttaaaattgggcataatttatacccttgaagatgttgcatggcaataccttctggtgggtggatcacctgaggtcaggagttcgagaccagcctggccaacatggaggggaaaccctgtctctactaaaatacaaaaattagccaggcgtagtggtgcacacctataatcccatctactctggaggctgagacaggagaatggcttgaactctggaggcggaggttgcagtgagccgagatcgtgccacttcactccagcctaggtgacagagcaagactctgtctcaaaacaaaaaccaaaaaacatatttctattgtgaaacaaaattttatccatgtcaggaatttcctctgaactagagtatgttcattcctcttttgtgatttgagtctgtgggagtcggaacttgtcaggaagacttagtgtagctgtgcttctaaggatgtgctattctcacaggcagccgtgctaaccatcttgctgtaaactagccacgagtaaacgtctggttgtgaatcacagcgtgacctttcagggaaaacaaaacaagcaaaccaccaaacacatgaatcagattttctttagtatcaggattgtaaagtctggtatttaacagtttgtcaggcccacttggagcagttgagacaacttcctttctctgtttttgtttgttcaagatgtggaagtgtatatccttctttagcaacatattaggataaaaactttaaagttttcttccactgagttaaactatattagttttcctaactgtcatggactttaaacaattaaagattcctggttaccactcaagacctactgaatcagtctcttggagtgggacccagaaatctattctgaagagcaccctaagtgattctatggttaatcagatttggaagccactgagatacagaatgataatattgtattttctatccacccatttattcttttttttttccttctctgtggtccgaatatccatttgttcttactcatttatccacgtcttgagtagattagaattgattacctatagggcattggtcattttaagaactaggcgtagaaacaagaggtagaacacaatgcctgccccatggggttcacaggtggtctcagaagtttttaactttgggttgagtgttaaaggattcacatacttcccaaaagccaggagcagaagattttgtgtacacacttttttttttttgttttaagctttcatcagattctccaaggggtcagtgacccataaaaggttaagaaccaaggtcttgtgcttgcacagctgttctggaaaaagtagaagagggcagtgtttctgttgccacttaagatgtttttgaccttttgagaggcaacagcggtttgaggactgtacctgttttctgtcctacttaaaatatttaaaaagaagaaaaaatagtttaacatctgggtcagggtcagaacaagaccaagggatatggaaaatagttatttcgtgaactgcatcacatttaatgttaaagagctgctgacagccaaacagcctggtggttagcgtgatggaggaacttcttaagctggatagcataggcaaggttcattccagttttcttacagtatataattagccaaattatggataacaattttcaccccatggatatacataaagactaattgtcttatttttgttccattttagccccagcatgtccattgaattgcttaattccaaaataactttgccagccgtacagctgatacattcttctttatcttctaaaatccccaaataacactgttcatagcaaaacagagttggatattaagaaagaacatctttaactgctgtggaaagtgtttactttgtaaaacactagaaccttgtatgtataatgttcttatccctaaggataactttataattgaatttcaattaaggatgttctcttccttttcctcctcctcttctctctaagttgtactcattgaattcatgtttcaatggggaacaaaaatttttcaaatattgttgttctggtaatgctgcattttaggatctggagagggcagtcagtgggattaaatgttatcaaataggttaaattatttggccatttactttggtatagttcctctggagctcaggaggatgttagaggtctttgttgtcagtgaaatcttgtaaatgtatttttaggctgttcaaatgtctggatcacctattttgaacttttgcatataccaccttacattacttatttttataaagtggacattttatctttataaggttttgccttgctggacagtgattatgtgttctaggtctttatagctttgccattacccggcatactgagcacataacagacactcaataaatatttgattaattggatatgttgattgggtacccaagaaaccagaagatgaaataagtctggagttagaacttgatacatgcttagaaaggtaggaacgtaaaagtggattatgaggtctatctcttaggctgacgtgctctcctttctccttccccatccctctccaccccctctcctcccttctctcttccatcctgcctctcctctccctccccctctcccctctcccctctcccctctgccttctcccctctcccctcttccctctctgttttctttctctttcctttccctttctctttccttaattttcttttctttctgttcatatataggtagtagagccagctcacgtttgctagttctttaaaaatcttaagtatttagaattccacagttacaagaattttatggtagagccacaacactaagttttcatttggaaaatgttaaatgtagtgaaccttgagagaggtttttattagttattgcttttatttatttttaaaataagtttcattgtgtatttgtaagatatataagattataggatgcatagagatagtaaaaaggttactatatatagtgaagcaaattaacatattcatcaccttacataggcaagagcagctaaaatctactcatttagcattaatcccaaatacagtacaattttattacctttagtcctcatgttgtacattaaatctctagacctgttcatcctacatctcctccatttccttcctacccctagtaaccactgttttgttctctgtctctgaatatttgaaaaaaatttttaagattccatatataagtgagatcatgcaatatttttttttctgtgtctggtttatttcacttagtacagtgtccttcaggctcatccacatttgtggcaaatggtaagattgagtttttttaagggctcaataatattcatacacacacacacccacccacacacacacaccccccacagtttatccatttgcctgtcgacagatgcttaggttgtctccatatcttatgaataatccttcagtgaacatgggagtgcagatatctttataagggggagatttcatttcttttgggtaaatgcccagaagagagattgctgggtcatatggaagttctatttttaatttctttagaaacctccatactatttttcacaatggctgtatcaaactacattcccaccaaccgtatacaagagttccttttctccactctttccaacatttgttatctttttactttttgatgtaagagctgtcctaatgggtgtgtagtggtatctcatgaaatggcattgatttgcatttccctgatgagtaatgatgttgagcaccttttcatatgtctattggcagttttatgttttctttggaaaaatgtctattcaggtcttttacccatttcaaaatcagattatttgtttttctactattgagttttgtgagttctttatacactttgcatattaactccttatcagatctagtttgcaaatattgtcttccaatttgtaggctgccatttcattggttatttcttttgctgtgcagaagccttttagtttgctgcagccccatatgtttagttttgcttttgtggtctgagcttttgttatgttatccaaaaaaatcattgccaagacaaagtccaggagtttttcccctgtattctcttctaggagttttattgtttctcgttagttagtgcttttaagaaggaaggaggcctcaccagacttgattattattttttttttttgagacggagtctcgctctgtggcccaggtgggagtgcagtggcgcaatctcggctcactgcaagctccgcctcccgggttcacgccattctcctgcctcagcctcccgagtagctgggactacaggcgcccgccatcacgcccggctaatttttttgtatttttagtagagacagggtttcaccgtgttagccaggatggtctcgatctcctgacctcgtgatccgcccgcctcggcctcccaaagtgctgggattacaagcgtgagccaccgcgcccggcccagacttgattattaaaagacatctgctactcaaatagatgccacccttaatctgtcctaatcaagtaaaatcttgttagttatatttgggtagaggaaatattgtaggctaatgaacagtggctgtcaacagttatcttgaaaatctagacttgtagccttgaaggagagggacccgaactgtgaagagatttgtcactaaccatgctatattggatgtaaacctgggagtggttacaggaggtggcttagggtaatatgtgctggcatctttaagtatttcgggaagagggatttagatccaagtggtcactcctactcccattggagacgcaatttggcattgtgtataaaagaagagtttttctaatagtgctgtgttagggtcctgaattccagctgctgccattcaaacaggctcacttaacactcacctggattattctaatgggaattcaaactgggtattggtgacctttgagggctctccctcccaaagagactatgagtgtgtgatttttcagggcaaaatgttctaagtaaatcaagtcatggttcaaagtctagatccgctccttgtaattttttttttttctttttaaagaactcagtcttgggtgctgtttacttcatatttaagcccatggtccccatgtgtattgaactggcacaaactaaacttgtctgctcctctaggtctcttctcatagtctgagttcttaaaattaaggtcagttaaaagaagcaccttggcattttccttattggagtttgctgtgtgtttgcaaatcaaaatgggaattgattcagtcatttgggctatacaggttttcatctcaagtcacttaagtgaaatccataaggaaagatgttcatgctttacctaccatagggctcactcacctcttttcttaaatacaaaacaaaaagcacctgccagttttaagggactgaaaaggtgttttatgatggctgaaaatacatctgagaataataatatagttatacctagactggtgatacatcattacagtatctgcggggaaaagtagagggtggaagtctgtatgtggggtcagtcttaacaaggaaagctgacatgaatgctctagccctgcagtaccagagggcacctggattaatgttctgggccctaattcagcgtcctgtctctcagacacttggcactgatttgctcatctcagagctgaagtcttaaggactaagaggagagaggaacacatcattttctctgccagaggaggtacttaaactgggaaaggaggaggagaccttaacaaatcaagccttggcaaggaaatctgtcatgaatcagcaatgccttggaaagcctctttcgctgtattttacaaagctaaacacttgtcgctactgacatttctctattgcttaccttgaggatcagctttaggtagcactatgaatggaatgaatccttttttgtgtgtgcccattttgacattaggtaattaatttacaactagctcaattagagtccagcccatacagtgtgtacatggccttttaaagagcctttgttttgacgctaattgaactggttgtagcagagacagccaaacaatttgcattcatctttggcagaacacaagggctctcccttggtatggacagccccattttttattccttctaccaagtctggcactaaagtgatgtgtgcttattttatttttctaatttaaaaaaactttgaagaggacaaaagccacataggtttattgtagaaaaattggaagacatagataagcaaggaagaaaataaagatcatacattatcttttcttcttaagacggagtctcaatctgtcgcccaggctggagtgcagtagagcaatctcggcttactgccgcctccacctcctggattcaagcgattctcctgctgcagcctcctgagtacgtagctaggattacaggtgtgtgccaccacacgtggctaatttttgtattttttgtagagatggggtttcaacatgttggccaggctggtctcgaactcctgacctcaagtgatccgcgcccccccccccccttggcctcccaaagtgctaggattacaggtgtgagtccccacacctggcctggagcacacattagcttaataccaagagaaaaccatttacaacctagtatttttctttctataccttttctgtatatgagggaatgcatgcacctgtgtatgtaactgttttcatgtgttgtttttacaaaatgggaacacagcatacaaactgttttgtagtatgcttttttttcctacttaataagatggaagtgccttgtcattttataaaatgttgtcctacaacatttttttttgagacggagtctcgttctgtcgcccaggctggagtacagtggcgcgatctcggctcactccaagttccgcctcccaggttcacgccattctcctgcctcagcctcctgagtagctgggactacaggcgcctgccaccacgtccggctaattttttgtatttttagtagagacggggtttcaccgtgttagccaggatggtctcgatctcctgacctcgtgatccacctgcctcggcctcccaaagtgctgggattacaggtgtgagccaccgcgcccggcctgtcctataacattttaaatgtctgcataatagtcaattgtgtggatgtaccaaaacatatttaaccaatctgttattattggacacttgagccctttccaggttttcgatgttataactagccttgtgatatatattcatgctactaaatctttgtgaagtcttaattatttgcaaccaataaatttctagatattgaattacttggacaggggcatgcatgttttaacattttttatgcatactgccaaattgcaacaatttccactttcagtaatgacagctttatgtttattcttgatattcaggagtacagtatagagagtattgactcagaagtggattaaatcctgatcagtgattttgctattgcccctgaaatttacgtcagccttataatcttctgttcccagtatcaggtgaaagaggccagtttatatcatatagtacaatataggtttacttatcttgactaatatgtgttatttagttttgaaaaattgtagaataaaagcaggtagctgctgctgtaagacaaaagtgcctttgtttttcgtaaggcaggattctgaaacagtgttttcactatgaataaggaccaacctaaataaatagatgaaaatcaaagcgatagtagatggttttgctaagtatatgaaaaaaatatttggatcttcttgaggcagtgaaacccaagactggaggagcaagatgaactgtggcatcttgtatcaggggtggccttggagaggctgttatacctcgtgtatgtggtctatcattgactgaacatttgttatgctgctcatgattgtatttgcagcacctgaaagtgcagttggacaaatagatgctcattgttgactgaatgaataaatgaatagaatagatacacaggagagtgagatttcagaaaaagacctttcaggtcatctaagaccctccccctaattttattttactttattttttgagacaggttcttgctctgtcacccagactggaatccagtggtgcattcacaactcactgcagcttcgaactcttaggctgaaatgatcctcctgcttcagcctcccaagtagctgggactacaggtgcatgccaccgtgcctggctaattttatttttttgtagagacaaggtcttgctttgctgcccaggctggtctcaaactcctggcctcaatcagtcctcctgcctcagcctcccaagtgctgggactacaggcgtgagccactgtgcttagcccatccagttttctaattaaagacatagaagttcagaaagatgaagtgacatctttctcaagactaagttaatgatcacagcagaagttgtagttctctgtatcaatgtatttctgagattctcatagtactagaattgtatgtttttcccttgatatggtactttgtatgattaaatttcaaaatcaatagtaaaattttaatttcaaatgcagtataagcacaatttccctaactcctctttttttcctctgtttggaaatagcctcagtttttgttaaaattcaacacagtcttaaacttgcatttcttttttccttactttctttctttctataatattttcacctatcctatttcattcacagtggaggttttaatttacttcaagcagtattgccatctggatgtcaaaagacattgaattgacttcttatctgtagatcccaataaaggtctcacctgcctagaaacaaaagatttagtcaggaattgaggaggagcaaagcaaaggcttcaccagaggcccaggtgctacctatctgcccacttgttctttgattgacagtggggcacagaggtgccttgtgtttctctaggaagtagcttttgcatacagtgtttgtttggaacttttcaatttgctagtgctgaataatgtctgcagtaaaagttggtttagggtaaacccggagaaaggaattaaagagaagttttaacatttctattgtttttcttctgtgactttagcctttcccccttcttagtgaattattatagagttttattaaaatgtaagttctggaaattagacaccatggtatttagaccagcatgggatactgtactcttaggttccataatatttcatagtacatctctttattgtatgttaaatgatagcgaagtataataaaatgcacctagagagtacttatctattttatgtcctgtaacattcagtacttgatgcaaatgtagcagatctcgattcaaacaggagcaaaactggttataactcaagagaaaggggataggctcatcttgatggaaagttccctgttggtggcataagttcagcaaaaccatagaatttgaggctctaagggacctttgtaacatctactccaatcttttattttgcagatggggaaagaattagccactggttcagtgtcactcagcaggttaaagaaagacctgtgggcagaacctagaacttaacgcctgctctgctgtgtcttttcattttctgatcacaattgaagcatgtggtctaccctgtctttaaaagagcataccatttgatgtttgttagcttgaaacctgttgtgcccaagggcacctaaaggcttccgtcttgctcccttttcctggatgcccaggtcattctgtgcctctgagggtgggtttggatatggctgaaatgaaagctgtgttgtggcagtgcttagagaattgtctctgatgataggactcttttaagaaagcagtgaaaaagcagtaaggagactgttacttcataaaacaattggctctggacttggagaagacccaggtggcggatggttacatcccttggcagcagctgtctttgctatatctcttacagtcttagagatctgggagtctttggctcttaattttaacctagattcactgtatgatcttggtcaaacgcctcacctcttgggcctcagttaccttgtagtaaattcaaggggagttaaagtggatgatttctatggcaacttccaggccttgaattattatttttataaaagtttttccacatgatcaagtaaccaaacatgtattgctgacagtccattttattactgttttgattggttttcatgagaatttggaaaatgtctgcagactttactgtgatcaggctgctagcaattatttacagagcacccatcaagtgttcagggctataaaagaaatagtgtctagcttcagggagacagaaagacttcttgatctccccagccggggatggagggcattctcttccactggatttaagctctgtgagtgcaggggctttgtctctcttaagtagtgcacagttcagtaaacattggttgcattaatgaaagaatgaatccagttgtcagtcttgcttatatttactgaagatatcccactgagatttattggtttcttcaacccgtaaatgctgctaacttgaatacatttcccagaaagtattccttaccttccatagaaaaatgcggccaggatgctctgaggctatagggaaaaaccataaatattccactcctttcttgaaattcaatttaatattagcatattgaatgccctgagattacctgccttcaaatattttggtttaacccagcatttttgaaattcatttgacctcagaatattgttcattccactctcccatgacacacttgttaatatcccccagaactttgatttgtaaaataaaaaggttgatatagggagtaataatatggaataaatagaagcagcaacattagttaagaataattaattgaacacaatggagcatatacattaagtgctgttcctagcagctctgtgtgaaactgtggtagacttgtagattttttttcttttaaaaatgactatctatgtctcattacagatacaaggttgggtggtagagagattgaaggaagttgcaagtgacctaatagctaatttacagttacggaagttgaatggtagcattttaacttgtgtcaagggctgccctgtcaggtactgcaggggaataacgatgaaagggagtctgtgtctgctccttctggagctggctgtccagtggaggagacagacatgtaaacagattatagcaataaagtactcaaatgtgtaatgaacagaaataggacacaggaaggaatggtattttcccctggtttagaacagggttgctgttcatacaataagcccaaaccacattaactggaacccctctagatcctccagacaaaattctactcatacatcaagattcaaacaactcggcctcttcatgctttcgctgatccagaattaattgcatcatctatattgcctgcagagccttgcttacacctgtgtcataggccttatcataatctgctttgtatgtgaattacttgagggcaggatagagttgtctttgtccctgtatctctggggcctgcagttacagcatggactgcatattcgctgctttgtttagacttggagcaagttattggactgtgaaagctactcactttaagtaaattcagtaaataaaattatgttttatggaagacagattggacaggtggtggtattattagcattttctctcaatgcttaaatatgatttacatttcaagatttcagttacattttttaaggaattcaacaattctgcatcatgaagtattctttcacacaaatgttccatagtcattagtttttacagaacccttttcttatattctgcatttcatctggaatactataagcacaagttcagtttggcattctgttctccactagtgattgagtttgaagcccaaggtcaggatattgattgatgacatttccctttaaagtatttgtatccatttgcaatttggggacagagtgattcccagtatggtgcaggaaataactaaactggaagtcagcctgactcagttttgtagttaattttctttgtgaccttgggcaagtcacttaaccttccaataactgagggagttggcccagaactagcacagtcttctaatgcagacattccacgattctctagggaggattcacttccatagaggtttaaaagtggatacatttttaggttaaatggctttgttcatttagtttttttctccttaacccattttggagcaataagactgtcatggagtaaaaccaaattacctggaactctcaaaaggctgcagttcttatcctattttttttatttttaagggaagggaaaaaaatggcaacaaacaaatttatatccatgagtcaggacaaatccatcccagttttctaacatacacagtgtacataaacatattcaatgaagcactgcagattcttaaccgaaaatggaatatttggtttgacttaccatcctaaatgtgggaagaactgtactttgatatatactttttgagtatttttagcaaaaattgatataagcagttgtcttggttggcaaggacttgtgtataggaacctggctcccagctcagtgacgagtgtattctgtaactttgaataagtcactgaacctttctagatgtcagtgtcctcagctgttagatttgatactgttctgattactaacagatctgtgattagacatttccatgcatttatttcaggcctcttcctgttctcttccttgagagattaacaaatatacccaccccttccctcacacagtctcaggcaattattgatttgtgagggaaaaggggtattttaaaacactttaaatgatacattcaagaaaattatctcgtattggttatcaattgatatataacaacattaccacaaacttagtgccttaaaataatacacatttattatcccacagtttctgtgagtcaggaggagtctgggcacttcttagttgggtcctttgcaaggctgcaatcaagatgttgtcctgggctggggtctcacttacacgcttgactatggaagcataagctactgagcccactgtgattgttggtggaacttatttccttgcagctggaggactagagggacttaatgtttttgctggctaggggctgccctttgctccttgaggccacccacatatccttgtaatgtgtgcttccctaacatggctgctggccccctcagaagcagcaagggagagaacaaggcagtgctgcagtcttttggaatgtaatcacataatcatgtatacataatcatgtatgtccatcatctttgctctactctggttaaaagcaagtcacaggtccctcccacgctcaaggtgagatgatcacacaagggcattgacaaccaggaggcaagggtcatgggggccgtctgaagcatctgtcagccacaccatatttcaggttttttttttttctgtatcttcctttggatctgtgaataagtatctcacttcatactaaagcctcaataaacactgattgacagaaagtctttgtgctcatttaaaacttctcagctccacagagtatttgtaccatgcccttgttttatggagtccccagatactgatgagggcagggtttgagtttgagggctgttcattcttctgcccgccaaccccccaccccgcccccagcacagaactgccagtgttaggtgctcattaagtgtttgtcaaaggattataactgttgttccaattgcagcagtaagtaaatttgaagaagctccctgatattgagtgaattgtattctccaccccccaaattcgtatgttgaagctctaacctccaatgtgatggtagtcccagctaccagagaggctgaggtgagaagattgcttgaagccctggagatgaggctgcagtgagccttgattgtgccactgcactcaacctgggcaacagagtgagaccctgtctgtaaataaatatgtgtgtacagacatacataaggttcacaattcaatttaaaaaagagaaagtgaccatctacaagccaggaagagagcccccaccagaaccctatcatgctggcaccctgatcttggatttccagcctccagaactgtgagaaaatcaggttcgcctgtttaagtcacccagtctttggtatttcgttatggtggcctgagctaagacaggccctgtgttctctgtgtagcaagaggcaggaagctaagcacaaaggttgccagatagcagggactggctggctgttagtgagccagggccagtggcatttaattgcagtcattcccattctttgctgagctttggtcataactatttgtagaggacccctagactttttttttttcttccaggacaaaagtgatccaaaacatactgtcttcagtttttgagcattggactaccaaacaggaacatttaaggaaaacaaaatgttgctgttgtaaagccttgatggtgggaagttatgtagtgaattctcaatttcttcttcctgcatcttgtcttaaaaaaaaaaaaaaacttttaaagtttttgtttgttcatcattcattcattaataagtcaagatgtagagggctcagtagccttcccctagttttctacatttctgactttggtaaacttcctttacttctgcaatttccctaattgtaatattaacatatatctaaaaagaatacaatggttatgtaaacctcctagcacttaataggcactcaagacaatatgacttaactgtataagaatgactaatgtgctatgtttatttatttggcttcattcattttgccagcaatggtgtagtatatatgtagtatatattaaaaatctcttgagtaagagaggtttggaatgggaaaaggaaccaagaaaatctcaccatctttcttctgcttggcagcaagtcttgaattctgttttatttttcttaagagacggggtcttgctctgtgcccagactggagtgcagtggtgctattatagctcactgcagcctcaaactcctgggctcaagtgatcctcctgcctcagctacctgagtagcggagactactggcacctaccaccacacccagttaattttttttttttttttggtagagatgaggtcttgcagtgttgccctggctggtgtcaaacttctgacctcaagtgatcctcctgccttggcctccaaaaatactgagattacaggcatgagccactgtgcctggcagagtcttgaattcttcaacagggcttttgaatattttaaagccacataaaatttcctttttaaaattgcaatgaaaattgtcaagtaaagtgggtcattttttgacctggtgcttaattgtacttagaagcaaatgcatatctgtaagtaaggggaggactcagaagtgatttaaagggaggattgtaaaagagtttgggaagtccatccctttcattttacaggttaggaggctgagggcattgtgcaatgatgtatagtcaggtagagagaggaaacaggaatcataaatcttaccttttgtacaaagtcaatgttttcagtaattttgttgaaaacaaacattaaacaaatttggacctgtaaaatccattgaactggtggaggtcagcctgacctagcaggacatgtggcatctctgttttgtgatgctgtatctgctttgggagtcccagtgcccaatcccctcagtgttgaaaacttagctcctgagtttaaggtggtttctgtggggttatggggcagggggagagggtttggaggaggggaggagcggaaaaagagacttccagtctggggctcctgctgtgttaccttaggggatttagggcctataaaaaacacatttacatctctgaatggcaacagataaataccaacgagcgttaattgaaaaggaggagacccaatggactagaggtcaggactctacagtgatgactggtggcctgggggtgtcagctgaaacggtctggattttttttttttttttttctccttcttcccctacctccttcctgggcttagaaatgctggaaggaagaaggagggaccattagttgaactaagaggtatgttgtttatactgttgttgtggttgtccctgggtggtctgaaattttggaggagggggtagggaaaggccccctaaaccttttttaaactagtataatacaacctgactgctacctgcagtttcccaattacccaattataacacaaatttgcacatttttttaaaaaagcaggctgctactgtttctccttatacaaggattttagtcactgtacatcttgtgtctttaaataatgtattaggaacattttcaagtctgtaagtgcttttttaatgagagtgtgaagattttaatgggactagattgcttttcatgacatttcagagtgacttaattgtaacaatgttgagaggctgtattttaaagtttgctaagtatgtctgtgtggattatagtcagacacttaaaaggacggatggttggatagtggaatcagatagcttttccttactactttctccaaatattagctctttgcaaatatggttataccaaaccaggcacaggtcaggattctcttaaaccttttaattttcagataggaacagaggctaataacagaccaatgtgggtaattttagagacaatttccttaaaacttagttggactgcaatattggtcctaaggcctctcctctctccttttgtagacccaggaggccaggctgtctttgtgtatacttcctgttagtccctgaactctcttccctgtttgctttaaaaacatagtgaccttgaccgggtgcggtggctcacgcctgtaatcccagcatcttgggagggcgaggcaggcggatcacgagatcaggagatcgagaccatcctggctaacacggtgaaaccccgtctctactaaaaaaatacaaaaaattagccgcgcgtagtggcgggcgcctgtagtcccagctgctcgggaagctgaggcaggagaatggcgtgaacccgggaggcggagcttgcagtgagccgagatggcgccactgcactccagcctgggcgatagagcgagactctgtctcaaacaaaacaaaacaaaaaacaaaaacaaagcatagtgaccttgtgcctcatttttttttcaggtatttgagttagcgtttctaaagcattatgactctccagataacagtttaccgttttaatgattggaatttcagactcaatttttttcttatctccaaaacaagaaggttattcagaggtcttttcctatgcaaacattattaggattctagaacctgtggcagacttctcaaaattagatcaaatggtcagacactttcactatctttttttttttttttaatggtcttgctctgtcacctaggctggagtgcagtgccatgagcattgctcactgtagcatcaacttcccagggttgagtgatcctcccatctcagcctccttcctgagtagctgggactacaggcatgcaccagcacacctagctgatttttaaatttttttctagagatgaggtctcactatattgcctaggctggtcttgaactcctgggctcaaacaatcctcctgcctcagcttcccctaagtgctgggattacaggcgtgagccaccacgcccagtctcctcagtgccactcttaatagaagcttgtattagtttccaaggctgccataacaaagtatcacaaactgagtggcttaaaacaacagaaatagtctcatagttttggaggctaggaaatgtgaaattaaggtgttggcaggaccatgtttcctcttaagcctataggggaatctttctttgcctcttcctagcttctggtagtttattgacagtctttggcattctttggcttgcagctgcataatttcaatatttgcctttgttgtctcttagtgttctccttgtgtctttacatggccatcttctggtaaggacatctgccctaatccaccctaatccagtatgccctcgttttaacattggtgtctgaaagaaccttatttctaaataaggtcacattgtgacatactgagggttagggctttaacgtatatttctgaggggacacaattaaacccataacagagttctactttgaaaagtgcctaggagattctgatgcagcctgcatgggttcccaaagcatgattcctgacctatctgtacataattcatcaagagcactaacaaacttacaagacatatatgtataatggtatataagtatgagtgatatacagaagaaaaataaacccaaaactcatgtactcatcaccctgcttaagaagtaaaacattaccagtacctttaaaggctctggaaagcctggggtgtttgtttaaaacataggttctcctctgaggggttaggtcagggaggtttggagcaacaatgtgtattagaattcagtaactttaaaaaaaaaaaaaactccacgtgcattttaaagttggtctttaaaattttactttggagtgggatgggattttttttttctattagcgaatagaaaacgtgcaagaaaagatgtagtaacttttttcatagtgtagtagaacagtctttggctcctcttctttttgtgaggtttcttgagaaatctcacctgtacttggtataattttccaaattaatttagatctctgacccagagagacttagagtgatgcacagtcatgtagggggaggatgtgtatgtgtgaagggacctgttattgattatacgtcttacattcttgcctttcttgtgggattttgtgaagattaatatctgccagataggtttaagtttgcaaaatgccttgagttccttgggggaaactgttacataaatgtaaataaattatgcagcacctgaatttggttgttcatcattttttatagtgtgttttaattaagaacttagtgctatttaagttggatggctggggagagggtttaatcactccaagatggttaagtaagtaggtaggagcaacatttaggctggaacccatggaggaataaatgaacaagactggagaccagtcattttccatggcatttgctgagcggagctgtggattaatgtctcttcttgtacgtgtgtacatggtgctgttagaaaatcagccagtttttcactacactttgtctcggacctgtagataccttggacctctctggttttcctgagtaagctggaaaccctaacaacagccaaaacaaaacaaaaacggagtttgtcttacagtctaggtacttggggagcaagaggcatccagcaaactgcattggcttttggtacactgtgtttctgtagtccaatgagctgggttccaaactacctccttttgcctgttacatacagctttgtgttccagtggatgatactgttccttaactcttaaagagtggacatacgaaacagttgccaacaacccgtggtccagttgtgcctcctttgtttgctgctttgtcagagtctcactgtatgcttttttttttggcctttggcgctgtgagcagagtcacctcatcctcctttccgtggccaactcaaagacttacaacctttctccctcattcctatgtatctacagaacactcactagttgctaactagtggatacatgtgaattatgttttgatgccatagggctgtctagtggaggatacaaacattaaaaaaaaaagctaaatccagcaaatagctataattagatgagggttatagagaataaccacagactctttcagagcatataaggaggcgaatctaacccagtctcggattctggcaaattgcttctgaagagtgactctcagcaaaatctggaaggatcactgggaagaaattagcaaggaaggaggaagaaaagagaacagtgccttctaagaaatataccatgaagtcatttttttcctattcctttctctgcccttttccttccccacacagtcttatgcagcagcacaattttagccatccaaactgggccagttgttttgttacactgtggatggttggagattgagagctatgggaatgggtaggagttaaaaactgaatataaattaggtgacaagagatggcaaaatcatttattgggatgattaacttattaaattgggctattcccatgctgtttttctaaaattgtgctctgatggccattttggaagcctggtactacccacagactggagtatgtcctaagtaggttaagagcttgggaaagatgcttgctgagggagggccttctttgtactctttctatcaataagaaataataaagagttaaagcatcgttacattttagatatactttctcaaactgctgacatcagaattgccaggagcctgttaaaaaggcactttctgtagccttcctatcccaggccttctgaattagaatcttagcagtaggattcctggccactgtaaagtactctattgaaggcgtggattaccagtgggttattcagaggagaactttcatcattttagccccgtgggtccctgcctgatttcctgccatctctcactaccaggaccagctatgtaatttgtgaggccccttatttaaaaagaaatattaggaatttcgagacagtgatggtagagcattaaaccaagtatggggccctttctggatgtaggtccctctgggattgcacgggttgcaagcccatgaagatgttcttgttcaccattcctgtttgcctttttaaaatgctcctgcagtaatgaactgcttattgctccctgtgcatgatactgttttttgcctttgtcccttgggtctcactatgtggcatgctgtgtttcatctcttttctgtcacctgggcttacctcagtttttgcacatactgcgttagaatcctgtgcaagtcgcccgtgctatgctgtgtgctttgagggcccggatctgctcttcctcatctttatattccctgcccttagctgaggctctgccttggtcttctgttaagtgtgctgaaagggatacttttttaacctgaatcttttcttaaaacctaattaggttataggccattgggaatgcagatttggttcagagtgaggagttggaggctgtgttgccctagtagtgtcgtgaggactgcctgggcgtgactggtctgagacagtgtgaggaacggggtgtgaaacaaacttatgacatctctggcaagtagtgcatactctgctgttgacacctttgatagctgctaccctctgataaccagtgtttttttttctggatctctcattgaactctgagtttctgggaacagcagatttttctgagccacaggttcagatgtgttagcagaacctgaggaaatgtttcttgcaccaggaaggtggccattttactccgtggctaatatttggaactagtcatttctggattgtttgaactagcgtgttctggggaattccccaaagctggacgcacttgttaaatgaggttatggctctgtggggtgagaaatagacccgcctactatacttaaaaggactgactgtgtttctgccttcaggtaaccagaggtagttatgaatttgggtgaaacctcttcatctcatgatagactagcaactagaggttcagagaagttacacagaatattcaaggttgattcagatagtgactgaattgggactagaatccatggtttctattctgtggattttgagtaagatcactaatcaacatgtgaaatcttccttgtgtcattcaattagaatttaagtgtcaaatggatggtaaaatcatttcttagcttatgtagatcataaagattagcaaatcaaggcagaaaaagacccccacacatatttgttgccaggtctgcactaatttctggataaaggttagtatatatttggtctacagggtgtgatttgagtgtaagttttttctttagtttttagattattgttcaaagtccccactgacagaatgcagggagacagccttgattagattaggccagattagattaaatcgaatggttaaggcctttggagcctccagcttgtaggagacaccataatggccttcatagcgtccttaaatcctattaggtaagttaatcttattgaagatttcaggtctgcataaagcagtattgctcttatactctctatggtgggctctgcttgttaaggtgagcaggcattttaactttccgggaataagttggttttattggtttggggcaagttaatctaaataacttgaaagtagacacctgtgcctgatagagaggccattccatgtagcaaaataggctgtctcctggcttcccctttgcttggtggctgttagtacctgtgacagggattttttttctttgccctgatttggggaaagagagtcaggtgagatgtgtaataataatgtacggagacagtagtatggttatgacactgaggcactactagatattgagaataaagcactttggaacttaggagctggaagcattcttagctgtcattttttgagtgtttatagttttattataggtgctagttggctcttgcctgtttctacaggtgcagtgaccatttttctgaagcaaaatattcttgttgtcacaggcttttcctcaatttgtgaatttatggacctgcaaagttttacaaacacatgaattatgtcaaattttgtaatgtcttttgaaaaaaagggggaaaagtgtaagaaatttagaccatgtaggtctgaaagtatgcttactacatcgatagtgggggctggaggaactgtgaaaaaagtaatagtaaatttccttttttagatctttgccaaaggtagttttgttagatataaacaacttcaagacccacaagtgactactacacactggattggccttcagagatactgggattttctttccaagtatctttaaaaatgaggttcgtagtgctttagctaggaggctgagtgcccactattaagatcctgtgagttaattggtttggttcacaaactaactcatattgcagtgtatctggctgttttgtggctgggagaaggttcctgcattgaagggactgaagtgacactctgaccttgggacttccagtgctgttgtggagtggggacttccttcttcatgtgggcttgctggctcttcatttattgtcccacctgggctctgcctgttactcttctcaggccaagaagtgagttaggttccttatttaacttttctaatggggcagctctgcatctgtgtcctgtccccaaagactaaagagaaatttcaggtgtgggccagattatggagcctgaagaacagttttatgattgattaatggttttgatttgcttttaggaagaaaagtgcaactagcccattggatgaagatagtatctctctccagcactcctgtatcaagtgtacagtgttctcttcctgtatagcacttgtattttcaagagctagggtcattgagagaacacttctcactcatgagtttcagagcgtagcagagtacacacacctgaagcaagaaatgtaattttctctaagtgtactaagaattactttaattctctgtatgtgcatgcatgtgcccacataatggtggtgggtttggttttttttttttttcatgctccttgaggagaaataacccgttttttgcttttattgattcacgattacctacttttcagggttacctttgttaggaagcagctgctggaagaatgtgtgctcattttgtacttgtgtcctttacttctatgtcctctctgacctgaggctcaccctgcctgccacctcctctgcatcagcccagctttgttcttctgggcctgttgtttccactctatgaagagacctccttacttctctctgtctctacttagtatccatttctgctgaggcagatccagatgggcagaggttggggagggaatttgaatgaggggaaaaattggatcagttaggggaaatttataaaacttctgtattctgtgctaatagttctcagatgctttggaatcataagacgggatgttggtctggcgacctttgagagctgctcttaaccagccagtggacagctatgcttgctttttcttcctgtcaccatctctgcttttcttgcccaatttgccaggaagagtccaccaattcttcataagcccactttttattctctcttttgaagtcatcttgattcacttcctacacctgcagcccccagtcttgcttgatctagctcctaatcttctgcttccctttgggacagaggagaagctgctctcctcgccatgctttgctgacatctccaaggggaaggagagcacaggccctttcatatcctgccccagaccttcacagggagcagtaataatgcctaaaccttattgagtacttaacatgtgcccagcactgtgacaaacacttcacacagattatctcttaaaatattcaggccagcccagtaaagtttatgtactgtcattgtctgtcttcaatttgcagatgaggaagttgatgctcagggaggttcaataacatgccattatgtacacagctgaaatgagtgatgcaatcaagattcaaactaggcagcccagttccagggctcttgtccaactactcagggaaaggttttcgaggtcactgccaggatagctggacttgtgacggttttcctgtttgagatatctacccttttacatcaacctaagcacttactgtctttatattttcaatgaactaagtggggtgttctgggtggtctttgatgatggcaactgtgtgttttaaagaaccagaaagaaaaatgtttagaggtgggcttctttagctgtagtccctcttgactgtgtggtcaaataatagggctcctgacaaggaaataaggctataagtgctcttgctttgtaaagattagttaattggtagaggttgtgtttctgtggttaatttgtgctcctgtcttagcaatacatgagtatccacaggcagcaagtgtgtcgcccagcagccccataaaacaaggcactcttcagcaccagcatcagttgatgcacctgaataacaatagggaagcttgttgaccatttggcacttcacagcctagtaattagaaactgtaaaacaataatacagacatgaagcaaatcctccagttaatgaaaaaaaaatctacaatcttgcattgtggctgagtgcaaaatcacaaccggccgcttatacagcaaagcaaacacttcaggattttggcagctgttttgtggatataaaaagctctaggctctgtattaatttggggcctgtcatattttttaaaaactgaaaacaattacctgactttctagttttttgttgttgttgttgttgttgtttttaatttactgcagtggttctcaaattatggtccccagtccagaagtgtcagcgtcatctgggaacggttagaattgcagattggtggggcccaccccagacctactgaaccagaaattctggcagtgcggggcacagtaatttgtttttacaagtcctccaggtgattctgatggactttaaagtttgagaaacactgagggtgtgggaagggtaatttgggggaagggaagtggagtcccctcttggccccacccagagatgagcttctctgtctagtggtgggatagttggcttgagatgtgatattgagaatatatgaaggctccctactgggtcaggaagttgggggagtgtctcaggggagggccgtgccttcctggggacctgtttaggagaagggtcctgggcagtagcttgttactagcctttcgggaacaatttcaatgtttcagtcaccctctgggctgttgtactattgcagtcagccctgctaggcccacaagttgtatggggcagaggagaagaggcatggggacagaaaccttatatcccaggcaaagccttagcaatgctgctgatgtcatatgctcatcgttgtcaagaattgaaaattaagatagtgatgaggtggtggcaggacaaatttcttcttttcactgtatgtcccctttctcttctggatctcatttccctgcctccagctatcttggcagatgggattatttaataattttcttggggcctgttggcaaatggcccctctgccccttccccagtgtgtggtgaccacaacagtgacatagcttcatttcacagccattaggaatcttgacgcagctgacccctagatctcctggaaaggcctcttgggaaatataagcttgccaccagagtgaagtgaattctcgagtggtattaccacagaggctcaggttcctgatgctccttggagtgctaggttaacagtctctctgttggggaaaaacttgatacaaatagaagatttgctaattttgctcacatttcaaaattgtttaatttgcttactttttttttctctttcagactattgggttttatctatcattccttttattttacaaaaaagaacatagggcatgttggccagataatgtatcctgttttttgatttaatcacccaacatagcatgggaataaaaagctgaatgagatgtagccttgctcctccctgacattgaagagactggcttctgggagaggaaaatgaccaagaaaagaaccacccagatcttgggttcagtttattctctctgtattttcaagtggcagaacttgcttgaatatgtgaatttgatgttggatcacaagcccaacatgtggcttctgtgggcatatgtagttattttggattttattttattttaaagggtctgtgtcctgttggcttttaggaggtgatagttgctgattctcctttcatgtgacattcagggctcatggagaagtcaaaggctcacactggtgttcaccttcctggacttcaggaaagatagtccttttgccagatgaatgggaggatctaagtctgttagatttccatgagtcgtgcagcctttctggatcgggacaggaagactgacccactgtccttcccaggctgcctgccgttcatcttgctttaattaaatacacagctgatgatgtcagcttggctcccggctccttcagctttcccctcagaacaaaacatccgggcagacagttgtgacaattaagtctcaagacccaagcttagtttgttctgaggtagttaagataaatctgcctaagcatctccaaatgcagataaaacctagtgctgattagaggtgaccctctaataaacctgatttgattaggcagaaccagcgaggtgcaggcaaatatttgagactctggccaagctgatattccattgacctttcacttaggggaaaaaacctgtttgatttttttcctatcccagagtacttgaaaattattacctatggcagctaaagcactagggcgaaataaacaggtgagacctgtggacttgcccttaagagtcgcagtcagctaccacctgggttgtgcttgcttcctggcagatcagtggagaatggattttgccggaggtcctggcctggaatgataattaaaaaggatgtttcagaacacacccaggtgcgttctgataaagcctgagcagatgtgggtggtgaaggattttttttttaaagtcaaactttgtttataaaggtaacttctaacaatttattatagaaaagtcaaactagaattgcattagtttgtttatatcaagacctcattagaaattaaggagaaatttccttaattgctccatctctggctcctgtaacagtgggcatacttctcttcttagcatttatcacattgttctgtaattgttggtttaccttcccttttgtcttaaaaagcagggaaattgtataattattcttgatgttgctcaaatgcttggcacctgggccaggtacagggattggcaaagtttggtccacaggccaaaccaggccactacctgtttttatgcggtcatgagctaagaacagtttttgcctttttaaatgattgaaaacaaatcaaaggatatatatttcatgccacgtgaaaattatgtggaatttgaatttcagtgttcataaataaagttttattggaatacagccatgctcattcatttacgttattgcctttggcatcattttgcactacaacagcagaattgagtagttgcagcagaaaccatatggcctgaatagcctaaaatatttgctatctggcacttcacagaagtagtttgttgatccctttcctattatatagcaggcatatagtgtaaatgcttattgtttgaattatttcaaatataaatctgagtttacaaatagagttattctgatcctaaaagtgttcagtgaaagttagatgaatgactgaccaatctatttctcttgttattcatttgtaaccttaggtttaagttttagaggtagtggttcgtttattagagctagacaattatatactatttctcttctgagaaactttataaagagttaatccttattacttttctaggttctgaacctactatatgggatgcagagacaccaagaggcacagagaggttaaactgactaagacacacagtaaagaaatggcatgactcttcatgtcttcatctctttctttgtttgctaaagccattctttgtgatgaaagagaagtcaaatctggagatattcatgagcaaactactgtctgatactatataatgcattatttcttatagacatcagtatctttgtaggctctttggttcattaccagggaaattcatttaaaaaaataataaatatgtggtttaaaaagtaaatactgcagagaatgatagcaattaccaaatgtaaacaatgtggcctttgagaaccactatgaaattgtttagtgaattaaattattatgcttttgctattcacatatccacttccattgactgttaaggaatatgcttcaaggaggacagatgagatataggtaaagtttatttttaagatacttaggtaaaacaaaataaaccagcaactggcagatgtttggtgaccttgaaatctggcttttgttttgagacagtgtctttaaaatgaccagtgccacaaatgtaaacaggggagttggagggcattggagtattcaggaagaaagtgagaaatcagtaatttgtagaacatgactaactggaactattgtttggtctgctggggtttgagggagtagaggaatttgtgaagaaggaaagaaggttaggagatgcatagagcagagaaacaagggtctaagctttcctaggaatctcaggtcagacccttgttaaattttgtccgtatattcattgtttgctgtggaatcttttaggagagtgtaatttttttttctgtttttctcttattaaataatttaaagggatgacattcagggctttgggaagcaattttttttttttttttcaaaacgccgctatacctactaattggatatccatcaggggatggatacttacaacagctctgcatgatagggataatattcctattttatggatgggaaagctgaggcttagttgtttttttttttttttttttttgagatggcatcttgctgtggctgaggcttagtttaattggctttcccgaagttttacagttagcagccagagccaagtttcaaacccaaatctagctgactccaggggccttctgttgtttctactatcccacttcctcagtggttgcatcccagagatttcatcgtttggtgcataaatccagcctaaagccatacttcaccattttgtgtgaataaatctcttcctcattttatgactcagctacctgctttctctttctaacctgttattttgtacatctgatttgttagcttcccatgttcccttagcttccctgcccttagttgttaacccttttgatcaatatctagttgattttgctacttaataacagactttagagggacttcagaggataaaaactagaacctccaccctactgaaaaattacatttggtttgccgttggtagtatgtgccccatccttctgccctggcactccaggggaatcaaaaaggaagagctgagaaacagcattccaggcttagaggctccacattctttgggtttgttggaagacttcttggcagcattgaaagatgcctgtgttttcatactgattttccatcctgggccacctgctttctcccttcctgctgttttccttttgtacctatgtggttggtgcttctggggctttttatagcagctttcatcatttatactactgagttttgcaggcgcttttcttttcaatttttgatgtttgacagtatagacttttatttatttatttttaatatgttcacttctgaacctttttagacttcatggtgacagcctccaggagaggaaaaacaaaacaagggaaattctaggaagaggcagaaggtagttactattgatttctctggatgcagatcctaactgttggcaaatttaaaacttacttattttgagtggaggtggttctgtgttagtgagaagttgatctggaaaagatgctgatttggacatggctgttgtaaaactaatgatgaagcaaaacaaaagaaggaatagtgcattttggccaggcatggtggcctgtaatcccagcactttgggaggctgaggtgggcagatcacgaggtcaggagatcaagaccttcctggctaacacagtgaaaacccgtctctactaaaaatacaaaaagaagttagctgggtgtggtggcgggcacctatagtcccagctacttgggaggcttaggcagggaatggcatgaacccgggaggcggagcttgcggtgagctgagatcgcgccactgcacttcagcctgggcgacagaggaatagtgcgttttcactttttaaccttagttgcacagggtatgttgaaagctactgttggcttcaccatgtcattgggaagtgggaacgctgacaatcaaagcagctaaacaagaagcaactcaggaattatgacattggcggcaagtcttttgcccctcttcagaggtaacactactagatctggagagagttctgtacattcagggaatcttcctgatctctaaaaaatttgagaggactagagaggagtaaagactggaacctggatagattgatttgtgagggacaaagattcagagaagacattttcttgaaggtgatgaacctgctttaccaaaatgttgtaaaaattctaaagaaaagttaattggatcaagttgacaataaatgttagaagggaaaaatcttaaagggtaaaatttgaaagtagaaagtttgtcctgtccacagtgtttgccatttcatagaccaaggtggttgggggaggtggggcaaaattactgtagtttccagtgatcattgccttctctcggtcctataaatgcaggcactatttagcactgaaaccatctggtgttggtggttgtttcttatgtcgtatgacctgcctctataaatacattgtgtataagcttaactgggacagtaattggtgtgatccttttctttttctgatctctaaggtctgaggcccatgaccaagggaaagagaagtgctttttaaaaaaacggacacttttgttgttttggtctcatggtttcactgaggtagtgttccacagtgtaagacaggttaggattgtatgttccagaattatgaacaagagtatccttgggaatgataaaaaccatgctgcagtgttgcatgtgtatttgtgtgttccatgtggaagaccttctgggctgtgtctgtctttgctatttatttatcacctgaaatggtgctgctcaaccactctgtgacagtgttattttaacttgaaatagcatgagggttaggagaaaatacctcatgaatgtgaagggggattctcctgggcgtatgtaattgcaatgatttgaaatgctttcacaggtttgtaggagagggtaatttttcttctttatttgctccttttatcttgttctaaagccagtattacctcctctcccaccgcccatgtatacttcttattcccttctccttccccctccctttctcccactctccatgtaaagaaactctttcctaataagaatcataggtattcagagctttttttttttttttaattaacagttgatttgactttttagtactgtgtaggagatgggaaaagtcagggccatttgatagtaattgcttcctggaagagccgaccaacttattataagggtgaggagtgtttggaggcattattttctggttccaggtgtgttttgagtattgctggtggtgctcagcactcttgacatttggggctggattactgcatgttgcaggagtatcttgtgtattgtaggatgtttagcagcatccctggactctacacaccagataccagtagcacccctcaagtgtgacaaccaaaaatgtctccataggttgccaagtgagggacaggatcactctggttgagaatttctgccttagaaagaggaaaatggattccctggaagcagaggttagccattaaccttatagggctggagccttcatttaaatgctttggtatattgaaagcaccactcaagtatcagtggtgagggcacatttagcttgttgaaattcctgtgtaattcataaatatcatattagctcttggcttcaatttcctaacactagaaatgtagatttttccccttattttcaaaatgaggaggattgtagtaaaatatagtaatctctgaggtcgctcccaacccttacattttatgattttagttataacagacatcttatggaattacacaatataagagttgaaaatgtatttgtgatcatttagccagccctcttctgttagttctatcccgtgtgatttccacaaatagatcagaccagaagaaaatagttgctttttacaagtggatgttattaaatgctcatatttagaatatttatcagaacagacttatattacagtgtttacttttctaactgattgagattcaggtgacttaactgcctaagcttcaactgtctgttgtttggaattaggcttttaaaagttggtctttatattaatattcctatgcctaagctggtactcttattgtcaaatagctttatgctctgttacattaatgagggaaactttgactttccagagtgccttggctgatatattggtgttaaattggtaagctttctatcccaactgctttatttatgctttaaacataaatgaaagcagagaatttttttttttggcctgagaggtagttaagagggaaatctaataccttttatgggtttatatgcttcatatgtgatgtgcccaaccagaaataataagatacaccccagatgtgaaggtaccagctaatataattatgctggagatcattttcaccttttgagggctgaattacattgaattcatttcttcaactctaacaggatttggtatagttacttaaatttgaattgggagctgagatgaagtcccaacacttgtgcttttactggaaggattgggttgtgtataccttttgtatttctgaagcttgataaactataaagccttgagtattcaggttcatggcaaggtttagatggatggggaggtatactctagtagaatctaacagcttagtatgctttctgtgggctcttgcctggaaacccaatctgaaggtatagtgatcagacacaatgctattcttaagccttcttggaaataacaggtgtcttagcctgtggtaaaaaggtaattttgcatgtattaaatattcaaccaagggcatgatctgtgcttattttggcaaacaaatagatcccaaaatgaatcaaacaaattgtaatgcagaacaaatttaaatacttgaggatttgttttagacatttaaactcatattttatcctctgtgtcttcatagtaccctcagaaagaaaagaatctttggaaatgtcagtgaaagggcagtataatctcacactgcagttgtggttccggactcagtctgtgtgcctgtctttcctttcactcctagccacgtgacaacacaaagagggtacttaaagtgtttatttcaccctggaagatttttatagagagcactttttaatgaagcacagcacatggcatcattatcatttctaacacagagaactcattttcaattttgctatcaaagaaaaatgacaaatagagaatgcaagaaaaaccagatggactaactgtattaggagcttagtatgcatattttgtgtcacatattagcattcattaagtcaaaagggaaaaaaatgagttttgcctacatgcattaaaccaataaggctggcaaagttccaagctagctcttgtgaattaattgttttataactgttttaattaaaattgttcagtatatgattaacctaaaagttttaatttccacaaaactgttgaacaaatgagacattaatattttacgttaaccatggcaatattgctgtggttttcagagctctgcttgttcaagcaaagcatggcaagtggtaggtggaaagtaccctgtgtctcatgccactactaagaaaacctgcaaatcagaagcaaattctatacacaagcatttatgtaggcatcgccccaaaccccctgttcagacagtctagttagagctgggcacctgtcataaattgtcaggttgaagaggttaacgatataacatggcaagaatacatttattgtctttttcttccacctggcttcatagtagtgttggtgtaccgtgtgagatccttagattagaaggggttggccagtagggactatgaaatgattgttgttaaattctaggggtttaatttaggatataggtacaaatgttagttctggaatcaaagggaagaaagagaagatttggatgacgcatcacctttacttgaggttctttaggttggcatcaggctaactttggtaaaaccacatcccattttgcaaatggtaaaacagggttggtaaaatttcactgtgtatagctgtggctcctgaaatacacagatttgcatttctgtcactcctccctctccccactttccacatgtacccccatcctaatgtacttcactttgttaaaagatggggatgtctttcctctctcctcccctaagcctttcactttgctctgtggatttgggtcatggtgctgtataaattcaaggtaatgatggtatttgaaccccatagaaggatattttaagagataagattaatactgctcagcataaatgatgataaaactcaggctgtcctaaatgtctaggtagtgatgcattttttaaggcactagactgagcttaccttttaggttgtatgacacttgatataagctgtccttacaggtttaaagctgtaggagtctggaatgcaaaactgaaccacagaagtatattggccttgcacttacatagtcaggatcatacggcattgtgatctatccagatttccagctgcagtcctgatgtggtctcttcattactttgtccagctgtttcttcccagacggtgctctgtgttagccttcccttctgtataatcattctcttccctaaatttttctgtttaacttgttaagcaccagattctgaataaattattcatataatcagtatttttgaagtagttaataatcagagtataataataaattttatgattgtacaggttgccatatttgccagaaatcagctttacacaagtgatttttgagataaatgctttattgggcatgttgctatctgttcatttcttcaggctctcttgatttctattattgtgtgaagttaggccattagaaatgcgcatacctggaccatattatttaggctcttcagagaactgccatcacggagttagagtgctatgtccttggtaaatggaaagtaagagccctcaatttaataatacagtattttatagtcaaataatacatctggcttttgtaaaaccttaaaagtaatctggtatcttaatgtttcattatacatatgcatatatgtgtgtgtatactcacatgcatatatacagacatacatatgtgtacatatatttacacatatacgtacacacagtcatacacatataaaaagcttctctaagaatttggagcgaggaaaaaatgtctgtcttctgaccaacatgtatacattcttctaactctcatgtgtttgtttagtgaatgaatgaatactatgtaattaggtaagagaactattgccttaccctggaaattcgaatcgtaattcagtaaacaattttaggtacccatcctaagtacttgttgatcaaatactattactcttttgcttggtgagtattatttttcatctacttttaacaggttcttctttggttaaaaactgacttctaaaataaaacaaacagaaaacctacttacttctaagccgtgatatgtctgtattggaaaataggcactggcattgcaccatgttccccatgataaggaaacaataagaggaatcatgcgtatggttcctgtcctgtaaagtctaatgggtggctcacacctgtaatcccaacactttgagaggtgaaggcaggaggattgcttgagctcaggagttccagaccagcctaggcaacatagcaagactcccatcttgacaaaaaataaaaaattacctgggtgtggtggtgtacacctatagtcatagctagtcgggaggctgaggtgggaggatcgcttgagcccagcatattgaggctgcagtgagtcatgatcatgcccctgcactccagcctgggcgagagagtgagactctatccccaaaaacaaaacaaaacaaaatacagtacatgtctggcaagaaggagaagtacctagctcagtccattttctactgaaaatgggtaatatataaagaaaaggaatttatttcttacagttgttggaggctgagaaatccaaggttgaggggccacatctggtgatggccttctcactggtggggactctacaaagtcctgaggtggcacagggcatcatgtgcaagggggctgaacatctagttcagatctctcttctgataaagccgctatccctactcccacaataacccattaatccaccagggcagagcccccatgacccagtcacctcttaaagactgtatctctccatgttgctacattgaggattaagtttcaatgtgagttttggagcagatgaacattcaaaccatagcagtgccaaaatcaagcttttgttttgttgtgtttttttttttttttttttttgagatggagtcttgctctgtcgcccaggctggagtgcagtgagatgttgtcttggctcattgcagcctatgcctcctgggttcaaacgattctcctgcctcagcctcctgcgtagttgggattacaggtgcacgccaccacacctggctcatttttgtatttttagtagagatggggtttcgccatattggccaggctggtctcaaactcctgatctcaggtgatctgcctgccttggcctcccaaagtgctaggattacaggtgtgagccactgcacccagcccaaaatcaagattttgacagtggggctgtaatagtagtttggaatatacttcatttattctagttcttttctctattttattacctttctgaatgtgctctctgctcccctggggcccattcccaatccagtagcggcaattaccattgggataaacctcctacctctgaggcccacagttttcctgaccatctctctacagcctcacttccacctctacctctccataaaacaatgtgtatacttctgttcatcagctaaatcactatacctatcttacttgtttttctgatgcaacaagcagccttccaaaaataccaccaagtctaataatccttttgctgtttagtacatcttttgtttgaggcttactgtcacatgacagatgatgacaggcaacaaatgactgtttaaatggtcaacagatgtgcccatccaggtgactctcctaatagttgacacacagtgggtggagggattgggttgttccagatattccctgttgttgggctagcttgctcttggtgattatagtttgacttattttgcttttattcagtttttgtggttctgttttgctacttggttttgatacatgtaggtagtgtgggttccattttggtatgtgaaatttcatatcatgaagaaagttatgattataatgtagcgttagtaattcccagtggtcattcccaaaaaatattttctgagaatgccaggtgtatataaaagttatttttgaaagtacacatgtagtgtgccacaccctctatcaaaacaggcccacattactgaaagaaggagggaaactacccatccactattactttacagtacttaaaatatgcagacaaatacattttagcacgtggtgatctttgtgaggatatcctgtcaatcaagagagtaaatatcttttctctttcccatgaacctagcaaccaatttgcttatagttccttcaaagctgttgttaagattattttgtggctggttatgtcacttggctagaaaaatggtactggaattaagtcagctttagccctatgctgcccatctttcttaacttatggtcagccatatgtttagaccagatgaggtaggaggtatgattggatacaagtacattcctggaaaagataaccaaaatcatgttctactaaaagtgaattactgtgtttttttccttcacataagaacagcatcttcatacctatggcaagaacctgtcatttttttttctgatcacatatgtaaaaatcatttgttggtagtagcaattaacataaaagtcaggttagtgatgtggttggggtgagggagatttgaccattgagagacacacaagggggcttttgaggtactgtaatgttctctttattaaccatacctgtggttgcaatggtgttcattttataattcttctgaaaaacagacatgttttctacattctgctgtatgtgtaatatattttgctatatacgtatgttttactggagaagaatttcaaaaatacctaaatagcacaaagtagaaaatgttatcagtaatcctaacactaagaaataatcgcaatttttttggacatgtatcttcccagtgttttggggacaaataaaaataataatgtatatctactcccatgagttaagattttaagaatgcatacatgtatgtatgtatgtgtatgtacaatatatatgtgtgtgtatatatatataagtatatacaaacctgactttttgatttattatattgtaatattttgacatgaggtttcaggattctatagagttaattttaatagccatatagagtaccattgtttggctatatcatattatttgcccaatcctgtattctctaacatttgcttgtttctaatatttatgtgttataaataacatgtatttatcttgtaggtatttaaaatttaaataggctaaatgggacccttctttatgtagtatgtagatatttcataaaaggtacattttgttgggaaagataactctggcttcaaatgctttttgaaagatgatttttttcccctcaaagaaaattgaaaacaatttcactttttttttccttttatgaagcatgtgtgtgtcatttgttgtaagaaggatatggccctgacatcttcatactcgattgttctctgtgaagttattttatttattcacttattgaactcatttattgaacaccatttgtatgccaggtgctttgttccagatctgaggatatagagatggagacctggtttctgctttcacagcctggcgacataatggatagcagggtttgggatgttgtctgtccatagactcttgagtttatggatccaaatgtttttgcttagattactttgctgtgatttttattattagacaggtgatttaggagcttatgtaccagagaggctgttgctttcctccctccccagcccttccacccccagactgtatgttcttctttaaggttgagtcttggaattcagaacttggtgagcaagacctgactagaacagaaatggaaatgaccttttcatgcacagcatgagcatgacagagaatgggctgtgtgttaactcctctctgatattgctgaggtcctttccagccctaaaattctgtgatttttctgatacttgggcctttgaagatcctaatacccaatcctttctcaaacattaaatttgtagcagaggggaaaaattaaattcctcctttttgagacaccagctgaactttgcagtataaatagactcaagagtgaaagaaaggagaaaagtgcattcacccatcccaggaaatcagatggggattgagagtgtgtctgttcatcttctgtaaacaaaaccattagtaacatggttgttttttacttgatccctcaaaaaaaaaaaaaaaaaaaaaaaaaaaaaaaaaaaagcagctgggtaccgtggcacgtgctgtgtaatcccagcactttgagaggctgaggctggaggatggcttgaacccaggagttggttaccaatctgggtaacataatcagaccctatctctacaaaaagattaaaaaattagccaagtgtggctttccaactacttgggaagctgaagtgggaggatcgcctgagcctgggaactcaaggctgcagtgagctatgattgtactagcactgtactccagcctgggtgactgatcgagaccctgtctcaaaaaaaaagcatcgttttagggtttctatttgaatagacatttctgtggcttgagtttcgagttaggaatgttttggcatagaaaaacctgttggcccagaaacatctggcatcattcacaatcaggccaaagtaaaggaaaactaattttttaggtagaatgttggcacctggaagaatggaggctgtaagttcttttgctggcaaagtataaaaagaaatgtttagtggacaggtgtgtgagttaaactctagagtataactaagcagtgtggctgcccattttttacttgatttgcttgtgcttctaccaccttcttaatgtgtccctggaatgcctacatgtaaaaggattctgatggagaagaaacttctagaccttaagtgactgtcctggttccagcactcatttagttgcataaccttgggcaaatctctcaagaaatctgttccgtcttctgtagaatggggtaataaacacttactcagcctgtttcacaacattgttggaaagattaagaaagcatatatgaaagtatgtactataaggtgatacttaggtattataaaaaaagtgaacagggatcagcacaaaatgttttggctgctgctgctgctggtgtgtgtgtgtgtgtgtgtgtgtgtgtgtgtgtgtgtctgtgtgtgtgtgttttgtgtctctgtgcctttgtctgtgtttctctaccaccttagatttggcagccctagtatctaagtgtgaaagtttgggatggatctcagggtttttttggtaatgatgactgactggtatggctattgaataaaatattgaagatgctattggtcctttaggacaattagttttgtctctctcctttaaggtcatttggatgaagcagcagtttgtgtagaggatactagtttttaagatatttttgtcctattttattttattttattttattttattttcactgttattccacaaaaatctttgagctggcttacaaaaatgtgtacaatgcaacagaattaaaataagtagaaaaggaattggggcactgggaaatgggtagggaaaatacaataaagccatgttaaggcttctgggcagaaacatgcaaggcagggtctgaggcagtaggttgagggggggtcccatattcagcttcccagagagtagaacaaagaggggaacgtaacttttctttttcttttttttttttggaaatggagtttcattcttgttgcttaggctgaagtgcagtggcacgatctcagctcactgcaacctccgcctcccaggttcaagcaattctcctgcctcagcctcctgagtagctgagatcacaggcatgcaccaccatgcctggctaattttgtatttttagtagagacggggtttctccatgttggtcagtccgatctcgaactcccgacctcaggtgatccacccgcctcagcctcccaaagtgttgggattatagatgtgagccactgtgccctgctggaactaacttttcttgagaaactttgtcaatggagaagatgtgtccatgaactctatcttggatatacttatcaatacacacaacggtgatttgtgaacagttgcttttataccgtcaatgcaaattaataacactgagacaaagcatgatttcaggaaagagtaactataaggggtcaagatcatgtgtctcacctagatagctcaaaggactggcttgagccaaggacaatttttagaacatgtcgaggagaggataagctacctgtcctcaggcagtctaccacaaatactctttatctcagctgggagctgacatctctccctgaaaggtttccagtgatattgtggcacaatttgttggccagaatcctagagacccagggatggagatgccagtgctgtcttgagagttcagtgtcttccctgttggcatcttctctttcttggttctggcatatctggttcaaggattagacacatgaattgatttagttctttgctggagagggcagcaaaatgccagttgtgatttttgggcttggctatgttgggaaccactgggaatttgtggactgccaataactcattttgtactagcttttgggtgaccattcagtggctgttatttcaattcatagttcagagtgactgtatttagacccatcatgtttctagagttttttcctagattcaaatcatggtaaatgctttcattagataatttagcttatgccctttttcctacttttatgtttccctgttgttactagccctagatacttaaaaaaattttttttggaaaggactgtgtgtttttagatatggggattgtattctgtgctttagtggggcacagaaggagactgtctggttaaggcaagagattgtggtgctaaaaaaggaaatttggcaggcctgttcctggtacttttagtaagtaaagaaagagaatgacaggctggctggggattgtattaaagggagccctgatcctcatatgaccttattccctgaacctagaaagatggtctgcctatgtggcagttattctatggcgctaaagacagttttgttctgctttctgccatgtatatttaggggcctaacggagagatagaaacctgttaaggaataatcatggatgttcaggcctattgcttccttcacttatccagaagccagcctcaccaatgtccatgggcaagtttgtgttcacacaagttgcttgtaacaagagggaagattctcattaagaagttggccctaaaatcaggatagaatcaggctatatttgtgtttctgtcaatagtctgaattccttattggtagaaaggtcttataattatggggtaactttgccaactaatagtactggggtttgatgtgggttacttacatcagaagtcacatcaactttttgacattagtttctattccaccatgtgctccagggaaaaggagattgatgtggactattaagccaaaaatgagaatctgttattgaaacccagaagtctgaaataagggtttagtgattgttttgtttagacacaaacttttcttcatagatgctttaacttcctaagtgagtttatatatttttctaaatatgtaatcttttaaaaatattgcaaatatttaatttatgtatttgccatttaacaggtaaaacagcaccaggaagtcttgctcctgttttgcaaaggcacatttagagagtgacagaggtttcccactgtgtctgggacaagcctcccagtgtgtctgggacaagcctgaaaagagtgccattttgtctccctgaccatttcactgattctgtacttgttgtttatgaaacttcattatgtaacagacaaaaaagcaatttcatgagcaattcctggaataggcaagtggacaaaaatttctcaggtaccttctctggaggctgtttgtcttccattctggctgcctctcttgagaactggagtggcatagtggttaagaccaggggctctggagactgcctggatctgggtgctggtctgactcttgagctgtgggaccttaacttctctgtgcttactgtccttacctgtgagatggagatgattggagtctccaccatgtcaatgtatcaacacttctaaattatttagagcagtgcctgagacattgtaaacacttaatatatgttggttgttattgtaattttaataataatagctattaaattattattctatggctgtcatgcctgagagttcatcacaggggcatgggtgggtgggtagggaataagggctgagaatctaatcagttatttttaatttattgggcaaaaatgaatcaaataaccgtggcaggcataatgaaattgaggtattcagtgtgtggtgaggatgaactgttttatcacagttcctctggtgtggcctgtgtgctttgattgcaggtcagatggctagggaaaagagtagtcaagctgaatgctctgtggtgaggctgtgagagggacaagaaacgtgggtcaggacagaaggcgtactgcaggaacagattccgaagtgtgtgcacagcatcctataatttgggctcctgtgtattttctttagttggttgcatttgttaatatgttagtctggtgtctttaaccctgtgactgacagttgacaatggtgtagctctttaaaagaggtgaaactggtctgaccacagtttacccttgatagtgctttcactttggcaacaagacagagggagaaagtccctgcttctctgctctgggaatcttaccaaatcaataaggagtctctggtagcactaacctcttttaaatagcctaagtgtgagatcctgacctttttttctgtatgtggcctacttccttgatgagaagctggcttttatattagaacttttttagacgtacatgaaacttgaatcttgctatttgtttccattgttgcttttaaaaaataattttacaaatttattctaataatatactaacgtattttgtctccaggactagtgaaactttttaagatttttaacagattcatctagacacctaaatctctctaggacttgatccttctccacccagcagaatactgtactgtgctgtgatcatttctcagggtggttttggctgagggtttttttttttttttttttttgagatggagtcttgctctgtatcccaggctggagtgcagtggtgtggtctcatctctgcaacctctgcctcccgggttcaagacattcacctgccttagcctcccaagaaactgggattacaggtgtgcgccaccacacctggctaatttttgtatttttagtggagacggggtttctctatgctggccaggttggtctcgaactcctgacctcaggtggtcctcctgtcttggcctcccacagtgctgggattacaggtgtgagccactgtgtccggccttggctgaggtttgactctttgcacccacagtcccatgatgtgtgtacttgtatgtatatatattcacatctgaggactgacatcatttcgcagaccgggaaactaagtgtgaggagtacattttaaaataatttttacattatatattggcagatcatccatgtgcttgtagaaggtattatattggtaagctgcaggtagacaggaagactgaaagagaaggtagaacctgcttggatcccagtctgtgcatacctaaggagttgagttggcaattcctgaaccaaaggttctggtgttcagaaatatctccagttattcagaaggatggcatgacattctaaaaataagaaattatttgtagtcacatcagtgtgtaatataccttacagaatattagaagggagatgaagcatttggggattcaaaggaactagttgtagacccttaggtatggccctgagactacctagggtggcttttgtagcaatctaaacctgtatcctgggatgttagcatctctgaacaaaccttttctctcccctccattgagatcactttctttaaagtctttatgcatttagagagttgctgaggcaaggccatgtcctggtttgctctttttaaaatgcagatgtttctagaaatgactataaactgagtcctgagccacctcttgtaacttttcaggtcttggtctgggggaagataaagaaatggaggtcttatgcttcacaatttggtttaagtcaactatggcaaggtatcttgacttaaataagtgtgacttaagtaagtctgacaatttaaatattagaatggtaagacatttttgtgcctctatagccatatgtccatcttggggaggaaaaactgaaaataaacgatgattacttttcagtattctgtggaaatcttacttctctttttagttaatttttcagtggataggctccctacctgccagccctaaattcttatttattcctgaaactctggtttttttcttttttcttttttttttttaaagtattctgaaactgttttctgaccatgcttcatatattgaagtagatttttttcacagaagggtaaaggaagtgcattatgtttcatatgtagatgcttttcaagaacacacagcttctcatcattcattttaacagtggacaattttggtgcctgtttatggagattccttgggaattatcagctgatagaaaatttctgaagagagatagaaaatctaatctatttggatgtcttgttaaatggagctttttgagtataagggtttctgaagaaatataggctgtcagagctgatagagtttagagagtctctgtgtaccattctttataaataaagacagccaaaagcccagagaagtgaggtgcttgatgttaagatttagttagtggccccctactggtctctgagctgcccatcactctaccttgactaatagtgataactgatgtttctggcaacaaatccaaggtacaagttttccagggtcttcaaaggaaagctacattatattaaagttcatgctgaatatcttttattgtgttctgatagtttgaaaattggttatttttgtactgttgtaaaactatagtgcttaactggaaaccccagcattaacccagcctttgccagcgtttcccttctataggatgagaaagttgttgaagagtgaggaaaaaagatggtatcttgtccttaacaaaaggtctacgtggatgaaaggagaaactgacacttattgttagggaaatggtaatgcttacatgatgatctaatctgggtttgagtttcgtttttgaagtcaccagtttttattttggtgtttttcagatattcttatagccttcctggggagatttattttttggagacatcgctcacattgtttactcctctaggttaaatgtactaggccatctgttgttaattttgtagttgtattaaattccatcctttggctggattttaagcaccaaaagcaaacttagacagaagcaggagcatttgcaaattacatagctttgagcctaaatggtggtttttataagtgcagttttcaaatgggctgagattctattttgagttttgggatcagtaatttaaacacagggacctctacgagttctctggaaaagcccattttgagaccctgaacagttgttatgccaaagcaagctcttggggtaaggttggcagtgatgctgctgataaattacttttaagatgcttggggctgaaggacaatgattttgtaatagtgttttaagttctcaggctgacctatgaaatctggaagtgctcatctgaaaggccagtattctttctgacaggcacaggaaaaactcgtcccctgcttgatcctcatgcaagcatttcttggaggaagccaggcctgtgggtcttgggggccagaacagagacactgagagcaacactactggcattttgaatttctgctgaggctgcaaaaacatttcaagggaaatctgaagttatcccttcactgtctacagcctcttgaattgacttctgggtgttacagatgggaccagcgtgtgtaaaagcagaatttatattctatttggatatcagaatcaagtttctctttttaaaataattttatggtaagtcgtggtttctctgatatgatttctgttgtgagcggaacaaaaatcatggcgaaatggtgttattacttaaccaaattgcctcgtgtacagacaggctgaactggtgctttgcctagagttggcctggagttttcagaaactcaattgtggcctttataaggctgtgcctggggttgtatttccaatctctctcaacttttgttcttgtggaagggaggaagtagagctgtgacagatatattgccagatagcacacaatagcacacaaaacgagaaagacacggcgtgagccattcatggagacagatttacgctctgtgctgccctcaaaccatagatccatctatttcagagaaacaacttgcccactgtattatatttcagacagggacatggcttagaagagagatgctgactccttctgtttagcttttgccgataatgctgcacgttttgctgtagaattacttttgtggggatgggaaagtatgtttggcaaaggaaggcctgtctctagattggaagtggaagaagggagatatcaggagagtaattggccatgctgtcgccatagtgaagtatatgtgtatatttttgctgggttttgtttccagccaactatattatcaggtgttggattttttaaacttacttcacaataagaaaaacaaagctagagagattgtgactggccaaggccagaatgtttggcattcgtagtttctctttagttctctctgtaggaccatttcctggagttacagaagaattgaccagtgtgtcagtgtctttcatgtacattaatgggcgatagtattggtagtggttaatataatagcatgggttctggaaccagtctgccaggatttacattcaggctcaacaatgccttagctacatgcctcagttatcttacctataaaatggggattccaggtcttaccttataaggcagctctgagaattgtttagttaatattgaggcagttataactaagtgttcagtaaacttagctattgcattttaaaatttgtgttgattttatggaaataaatgatgatgtgtgatacctggtagattgttcggcagacatttcaaatgtaaaaaaataactctgtctgcattgaaatctttctagattgatagttttaaataatgaaaaaaatacttctgggaatgatctacatttggaagaaatcaggaaagagaagactgtgtgtacttttgcatttctatgttttgggcttgtaagatatgtgattgtatatttcatgtcagtaataatttattttggggagtagaagcaaatgtcagttacatacatcatctatggaatagatttttagttttatttattttaactggatgaaatggttgagtgttgccttacttggttgaatttagacatttgagaaaatttttttttaacttttgtgacacacaaggacctttgaatgaaatcagtccccttttcttcctttaaaaaaacttataagaattaccatttcttgactaaacagttgttttcttttaacattatatacttgtctctacatagatactacattttttagttagatgtgttttggaagagcattgactttttttcctgttacattggaaaaatttaatggcacgtgtatgttattcttatcatgaagtgggtttaggcatgctgccttatactaaatagaaatcctatagtagttgtttttcagaagtaatccattgattcaagtcattcattgattcatttatgaatacttaagtatggttacataggtagggattgtcagaattggcttttgagcattttgtttagcagttataatccaggtggcaaatatactgtctgattcaattacttgcatgaaatcactttaaacagctacttaagatgagttgtccctaggcctgtctttatctacttattgtgcatgtgtgctagcatacacgcattatcattgttgttttttattgtgttaaaaaaatattacaaagtgtaccatcttaaccattttaaagtgtagatacttcagtagtgttaagtatagtcatttcattgtgaaacagagctccagaaatttttcatcttgtgaatatgaaactctataccccttaaacaacaactcccctcccttgttccctccagcccctggtaagcaccattctcatttctctttctatgaatctgagtattttattttattttttattttttgagacgggctctctgtgttgctcaggctggagtgcagtggtatggtttcggctcactgcagcatccatcccccaggttcaagtgattctcctgcctcaccctcctgagtagctgggattacgggctcgcgccaccatacccagctaatttttgtatttttagtagagacagggtttcaccatattggccaggctggccttgaactcctgacctcaagtaatccgccagcctcagcctcccaaagtgctgggattacaggcatgaaccaccacacccagctgaatttgagtattttagatacctcatctaaatggaattacatagtatttgtctttttgtgactgacttatttcacttagcacaatgtcttcaaagttcatgtaccatatgacagaattttctttcttaagactgaatactgttccattgaatgtatataccacatttgtttatctccttatcctgtgatggacatttgagttgttttcacctcttggctattgtgaattagtgcttctatgaacacgagtgtgcaaatttctcttcaagatcctgctatcacttcttctgcatatgtacctggaagtgtgggattgctggatcatatggcagttttatttttaatttttgaggaacctctgtactgctttctataggagtcataccattttgcagtgtcaccaacagtgcacatgttccccagtcttttaaacagccccttccagactgacagagtggctacatacagaacagggcagctttgaagattagggtggcctgttccaagcttcttcagactcctcgggactggctaattatttttgttaaggtcatactgctggaccagggcctataggttggcactgacttacgcatagaatgttggcctgggtgttgatagacttaggctgcaattgctatgagtgatcttaggcaagttacctccactctgttccctgccattgtcatctgtagatgaggtggttatgcttctctctatttcttaatttgttccaaaatcttattgtttgttgtagaatccaggcatctaaaaaatatactgtgtgtagcttcgtgtaattatttgatagactggatttctttttgcaccagatagttcggtttttttgttaaatgtctcctttttcttttcttactctttaactgccccaaatactaagtgacgaggatggagaccttggcaattgagtgctatcagtgagtctgaatgcctgggttcaaatcctccatttactagatgtgtgaccttggagaatgtaacaaactgttgtttcacagtttctccatctgtgaaatggaaataataatacgtttgtgagacttaggtgagttaatgcctgtaaagtgctttgcatgtgtctagcccatagtaagcactcattaaactcttaattatcatataatatgctaattatgatggtggtaaatgagtgaggtcatcttccattttggtcatactccacatttgggtagctttagactttctgaagatactatttcctgtaatgtttctttgtaggtggggaggatatacctattacacagttagaaaaactgaacagtagagattatgctttatatggctgggattaaaacttcagtgtcgtgtttagagcctagtacttcctggcctggcatgttgtcctacacttaatgactgtggggcctgagtgggttctaatgttagaatctggtaagaactcttcctgacctctttgcccatttataaacagccttccagggtgacctgagtaagatcattttctagctgtgtaatcctggtggtatgaaaacactggatgtctatagttttttagaactgtgacttagtactaatactagcctcttcaatactcatactcttaaggcttaatatttgtctctttattgatttacatatttgaaacctagacagtcttttcaaaggtgagtagatattttatatgtctgccttctggtcggtagcagcagttgtgcagttactcagctgttggcagttctgttacttaatacagaggcagagagcgaaagacttattcagaaacaaaacctctgcttgaaaagttctcaaggccagccatggtggttcggcctgcagtcccaagctggtgtggcctgcagtcccagcactttgggaggctgaggtgggaggatcacttgatcccaagagtttgaggctgtagtgagccattgatatggctccgttgtctggagaaacacccagggtctctggtctcgtgctgagaaaatcagcaacatagatacacatggagtggtttaaggagcggaaagtttaataggcaagaaagaagaaaacagctccaccgtacagagggaagagggctcagaacggaaaacccccattgctggggggaatgccgtaggttatattgggaggctggatgaggcggtatctgatttgtatagggcccaggggattggtttgaccaggcttgtcattcacatagcccatgaaaaactggccctcctatcctagtcttttaatatgcaaacgcagctacctggctggttgccatgatgtcctgcccacatagtctctacctggctggtcgccatgatgtcctgcacacgtggcaacaaaaagtggcaggaaccgccatactgggtggacctggcttttagttgcctgcatttgcatatcaatgcttgcaggtctggtttttcagtctgctttctgttagaaaagaaatgttttgggggctgctttttcagtaaaagaaaaagcctcaccgaggactcttttaccctctctatctgcttaaaataattcttaataactcctgtaataccatgattgtgccactgcactccagcctgtgtgacagagcaaaaactatgaccctgtgtctaaaaaacccccaaaaacccaaaaccaaaaaacgagactgggcgcaatggctcacacctgtaatcccagcactttgggaggctgaggcgggtggatcacttgaggccaggagttcaagatcagcctggcctgttacatagtgaaaccctgtctctactaaaaaaaaaaccaaaaaacaaaaattggtctggcatggtagtacacgcctataatcccagccacttgggaggctgaggtaggagaatcacttgaacctgggaggtggaggttgcagtgagccgagattgtgccactgcacttcagcctgggcagtagagttaatgagactccgtgtcaaaaaacaaaaaacaaaacaaatgttctcaagtcatgttcaagagataatggcggacataatggaacctccctaaatctgattttctccagctataaaatgaagggcccagatcaggggatgcttaagggctttgcaagttctaagactcagccatcttgagattggaaacagccctgtaggttcttagggcatgatgaagacctttgaggagaagtattttaacagctttgtgtcttggggaggaagagtcatggggaggtgattaggtgggcattaaaggagcaactggagaaaggagagactaggaggctgttttgataatccacatgtgaggtagactgccccttcctgagtgcctgaggggcacttgcaccttgggacagggtcaaggttttctctgagatagcagctcccacaggcctaggagccttctttcatgagcttgctgccctggttcatgagggagggattgatggatctctgccccgttctgtttttttgctagcactgtcttcacaccctgttgccgtttatgttttttgatgaatgattaattagaaaaataatcatttgtaaattgtgagtgaaccagacatttggccctgactgtagggaaatggcgcctctgagccgggtgtagcttgcagccagtacatcagagctccagtattcccagaccagtgatgaatttacatgaagttccttttcagcatgttaatgactgttacagctgagtaactagcgaaaaataatagcaaatgggaagagtaaatatttaatgcttttatatcttttagcttactgtggaatatgtattttgatttaggaaggacatgagagtcttagagacattagagacaatgttagtgtgtctgagcctcattccttgtttccttttctttctttgcacttaattaaattaaaaggataaagtgagttgttgtgagatggattttactaggggagtggtttttctgtaagttttaggtcacaagatgcgtctttcctggcagttaaaatctgtatgttcagactacctcattgattacgtgcctggtgtgtacagggactcatattgtttctaaaattcagctttcatcattttactctcctgcttaaaaactttagtgactccacaccgcttctgggctgaaagatatactcagtagcctggcttttaagggagggcctctgtgctgtgagtccagcctcttttcaggctctctccctaaggcagctccatgtggctacattgctcaagccacagtggttgactccctgttcctgtaacttgctggaggcttcctcacctttgcacctctgctcagatcattttggggcatgaaatgatcttgtctttttctctatctaaagcctgcttttcctccaaggctcagttctagacgtttctgtgactactctgactggataggagcctgttcattttggaatatagagaaaattgaaagtaggtcacagttctctattccttccagtttgccacctctctaccacagacaattaataatgaaccctacttttccccacttcctgtttggccaccatctagtcttagacaaactaagctatttgtccaggtaaacaagtagttgtggactacagaaatttctgaagattagaattgaagttagtagggaaacaggcctcaaggatagtgccatattttctgagagcagatgattttcagacaaaaggttttaccaacagcattcatataaagtactgctttagtctgagtttgcaatggtagaagtagagtatctaaagaaaggatccatgccctttttttttttttttttaaatagagacaatgtctcactatgttgctcaggctggtctggaattcctgagctcaagtgatcctcctaaagtgctagaattacaggcatgagccaccacacatggccaatccatgcctttttactctgttgtagagactgtcttggagtgttgagttcagacccagataaaacaataatctttagaggaaatgaccaagatgaccagaggtaggtctgaaaacatgaaggccgtgtgggtaagagagaacaagggagtccatgccttctgttttcaaatatttaggaggctactgtcaggaaggagggatattagacttcatgtatggaaccatggagtgagaacaaagattgctgggtgtaggttataccaaagataaattttatgccaatataagaaataattttctcatagtgctgtgataaaatgaatttccccaggagatagtttcccaagtaggaagggatatgaacaacaggagctgatatttgaatcgtgaatatacgtggccttatagtaaaaggaccacagatactcgaatgtcagacctttaggaacaagtcattttctactgtaggattttggagggttcataatagaaagtaacacatctccttgtgtctaaaaataggaataaatcctaatatgaaccaaaaaatatattaggtacagttttctgagttgatattgaaatgatgaaaaagaaagagatctgggactgggggttcttaacacactgggtttagggacctcaagaatattgtttaagaatgacgagagatttgcaatttccaaggagtcataagcagtttcaaaaagttgaatgtttttgaggaacttaaaattctgttgttttcaaaatactatagaaaagtaatattacaaaattgtcttgacataagtaatttgggtatgctgtataaaggcttctaagaattaagaaacatggcccgggttgcaaattttaatgcatgactacctttttttctatagaatatagcttttgtcagattctcagcagtggctctgatccagaaaacattaagaaccactggtcatgagtggtgattttcagcttttttggtcttaacccacttaggtgggacagaagctccttatctcacctataccatccagcatcaagataagcacacgttaatatgaaccatatacatattttgttttataaaagtatcccataagctttaaaaatgtaattttgtcatacttaccttggtatagtagattgtaagttatttagagactataaagtcacagatgaatgtttacaagtactctttttggagttgggcttattctatctatgtcttctttagcagtggggatttggattattcttaaccataacacatacaagtctcattattggaaaattacaggacagaaacaaatgctgtaaatatgcaccactgcgcatcatgagattaaacagacaattttcaaaaagtcaaatttctaatgataaaattaaagtaagtaatttatatttaaaaagcaggaatagcagcaatgcaaactgtgattgacttaagaccacagtgaggttacagtgataataaatcattcttctggagaattgtgagaattttctaactgttggtgtgtgtaagtgcaaggtaggcactttgcataattgtatagtagctgacattcttgatatgccagtttcaagtcctttatatactttgctaacttgctgatattaatttattaatacaggtttttaggactcccctctcttatctaaggtaactagcttattaaagctcatattaaagaaaacaagtatctgtggaaatgttcttgtgggtaccagtgattctagagccttacgttaagaaacactagtctaatggatcaatgtataggtaaatgatattagacattttgagtaggattaagatccaggagactatctgaataatgacctttctctctctttctttttaaaatatggtcatcctaacgcgtatgataacccagatactctttctttttaaatacccttttatttaccaaccctcttaaacctggccctgaagttaagatcaacagctatgtgtgaataatttttttccttctcctttgctttgcttttcctatcaaattgaaataccctgccactttcttccctctctgaaaacacaaaagaggattaagccatataatggactatttatgtgtcaaattaaacgttttactctgaggctgtttctgagttatgcgagcagtaaaaatatgtattaagctgccaagccttttaaaaaatgcatgttatttagctgatagcctgtaacagtctgatggacccataatggtgttttgagtaaatacgcatttgaacaatttatgaaacttatgtttacatgtgtattaaacagcctgggtagggagtgaccaaaagttattaccagttgacagctgttgtctggtgaccaatttgaaatgaattggtggattcccttcagtgcggagtaaacaggtttcccagtcaggggagcatgctgaataattatcagtgtgtggggcctcagccctggaggcctgtgtgttggttgaatgaggtgctggaataaaatgtctcaactctacagtgaagttgcaccttagattcacatttatgatctagtttattttgtacttggaaatttataattatgttcacagagtacaggctgtgcataacaatatattctgcccttgggaagagggttcatgtttgtttatttcctttttttcttttttaactgacatataatcgtacatatttatggggtacatagtgatgttcaatacatacaatgtatagtgatcagatcagggtaattagcattccatcatctcaaacatttatcatttctttttgttgggtgcatttagtattttccttctagctatttgacaatacgtaatatattattgttaactatagtcatcttccagtgctatagaacactataatagaacttactcctatttagctgtagttttgtatcctttaacagagctctccctatcttccccacacccccttgtttatttctttgacattatccatctagggaaatgatcttgaaatttttatgatgtgtccatatcaacaatacatattttatatttgttcacttcaaaattatatgcatatttacatgtgtaaattttattccaaaattaggagtttaaaggattgagataaaaattaattacatatagataatttgattttctttttgtacctgaatgaatcctctttggcactgtctgggatgtgcagattttgccttggagattaaggcgagtgtcttgaaacctttgtgtaatgaaaagggcattgtggattatagtcattcataaacctgggcaaatcattcagctaccttgaggtctagtttcctcatttgtagaatatggatccctgcctggggggtttcataaagactactgatagtaaatgtcaggtgtctaccttgaccacaaaatcacttcctcagagaggctttccctgacctcttttctccatgatagctcctcttttcttcctgatcactctctaactccttaccttttaattaattaattaattaatttttttttttttttttttttttttgagacggagtctctctctgtcgcctaggctggagtgcagtggcgcgatcttggcttaatgcaacttccacctcctgggttcaagcgattcttctgcctcagctttccgagtagctgggactacaggtgcgtgccaccatgcccagctaatttttgtagagacagggtttcaccgtattggccaggctggtcttgaactcctgacctcgtgatctgcctgccttggcctcctgaagtgctgggattacaggcgtgagccaccgcacccggccttttatttatttatttatttatttatttatttatttatttatttatttatttatttgagacagagtctctctctgtcggccaggctggagtgtagtggcatgatcttgactcactgcaacctctatctcccaggctcaagtaattctcctgcctcagcctcccgagtagctaggattacaggcatgtgccaccatgcccggcttaattttgtatttttttttttttttcagtagagatggggtttcaccatgtcggtcggccaggctggtcttgaactcctgacctcaggtaatctgcctgccttggcctcccaaagtgctgggattataggcgtgagccactgcgcccggccaactccttacttctatttaaaacaactttttaccatctgaatgaatattatttaagtttctactggattgtaagctttgtaaggggagatatttttaaaattttacttttttggtctgttactgctgtatccataactcctagaatagcatgtgcatggcacatagtaggtactcagtaaatattagtcatgatttgaatatttcataacttagtagttgactaataaatagaggctgttactgttttcatggagtatcctacatataatatagttggtgttctaggatagaagacataattctctatgtatgaattgctctcactgtcacaggatccttagggtgtcacttttccagctggaaacctctgtggcctatggtgcctttgcccaagttttgctccggcctgctgggcttgttccacccactcagctgggcaggctgtgctcaggttttgctgccggcctgaatcccatgcctgccaagtgtgagcaggcgcagagcggcaaggggtgtgtgagcaagtgcagggtccggccactggcacagccaggcatgctggctgtggggtgggcagctccatatgaggctgtggctggaccaggtgtactgcaagcagcttccactgtgggcactggggaatgcggtggcacctggaagcttggagactccaggaaccacagaaccccaaacagggtgtcacagtcctggcttgtagagccactaggtttgggcttcctgaagggctgcaactcttctctctttctcgtcacctgcaatgtggctattgggggttgtgttacacccctttcagtcccgcaattcagcgggtgctgagttttgtcctgcatccaggaagaatgagatacgtggacaaccagagggtgagcaaggcggagaggggcttcatttaagtgacagaagagctcttaggagatcagaagtgggtagctcccttccacagcaggtcatcctgacgagtttccagctgtcagcagagaggagacccatagtgggtaagtgctttccatagtcaggttgtcctgacaagttgaggagacccaaagtgggtatctccttcctgcagctggtagtcctgacatctgcctgagtctacctgagtccgagggtttttatgggctcggaagggaggaagtatgtgctgattggtccatgggtggccatgagtgggcctggagaaagcaccgtaagttcttattccaagccacggactccagctggaactggcagcctggcccctaggcttcaggccatccctggcttgaagttggggtttcacaggggacctacccctttccgcccaggaacctgtctgcctcccaccgtcaacaagctgtccattgtgtctaggctgtttgtgcagagaggggtgtctgcagacccatgccaagctaccctcagcacccacccccatcctccacttccctcctgcacctgtttgcagccaaagtccagagggggccgaggtggcagagggctggtgtgtcaacatcacctgagctactgtacacctgactgggtcgcggcagtgcccagtctcagccacaactttgctctgcaccagagcaggtgccgggagtggggagaggccagggagtgggagcatgtacttccaagcctatgggagttgggcccccgagaacacagggatgcctgggtccagagccacagctgggcagctgcagctgtgcccaggagtgcagggctcccaccctgctaactcggtatggggtggggctcctgtcttttcctggctgtgcctcccctgctgcagcatgggccgctgctgccatcatcagtgggacccaaggcaggaagtgttttttcctgtagggaggatagatttttttttgtctcttacaggtagcatctggcaggcatgtagaagttagacatgaagcctccacccatggatctgagccaagtagactgacctgtgtaagcttcagatgcctcagtcttggtctccttagctccctgtttttgtcaactgtgccatccagctgagcaccttagagcttgaagctgagagcttcagcggggccagtgcctacaagggctgtgtgtatatgctttagaggtgggagaattgtgctgccagtgggcgtttggcccactaaggagaacacctgtgacctctgcaatcttccctacccctggcattccaagtgccattccaagtctgtagagataatagaacaaacgtaattttttgtgtggttggcaacgaagactggaggagaataaccacacctttggaagacttcggtggtcctttgaaatgaggagtttttatagaaacacttatcattttaaagacctaccatttttaaggtcactcttctgctagggctgtgaaatacagacatatgaaatgttttccagtgttgctctggtacttacgtgtgtgatgattttattggagaaatggatgaatatgaggttggagagtctttacatgtatgaactatcaaatatacagttcagtagcctgaaaacattaacaaatagcttttatttattgtatccttatgtctttcaatttggttcttatctgttgtctcttcagttgatgcaaatttgtgctcaacttttcctgaggggaaatggagagatactttcttggattagcttatgatcttgaacttgactattttaaagagtcatggtatataccaatctggattgtgtttaggatggggcttgggggatggtttctttgttctcttttggcccacgtcttctaacaacccatttgtttagggggttttatgctgcttagagtgagctgagaatgtgctcaagcacataattttagcctgtttttcaggtttacatgaaaaatgtaacaggcttctgaaacccctctaggttccagctttcaagaggctggtcaggaatgcactgaccgagagacttccctcaaaattaatttataaacacgctagaactttcctcaccttaattttgagaaaaagatctctctcatggcattttcaagtgttatggtagatggaaataatgaggaaactgtggcaccttgaacagagtgagaggtttagagttgtatagaccttagtacaaattttgactctgtcattaattacctgttctgtcatgagtgagttacttaacattccctgagcctcagtttcagcatctgtacagtgaggattctatttatttcatactgttgtggagacttgagcaacagagtgtgaaaacatctgtcagcgcctggtgtattttggacattctgtaaatcttagcagcccatttccccattctgggggtaaagccacaggacttttttggcaaatagttgagatacttggtgccaaaaggaaatttaactcatgccatgacaagtttttttgtataaggatgggattctggaaacatgataattttttctcttggccatatggattagcaaaggctttagaaaactacaaaaaagactaatttgttgcctctggatgtgtgtgttattttgggctgttaatatacttgactgcttgtttcaaggactggaaccttttcttttacctttaagattcctgcattttcatgtgctcattcagctgggatttgtgtttcatagaactggtagtattggaggtagaggagatactgtgatatcatatctctctctctgtctgtctctctctctctctcccactgaagaagagaagacaaaatttagagaatttgagacttgctcaaagttgtgtagctagttagcgataaagctggaattgcaccagatttgatttccatgacattgctttagcctggtggttctcaaagcatggttattggaccagcagcatcccttgggaatttgttagatatgcaaattcatgagatccccattcccttatcagaaattttaatacgctgtgtagggtgattctaatgcctgctaaaacttgggaaccactactgtggtctttacactattgggcagggagatgggagactacaggtagatttgctgaatttcatgggcaacactaggttttcattttaccttattgttctgccatttagatgtctcctcttaaaacatttttacttgcagtgatggcttccttagactcgtgtgtgattgttgctggggcagttaggtggaactaataggtgttgcttgttgattccctgctaccaagtactagttttgaaatttgagtattcattaaaaacaaatagggatttctgtgtctcactcctggaaattctgactcagtgggggtaaggattaggaatgtttaatttttgaaagccctgcaggtaattttttttctactttttaaaaattataatttttattttctttactgttcttttaagacatcctgttatagcatctgcaggtgattttgatgcccagccatgtttggggaaaaaagtttgggttctgagtgaaaatagaaaacgtaatgacatggaaaggaagtcaggggataagaaaagctctatggccagccatggtggctcacacctgtaatcccagcactttgggaggctgagatgggcagatggcttgggctcacgagtttgagaccagcctaggcaacatggcaaaaccatgttcctattcaggaacaaagaatagatcacaaattaaactctgtgggttttcataagtggaaagttggctttcgttgttctgtatttgggtgcttagtggacaggagttatctaaaagaagtaattatagttgtaatgcggaccctcaaagttgaaagtagattgaaatccattattttacaaggtggccttactatttatagtttgactgtaggtatggcagtgagagataaaattactttttctagctttgcaaaacgccaaacgtctttgaaattaagagtaaaaggggtttaaaatatgtactgctttataaagcaggaaaaccccactggaacattttgggtgtttacagaaatgggtattccatgggagagaacgtggtaacctatgttttgtcatcatttgtttaatcactgaaaatatattaacaggccaggcatggtagctcatgcctgtaatcccagcgctttggcaggctgaggtgggaggattgcttgagcccaggagtttgagatcagcttgggaaacacagtgagactccatttctacaaaaaaagaaaaaagaaaaaaaagtcacatgtggtggcacacccctgtggtcccagctactttggaggctaaggtgggaggatagctcgagccccagagatcaaggccgccgtgaactgtgatcgcaccactgcactccaggctgagcaacagatcaagactcttgtataaaaaagaaaaaaaatttttttaaaaatataaatatagattaacaaagtaacagggaatataatattttcaggttggtcatatagaggaaatactatattgtgttattcagcttaataaaatataaaacaaaaaaattattaactgtttgaaaaattgtagtcagatatttgattaggggtaggtcctgatttggatgaatttgaatcacattcgactaaatattgtgctttttaatactcactttaaaaacaaaattaattgggcaaatgttcatatccattttaaaaaactatcctcttaaaactagattgatagtagacattaataggcttgatgttgtttataatattttgctatattttaagagcatgcttttgtatattttctgttttagtgaagcattttaaaaatgcccccctcccacaactgcaggaataaatctaacagattttgaccaaaattactctaattttgaatttcttgaaactgggtatggaaactagacattaaaaaaaatctttatttttaagcacggtttcttggtcagtagcttctgtattacgggagaacacaagaaggggccttcttgacactcaagaaatgctctttttccatctacaaataggaagacaccctttgtggtatttttgttttgtgggccctgaatgaaaacgtattatgatcagttttaaaaattgctgcccctttaatatctgaatatattcgtggctagtgaagcacatgcatctgtcagatcatgggtgagaattcacttttctttttgcgatttctccagccacaaggacaaatttagttttgcagagcagtttgacacctctagaagcctgcggttagcctcggtgcacctctagcagctgcataggctcaagaggacctctgttcttccctttttggtttggttaccttacccctcctcagggaaaggccaagagactcagcacttcctccccaagtgagtttccttagtaacgtcagccttctctaatgctggccaagggtgtctttgctgggctgttttccctccaaaatagactcactggggtatagaattttttttttacgtgaagggtatagaattattttcagaatagcagcagggtaattaggctcattgttgacatgtcattgaagtctccatgtgacaaaattgctcctccctctttgagcactctgaatactcttaccctcttatctcgatctgctctttagaaataccagcagataatctgggagaaggccaccatagccatgcacagagtggggagaatgaggagatctttgctgaatgtcttttagttgtttgagttggagataaatgcagaatgacctccattttgccctaagaacctgaccttcttgtcactttgtgtaacattaattttctaatgtgttctggtcaatttgtaaaaagattttttttctagtgtctcagctgttggtttgacttttgtattttcattggtaaaatatgtatgtctttgctgtgagcagagagaaacagattaataaaaaccactgaaccagcattgcatatgtaattaattaacaccaccaggaaagctggttcatggttgtgtgtaaacttatttccaaacatctaaaaaacgtttagagttatcttattcagttgtctcacttctaagggataggttaggaagctgtaacgtatgtgtatgcacagaaactgttggacaatgattctcaaactttacttttcattaaaatcgtctggagggcttattaaaatgtagattgctagacctcatccatagtttctgattcagtatgcctgggtggggccttaaaatttgcatttctcatgtggccccaggcattgctgatgctactagtccaaggaccttactctgagaatcagttttaggatgtagatcttatgttcctctttgccaagggcaaatgaactgaattgtataggcttccttttcttttacaagaagcattgcctcttctaagtagacatccaccaaatatttatgtactgtatccatggtgccatgcactgagctaggtgcactggggataaataaaatgatctctgccttggggaactcacagttgagagaggattaaattaagaaacccaccaatcgtgattcaatatgagaagtgctgtggtgatgtcaggggtaggctttctagatttgctatgaggtgcagtctgagctttttctcagactgtcttagctttatacctacagaaataagtgaaagaaaatgaatcttctgcagcttaggattttgttagtgctcagatcagtttcctctcgtccttgactttgggcatcccaagctctgtattcagacactcctgaactggcattgtgagctctccaccccagcttttgtggaagagtccttcctccatttttaaattacaatttcagacactgtccactgtggcagcaggatttgtaacaagaccaagttaagtgatcttggctgaactgatttatgagacagcttcaaaaattcatgaggtaccatgggaactttctgtagtggatcagcatgccgcttttccttcacttcttcaagtagatcagacattttgtgataacacggcagtttatagtggagccttctagattatggctctgctgattaagacactaagacagacctgaagacaaagagaagggagaacaggatgttacttttagaaactcctgttatcctaagcttgagcagggactttgggtaaaatacatctatgtataactcaatttatacatagaactctctagggcaagtttttctccagtggtgatctgatatggagtgtcttggccattaataatggtcccataattttaagcacaataaaatgttaggtgtgtatatgcgaaaaattgagtgacatagtagttgtctctcctctctttgtgaaaaccggtagacaggaacgaaggatgtggccaaaaccagtgacaggttatggtgctttccctattttattgattgctcatttctagtctctaaccttatttgctacttattgatctagtagaaaagcaaataattttccctagatagtattttgttgagctgggctttgatgacttgtctaccaaagggtttttaaaaagtacttacctgctgagtggcagcctgtctaccatttaatgttattatctgtgagcctgggggttccttcttagtaggatcactgatgtcataggctgcctctttattctgcctactttcctgcaagataccacacatgcccgtggtctgctttaatggcctcacagtgcacacagccttagacttaacacaagaaacatatgagtgatcccattggagataatgtgttgccgagtcaatttgggtcagcatctgccaacatgtcaaattttcacactaggttgtattttgagatttttattcatgcttttgggttcaaatttactcacaaataagttttgaacttttaagtgctaaaactgctgagttcttgactatctgcacttggggaggggaaggttaaagataaggggtgggtatgtatgggaaggaaacagtagcacagatcatctaacataggaggtaagatagatttcccaatgtcatatataactttgactatatattttttcctatgtttacattctcctgtttatgattatactcttttggttcatattaaattggtgtttatctcctaggaatatatatggcgaggtgtgtcataggaagcaatagaaaaagaatttggagactggtcacttataattcttgaataatataactatgtagagttaaaagcaaagattgatcctgtcattcatgggattgatgggcatttttgctggtatcttattattgttcatttctgagtaggtaatatattaatatgatcccaaaagcaaaattgtattaagaagtatatagaggaatgtctcactctcatccctggacctatgtgccccattcttcaggcttttataactactttattagtctctattacatcttttgtaatttcttaaatagtgtgtgtactctcctatttgtgtatgctctcgctttttctgccctttgttataccatatttagcatactataagcactgttctgcatcttgctgttttgtagttaccaatatatcttggagatcattccatctcactacagagagagcttccgtattcctttttatagctgcttaatatttcattgtatagctgtaccataatttacttaacctgtctgacactttggttatttacaatcttttgctcttacaagtgatgctgcagtgataatgttttttttttttttttttttttcccgagacagaatctcactcttgcccaggctggggtgcagtggcacaatctcggctcactgcaacctctgcctctcaggttcaagcaattcttctgcctcagcctcctgaatagctggaattacaggtgcccgccgccacacctggctaatttttgtatatttagtaaagacggggtttcgccatgttgtccaggcttgtctcagactcctgacctcaagtgatctgcccgcctcggcctcccaaagtgctgggattacaggcatacagtgaataatcttgatcatatggcatttcatcctgggtgtgtgttcagttgtaggataaattcccagaagtgaaattgttacagtgaatgtgcatttgtaattttgatagtcactgctaaatccctctgtagaggtcgtactaatttatattcccatctgtttaagagtagagatttccccgcagtcttgtcaacagggtggtggtgttaaacttttgaatttttgccaatctgataggagaaaattggtatctcaaagtggtttcaatttgcatttcttattatgagtaatgttgagcattatttactatgtccaagatctgatagtatttccttttgtgtcatcaacagtctggttatatttctttcctgttttttctatttgattattgctatttttttttaatttttaaaataagctattttggaatacttatagacttaccaaaaagttgcaaagattacggggattttttttttcttttcttatgccctcattagctcgttaattgggttagatggtttgaggaaggacaggtctcctggaattctgtggcttgtcataggtttgtcagcccaaataaggatgcacatccaattcacgactcctggctgcctctggggattttccatatggagtgacagacttgggaaattctgctgagcttctgactagcctccattatgaggcatataattcagagcccatcttccattattcttcttttactagtatcaattattaactagaaaggttattgaagtgaaaaccttgcctcaagtttgtatttcttgagatttacttccaataataaatgtggttttcaagtgactgaatctttcatagaccaagtttcgagcacattaaatatttggtggttttgcgtcctctctgcctcacatgctaattgagaggatgagtagctataatttttctggagcttcaggctgtcattctgtcctgttaattggttcttggagtaaggagctaaaatgtggaggcagaaatgctttcccagatagaaacatgccttgaagctttgtgtcctgtaagggtccacatagcctggaagttaagaatactggctctggaataaaaccttgtggattcagattcctgctttgccactgctagatgtatcacctcggacaagttacctaacctctttgtacctcactctctccctgtttataaaatagggattagaacagtacctgcctcatctagtagttgtgaagattaaatgtgatgagacatgtaaagtgcttggtacaggcctagaacattgtaagtgctcaataaatactggccgaaaagtcgtacagggcagtggtttcagaggccatgcaataaaatagtgggttatgttgcatttgacttttgttgattaacctttcttcttcctctattctttaccttgtgaggcacttaacctactaactgaaatgccattcattcagccagtatttgagtgctcagcaagtgccagactctaaacaagatgatgtgtaagatgctgcaaggagccctcgtgccttgcagcctgagcacaagtgcctataaacgcaaggctggttgtcgtcattgccatccccagtatactttgagaatacaaaagaatgtgaggtcactctcctttgactggggtgacgaggacatgcattgtgaaagggggaactgttagaactgggagccattcgtaagtgaaataaggataagagggatattatcagcattgatgctaattagcatttctgtagcattttgcagtttgggaaacattttatgtattttattttatctcagtctcataaaagagcttgaggtattattatctccagtttacgactgaagagatggggagtcaaataggttatctgattctcccaatgccatacagctccttggtggtggagttggggtttgagtccaggtctcctgactctgaatctccacgtgcttccctctggtctcttgagtgaaataacccgtactagcaagaaagagaagagtatgtcggcaaaagagaaacctggaatagttgccaattgtccctaggttcagatcacatacttctagggcatcagagctagaaggaacatgagatcagtgcatcctctttatttgactaatgaaaacattgatgtgcttgtgagggacttcgagaggtcaatgtggtgctggaagcagctcaatggagagggtagacagttccccttggatgctcatgtgtggtcttctggggattgattagttgctggtaaggaaggagctcattttggggaaagtaggtacatagattcatagagggaaaacctttattcagaagcaggcagtttttctgcaatatcttcctgggaaacacaaataaaagggctgtagtttagtattcagatgtggttctggttgtgcaaggataaggagaaaaggcagaggcagggtgagaaggaaggaaaatgaatgactgatttgaaaggtcagtgagaagtctgtgaaaggtacatacttagggtctgtagggcagtcatttgaaatccaggatacttagtatatatataggaggacttcgtagtagttctctgactggaagaggactgggctgccttgtgtgtgtgagctttcatcatgggggcagtggttactacatgctatttctaagaattgcacttgtggggtgatttctactttgggtaggaggttattctaggtagagctagtgtggatcagcaacatcagcaccacctgggatcttgttagaaatgcagatttggggactcctaccctagacttactgaatcagaatctccagtgggtgcagttcaagaatgtgtattttaacaagatctccaagtcattggtctgcatgttcaatgtttggaagcattgctctagtgcagaggctctccaagatcctcctttgggttctcggcttatgtgattaatgtgccattcaccaaacatttattgaatttcacttatgtaggcacagcacaaagccaactctcacatggatcctgcttgcattctagttgaggagacaggattgtttacaagtaactattaggttggtgcaaaataattgaagtttttgccattactttcaatggcaatttcagtggcaaaaaccatggttacttttgtaccaacagtataaaaacagtgttaaaggctagtacaggaggcacagagaatgcctgtgaaagtggagggtggacgttttcataggtgtgtgcgggagcaggtggcatgcatggtagggggaatcattacttctgtgcaggactcctgagtaattttaatctgtggtttgctgctgtgcaaacccagaggcctgtctacaacttgtttaacctcccccagcccttgactgggtttactttattggcctgataagtagtataaaaattggcagagctattaagatgactcatggaaggatatcctcagcatctccttttggatctcctcacacctgcactgcttcttcttaaatgcctgaatatccaccactttgtaaaagaaaaaaattgatttgtcactgaatttccatgcctcagcctgagagaaatgtaaatgttgtactggcctttagtactctgccttcaagcctagatttagagctgatcattatacttttagagtaggctaggtatgaaaatagcagcaggttgaagagtcagaggaagctgtttgctctcatctgctggtttggtcagggtggaagtacgaatattaatacagtccacttaaacaataaaatagctcccagggaagaggaactataaacttcagtaaatatcagagatgttaaatgctaaaaataaaagctctctgcagttgtttggctctttaaagagattgtttattggtcaagagtgctagtctgtttggtcatgttttgctagctttttaaaatgcatgtatgtaaatgaattagaatataagttaattaagcagggcagtgtttctagaatgtgaaaatagtaacctggctagttaatttaattaagtccttggtaattttcttttagaaacaagtttcatcttgggaggtcacaacgtcctggctgctgtgcttctgagctttaccttgactccatcctctcctctctgtcatccttttctctggctctgtcacttgcatttgccccctgacttgtcaccctgacttcatttcctctctcccagctgtttacagtgctatcacagtggtctttcagaaatcccaaactctgctgttgaactgggttctaaaaaccttcagagacttcatgttgtccataggatacactgttttctgaactccttagtgtgccatattaggctctctacagtctggctctaaaatacaattttttttttttttgagacggagtctcactctgtcgcccaggctggagtgcggtggtgcgatctctgctcactgcaagctccgcctcccaagttcacaccattctcctgcctcagcctcccgagtagctgggattacaggcgcctgccaccacgcccggctaatttttttgtatttttagtagagacgggatttcatcgtgctaaccaggatggtcttgatcttctgacctcgtgatctgcccatctcggcctcccaaagtacaggcatgagccacggcacccggcctctaaaataccattatagcctaattttcaggcttactttttcttgtggtccaggccacaggactatctgctattctcaatacaaataaaatataaccagtagccaccctgcagtagtagggacaattcaggtgcctcgacaagcattgtctgattacactattcaatacaggatcaaagagttttgtcatttgcccaaggtcatgtaccttgtgttagagctgagattcatattcagtattttgatattctgactcagtttcctgctttcatgtctctgtgctttccttgtatgttttctttctttttttctttttgaggcagggtcttgttctgtcacccaggctagagtgcagtggcacaatcacaactcactgcagcctcaacctcccaggctcaagtgatcctctcacctcagcctccccagtagctgggactacaggtgcacaccaccatgcccggctaatttttgtactttttgtagagacggggtttcaccgtgttgcccatgctagtctcaaactcgtcagctcaagctctctgcctgcctcggcctcccacagtgttgggattacaggcgtgagccattgtgcctggcctccttatgtcttctatgcctagactgtctcctaccctttttctttgcagacttggaaatgtataggtgttaggtattcctaacaatgtgcgtgcataggtcatcgggcctatctcaatttagcctgatagtgtaaatactagtactactactacctagtgctagtactaagagctgatcccagatcttaatttttcttcatttctcctccaaataataggcggtttataagtattatggaatgaatgcatggatggatgaaaggatgactggatagatggatggtcagtcccagtggttgggtccgtttgtgatttgaccaagttcaaggctgtagaattgctatgtggaaagaatgcatattatttcagctatatcaaatagcacctagggacggcctgactgacagggaacaaattgtcagccctcatttggatccaagtggaaattaatctgaagaatttggaatgggcctattcgtgggaaattgcttatttttataagagtttattttctgatttgtggctatattcgttggctagggccactgtaacaaagaccaggtgacttaaacaatagaaatgtattttctctcagctctggaggctagaaggctgagatcaaggtgttgagaggtttggtttcttctgaggccaatctctttgtcttgcagatggctaccttgctgtgtccttacatggtcttccctctaggtgcacatatccgtgttcagatttcctcttcctttaaagacagccgccatactggattagagcccaccataaagacctcattttaattaattacctctttaaagaccttctctccaaatacggtttcattctgaggtactgggggttaggacttcaacctacaaattttgaggatacctcattcacctctacccaacccatcccctctgccttttcctcttgttgtctttcttctggcagttttgtttcactcaagggcagtcaggaagagaagtaaagatagaggaaaaggaaatttattttgggtgcagttcaggaggtgtagctggggttggggatgggcagtggctgaagctattggtggaaatgagattttgatattgcctatagattagtattgtcctggaacattctgtgctggtttcctggacagccgatagctggctgtgtgtgttggagggcccagggaatatctgttctgttagtaagtgagggggaaattgataatcctgcagccggcctggagaagtaaggactctatctttgtctgtcagctcttcctcccagaagtagctcagagacttgctgagcacacctagggtagaggccaggatagttgagttttggacgctctgccttggctaacaccttgcctggcatctagcagatgcttatgaaatgtttgtcaaattgaattacttaatttacttgactcaaatattttgttcttctccaaaccttttatgaggagttttttctccacctttgtttgttaattcccaaacttctctccagttctcagttgtggcttatgtcttttctttcctttctctttgtaattatcaggtaatttattaaatggagacaagcttaactagacattaaataattgcaggtgtgcagctgaactgagccgctgtcctttaactaggaaatcacagctgcttgtgttgtattgtgtgatgagattacacttcacctcatttggttacacgatatcttgcttattgtaaggtaaaagaatgttgaagcttctgctctaagcagtacacaaaggctggtatgttcccaggaaaccaacgtaaaaagtacttggaggtcaggtctggagcctttgcaacctctgatgcttctcttttcttggaatttttcatttcctttgcctttttctgtatagagaacacctgaattactccttaacttgagacctgtttcacattttaaaattttcttttggtcaccttaactgtaaaagcaagatttttctgtttccttctaagagattagcagtgggtccattggttagctctttttttgctttcattatcagacctcatctgcatactttttatacaaatttgccccattggtaagaattgtagcttttatgaatgttaattttagtcataggttaaattgtgatgtcaccagtctgttttctttggctagtttcatagtttgtgactattgctagaggtagacactagttatatagcaagtacctagcttattacagaactcagagtatgctgctaataaaggattgcttgattgcttgaagggtatgcaggtgtaagaaatattcatctttcaattggtgtcaaaatttttatttaaaaaaaaagtcatgctgccacttcccagctttgtaactttgggcatgccactgaaatatcttaatcattagatttatcatctaggtagttgtgagggttaaagaaattcaacaaatatttgaatgaactatcttttgtgcctttctggatgctagggatatatttgtgaacaaagcagaataaattcctatccttgcgggattaacatatatgaatctggttttgactgtcaactggatggagtccaattggtgggagaacatgatacctaccatttatgaaaaactctttaaactgaaatatgtgcctaataacactaactttctttattagggacattttaaccccatttgggctttgcagagtaggtcttagagaaagcccttctccatacttgttcgttcagtcgtgtatcatgtacagccatccattttatggttttggctgttgtaaataaaatggctagagcctgtgcatctggagttgtggtgactcttagtcttgggatgcgtgcctcttcctctcggtcgttgctttataggctgtctctgaggttccagaaggggctcagagaatgagctccaactgacatgtttgagcctttgagtctcttcatgaaagctcagtttgttcaagtaaaatctgaatggctcagagaggacactgtggtgtttagcttaccaagcccagtgtgatatcactggtttgttaatatctacagaaacacacacaggaaaaatattctagagcatcatattgctcacctcctctaaattcttttttcatggatgatcgaaagaaaaacctttttgagtctctctcttcttttttgtgaatgactaatagaaagaagacgacactggtaactttcagaagcattgtgatagcattctgatggtgggattatgatgttcagacatgggagggtattagcaaccaaacatcatttcctttaggggactggaggtagtggtcatctgtgagtctagagctgtcttcgagggaagtgagcagtggctcttccaaggacacagagatgtcaggcacctctctcatgcatgcaagtgctacatattatgtccacagtatctggagtatttaaaccaggaataacacgtagtctttattattggaagaaataaattaggtcagagttagtatgccatcgtgtgatgccagtttgtattctttattttctgtacttgcttctagagagggagtaaatactatgagataatgaagaaagacatgtttttgtgacttttctgatttaggacactttatgttgtggaggttttttgaaggatttggaatttggttgcttattgagaacctcttgagaaaatcagattatctctgatacacaaccagtcctacattgagttttttccatttattgctgtagagacatgaacatttatttttattgaagctgagagaggggtgttacatggttgtttatcagctctgccaaaagtagctcagacatccctgatgactcagctgatgcccttgctgcctgattgggtgcttgtgtactaagtacttgtttccttgttgagggctaggaatatgtcacaaagccccattgctgtggggattgttgcagtgagcagacttagcggaactgcacaaggctggctagaggccaggtttagactaccttggaagaattggcttaagggcagaggagaggtttagaaaactcctttcttcctctttggtggcattaatctttgcgaaaccaggctcagactccttttgcacctttcccaggaatggggtagcatagatcttcttcctatgtgaatcacagaaagggactttgtgtgggtgctgtgtgttcattgtaaaccactggtgctgctatctaggtggagttaaagttgataccagcagagtaagttagcctgagcaggaggatggagttctgcagtacagccggaaattttcacttcatagtgtttctactgtaacttctcaccctgtgttgaaaaaggcacacctggccattcgcatagtttggatacgttttaacccataagagtgctgtccttaaagatgatgaaaagagacattttagctccttggaaataagcacatttctgaaaccacccgtctgagtgcacacttgtgcagataaacaggtacttttgtttatgctctgactcaagtggaaagggcaaaataagagattttccttctcctgagtcttttcactgtgaggattttgtcctttaaataaaataaaccggaactgtaacctttattatgggaggagtgtggaggagttaggaatgaggcaaaatgccctccctgtttctcagataactcttgctaccgtctgagcagtgtttatttaacagatttaatgcattgcctcaatagcatcacacgaaacatgtcaccccccctttttagtttcttcccttcaaaaattttcttaaaaatgccagaaccttaccaagtcacttaaataaatcagtccaagtatgaaatgatctctgaagtgacttaacacaaatgattctgactttactacttgggagactcttttttgatggccagccctctaaattgtaggaagatcattttctagctccctattgtcaaaaaacaaagcaaaatcaaattaaataagtcccttaattcccataagtaattttaaaattatctcttgtatatactttacttgtgtgcagcttgcaactgaatatcattgtgagagctatagtttgtcagggtttagatcttaattagctcatgagattgcatccttttgaagctgtataccacaggttgttggctagttttccaaaagcaattaaaatgcccactgttataattaagcctgttactagttgtatgttctagttataaaatatatttggcaattaaggaaactgagattgaggcttttggcttggctctttgagatgcagtagactggcttccaccttgatctgttaggatgactggtgcggatgcctggatgatgggacatgtcttagtccttgagtacctatctttatgagtaagagcaaccacaggtttttacaagaaagctaaagttagagaatgtgactcgtgtcctcacatatgccgattatgtcctacttggtatacaggagtcaaaacctaaacttctaagttgcagtctcttagctgagaagtcctttttaaagaagcattcccttatctttaagaagatggctcgactctgactgtgaacatttaatctgttaaactaacacctccattgcgctgtttaaatttctgtctggttgttgaaaagaaggtgtgggagaaatgttgcaggtacatgtggttaatgtctgtttctgaactgtatttcatttaggagttgttaagctgtgtgcccaccatctcagagacagatttgtctgaactggcctgtggaggaagatctcattgtcagggctggtctcaatggcagatacagttctcagtggtgtgctttgcgtgtcgtgtcttttattcttcctttcctcctgctcacccttaggaatgtttcctttttgtgccttaacaccagaacggtatggtggctgagaccatgggacaaatgcgtcacttagtgggcagatagaaatcagtatttaaagtatgattgaggtttttgtgtttattttgaaattcatttagtacacagggaagaaaacagcacttggcttatgtggttctatcccattgctttgcctgtttgtgcccccgtgcaattaacatgaaaatgatagtttaagaatgagctcattaacatttagaactgggtaggaacagggcttcataggatgttaaaatcagagaaaaagagaaaagagcaggtgctttgtaaatactatgtggttttgagaaatagtagaaagttgggtcttattttaaatttccttttttccagagtccctttaaagttgtgattaatgatatacattattttctttattgggcaaaatattagaattattagagatacatttttcttgggaaaaccactgtggttctctggacatttctatgttaactgtgtcatatattagtatagaataaattcacaggcttgtgggtctgaggacatttgcttgtttcctttaaatcaatttatacaagcacttcctatgcttccttcctaacaaattttccataatttatttctggcctcgtaaaaatagagggaaaataaccaatcaaattattagctcgattccttacatgagttcttcaatttttcctaggtaccaaacaaaataaaaccagtctttgtaacaaagattattggttctgaggaaatgactatccacaaagtgtacatttgtgtgtaatatgtggtatgcattatgtgtggtattttacagttaaaatacaacataattaccataaaataatgtatatgaaatgagttgtaacaataagataagattgacttttaaaaataaacaaccaagaataaacacagcagaattcctaatcagccttactcataggtcaaatttagctttgatgtcctttcctccataagccatatttaggcatcaattcagtataatactccttctttgtgctcccatatcgcacttcatccttccctcatcatggcacttactgtgctgtgttgcttgtttggctaattccttcatttggctataaactattaggatatgagcagacatggtgcctttttcactttgtcctctgaattctttttttaaaaattgaagtaaaattgacatgtaataaaccttggatatttagtatacaatgtgttaagttttagcttagtgttgtccatgaaaccatctcacagtgaggatcatgaacacatttcccaaagtttcttcacgctcctttggaatacttacttctacttctcttctttccttgtcttgagacaaccattgacctggtttctatcattgtagattaattgacacttccaacaattacgtgtaaatgaatctcatatagtatgtactgttttcttttccttggcttctttcacttagcataattaagattcatctatgttgtagtgtatattgataatttcctttttattgctgagtagtattccattgtatggatacaccaaagtttgtttatctatttttaaattgctgagcatttgagtaataccagctttttgcagttataaataaagctgctatgaatactagaatacaagtcttcgtatgggtatctacttttgtttctcttgggtgattatgtagggtggaatggctgggtaaatgggcaggtgtatgtttaactttacatgaaactgccacagttttctcaagtgttagtaccattttacattcccactagcagtgtatgacagttctagttccttcacatttgtgccaacacttgatatagttgatattggtaagattttagccattctaataggcatgtagtaaaatctcgttgtggtttacattttcctttccctactgactagatgttgagcatcttttcatgcttttgctgtccatatatcttcttttgaaaaccatctgttcaaatcttttgcccatgaaaaaaaccttagttgtttgttttcttattgagtttcaagagcttttgtttgtttttattgacacatgattatatgtatttacaggggacagtgtgatgtttcaatatatgtgtacattatgtaaaaattaaatcagggtatttagcatatctaccacctcatacatttatcgtttctttgtgacaacattgaaaattctctgattttgaatactacaatatacaacccatctttggtatcaaattttgaaatatacaatccaatatcattaactatagttaccctatagtgcaagagaacaccagaaattattcctcctatctgtaatcttgtacctgttgaccaatctctcttatgttcccctgctttcccttcccagcctcagtaactactattctgctttcaagagtttttttttttttttttgagagggagtgtcgctcttcttgcccaggctggagtgcagtggtgcaatctcagttcactgaaatctctgcctcccaggttaaagagatcctcctgtctcagcctcctgactagctgggattacaggtatgtgccaccatgcctggctcattattgtatttttagtagagatggggtttcatcacgttgtgtaagctggtctcgaactcctgacctcaggtgatccacatgcctcgccctccgaaagtgctgggattacaagtgtgaaccactgtgcccggccttaagagttctttacgtgttcttaattgaggtgttttattaaatgtatgatttgcagataatattcttccagcctgtggtttgtattttcattgacttaacggtgtcttttgaataatagaggttttaaattttgatgaagtcccaataccagtttgttcttttatggagtatgcttttggtctcataactaagaaatctttgccaatttagggttacaaagtttcttctagaagttttgtcatgttaagttttacatttaggtctatgattcattttgaattaatttttgtatatggattgaattttttttttttgagatggggttttgctctgttaccaagtctggagtgtgcagtggtatgatcacagctcactgcagccttgacctcctgggttcaagtgatcctcccacatcatcccctcaagctgtagctgggactacaggcatgcaccaacacacccagctaattgtgcatgtgtgtgtatatgtgtgtgtgtgtgtgtgtgtgtgtgtgtgtgtgtgtgtgtagagaccaagtctccctatgttgcctgggctggtctcaaactcctaggctcaatcgatcctcctgcctcagcctcccgaagtattgagattacaggtatgagccactacacccagtgtaaattttttttccatataggtatctaattatgtcagcatcatttgttgaaaagactgtccttttccattgaattgcctttctgcctttgtcaaaaattagttgtctatatatgtgtgatctatgtaaaaattccttattctgttccattggtcagtgtgtctgtcccttcccaaataccccacagttttgattactgaagctttatattaaatcctaaaattgaacagtgtgagactttcaactttgctgtttttcatccttcttttaactcttctactggttcctttacctttccatagaaattttagaatcagcttttctgtatccacaaaaatgtccttctgggatcctgattgaaattaaattaaatttgtataccagtttggggagaattgtttattgtgttgagtcttctaattcacagtcattctccatttattttggtctttctgtaaattttttagcagtattcttgtagtcagtattcagcatactttatatatatatatattatgtttactctttttatgtaactttaattcaaaaggtacagagactctcccttagtgctgttcttaagacatgtttatatgacatctttccattagtatctttggtcgtgttcctgcagtatcctcagttgtgctcaccactgcttaactcacctttgcagccaagtttcattttgagtcaaatctaccagaggaggtcatttaccacctgagaaatccctcacttagttttaacagaaataaataactttaaaacaattgatacagctccttctttggcttgtataattttcttcaggcataagtaaaaaaaaaaaaaaaaaaaggaaaaagtgatttcaaacatgttcagagtaactgtaatccagctgtggttgaaagaagaattttgagtggttaaagagctgactgaccatgttggtggctcttgaaacactatcagcttttcttaaccagaaggcaatcaaggacatacttgaggtcgggaacagatatttcataggccactggagtgctgcagtggaaggattccctccagatccttggttcacagacagggaaggtgaagcctgaggagacttggttacttggtttccttggaggatcatatgctcagtgagctcttcctgaaaaccagccctgttcccatcagaaactgcagagacatagtacttcccattcagcaggttacatggagtcagcgtaggcagtcaaaatggagagatgaaggattggtgttgggtaatgagagcaagggatggtcatagaactcagagatgataatgtgaccaacaggatcattattcaaatttcccaagaggcacaaatgtagatgatgattgctttcataagctagtggagttaatttctgtcagacactattctaagtgattttgtatatgaactcatttaattttctcaacaaccttgtaaggtataggtaccgtaattatttcattttgtgaatgagcagaaattaagcacagaggtgccagagatcttttctcataggtgatgaaggtaggagaggaacccaggcagtctggctatagagcacagagtcttaaccactacactgtctggctgatggcaaagagcatgtctattaagaaagcctatggggaaatggtcgccaaatccttctctaattcttggggaccctgagtttcagggttttttttggttttagaaataagggaaactcctgtcaaatgataagattgacatttttcatttttgaagttctaaatgtaaagctctttgaaatgtataggttttcagatactctgtgtgtctgtgtgtgtgtgtttgtgtgtgtgtgtctgtgtgtgtgtgtgtgtataagttcagctcctttaaaagccccatctctgtcacaatcacatttttttttcacaccgcattccaccctactaatactcagagcttagattagggaggtgactaggatactgttaattaaaactatatgacctgattagacaaattaagagaaattttcgatagggaaaagaagcaggacaaggactgaacttctgagagatagtgaaaaatcaaggtgtttttcttattctcagtcacttcacattttacttctgacactagatgtgtggtggattttccccacacaccaagcagttctccagaagacatcaattaattagctgaacttattcaatttaattttgaccctatataccaggcattctgatactgtctacctggagatagtatcagatctcacaatctcagggctcagtcccacacaactgcccccgacttcagacaccaattgcaagttccaggtgatgtgtacttctgaccaaccagctattaatcggggttctcatgaccccctcctcaggtttgattaatttgctggagtgactcagagaacccgggggggaaaaatttgcttatgtttgcccacttattattaagaatattacaaaggatacagatatgaacagccaaatggaagagatgcgtagggcaagataggagagaaggggagtgagtggacttctatgccttccgtggacttgtcacccttctggaaactgcacgtgtttagctcttgcgaagctcatttaaaccctgtccttttgggtttttatggaaaatttattacataggcaggatcgattacatccttagccattagtgactgattcaacttttagcctcctctcttatttgttttaaacgtttgtttccaaagtttttttctcccctttgaggaggacagattcaggcttacatcaaaatggaattaaatgtgcctttgatttggaatggggcaacaagagccgcctgcatggctgtgtatatttatttatatggggtcaggtaaaagcacttttaaaataagcaagtattagagatcagaggttatggagcagctgctggctctggctgacaaagcattcctggtggcatttgccactagctctctgggtgtgggcattagagagtgtgagagttggcctgatggcctttgtgtttgtggccctgtgtggaaactttatagcatttcagccgttctaatctgtgcaggcacagagccacagctgaccataactcttaggggaaatgaggacagaaaagttgaacagcactgtgtgctgtgtagagtatggagaccagaatgaagggtgcagaatgaaaggaaaaaaaattttttttgaagtatcctgcttcagggtttctattgtttgggaaactattcctatagaaatgacatttgtgctttgtgaagggggtggaggtagattttctggagtgtaattttctggagtgtttccttattgaagggggaaaacaaatgattggaaaggctcttcctctgtttctctcatgcatccctacacccccaatatatgcagtgtccttgtttttgttaaatacagaagctatacagagggcagttagagttcatccaccgttttactcattggatgggattattaagagataagaccatttattgcttagcatgagaatcttactgtcccggccagcaaaggaggccaaagatttcatctgaactttacctcttcaattcaagccaccaaagatttattgggagtctactatgtaccaggcataacatatggcatataaaggctaattttaacaattatattgccgtttatgttgttggtttggatagaaaccctgtcttccactaatccttacttttcctataatacaaagattatcattgatgaaacatattacagattattattttaagctatttagcaaatattagacattttcttagagaatgtttgagcatatcagaaattgtggtggatatgttagtttcctatttgctgcaataataaattaccacaaacatagtgacttaaaaacaacacaaacttttatcttacatttttgtaggctagaagtccaacatggatctcattgggctaaaatcgaggtgtcagggggctgtgttcctcgtggaggctctgggacaaattctatgacctcatctttttccagcatctagaggcttccctgaactcctaggtgtatggctcttcccttcatcttcaaagccagcaacagcagattgagcccttcttaaaatgccatctctttgtttctcttttccatagttacatcttcctcttccacttttaagaacccttgattacattgggcccaccctgacaatccaggataatccccttattttaagatctgctggttagcatccttaattccatctccaaccttaattcccctttgctatgtgtagtaacatattcacaggttccaggaattaaatggacatggacatctttggggagccattatttctacctgttacagtagggtggactttccccaaactttgctctttccccactcaaatgaaattgtatagtgccctctattaattctttgcaaaataaattgttacctatgaatgtgtcttgtgcgagtggtgggtggtttatcactgcttaaagcctcactcttcttcattgtgacaaaaccccagccacttagttttgtacaatcccagtgttcaaggaagctagagatcctcttagccagcccgcccgcaggggttttgcacacacattgttacatctcttcaaaatggctgtcccacctttgcttacatgaaatggcctgccttggcaaataaacctctttgaacagttctgtttttgttagatagttcctgctttaatttaggggaaaatatttctctttgtgggtttgtagaacctattggttcttgttttactctctggggtcatattgaataaatctaatttcttctttcacacttgaagcccttgagattttttttaaagacagttctcatatcccccaagtatcagacttaaaaatctcaatttcttcaactgggtctcacataaaactgtcttgagacttctctccatcctgttccttctcctgagtatgatacaacatgaagaaggggaggctgaaggaagatttaataggaggctttaaatgctggggggaattgtcatacagaaaaagctggtaaggtctttacatttaccatggaaacaagaaatcacaggctcatattgtggctaaggagatttaattagcaggaaacctgtcttaaccttatggatttggtgtcaggaaacctgtcttaaccttgtggatcatgcaatggactgcctgctatgggaagttgagggatcttttgccttagtgtaagacaagtcttcaagctcagaattcgtatattttgtgtaagagacgttgcttttagttaaatgttttgcttaaagtattcttgtcattgcttgtcatctatgcctgatgcctgaatttccctcttgtgttggttcattggatgtaaggcatcatcatgactgctgttaatcatagggggaaggaatatggttcagggctttatgaaggaagggaaacagtggcatagcacaggataattaatagcaagtggagtgacagtttgattccctggtagggaccctggcattgttgaaggaaaaaaaaatcactttattctttcatagagagaggcagctgtaattctggttggatggaatccaattaaaaggaactgacatgcaaattgatgatgagacagtgtgagcatagaagtagtccaagaagagttttgtaagaaatggcagagaagagtgtaagtaatttggcatggtaatgtgtgtaagaaaatggaaagctgatgggttggctacctgaacaattatgtctggaatctcagccagcagagaacaggagactggttggtttggtagagttgttaacaaaactttctggtgttttgagttttggtctacattttaggaattatagcctttcataatagaatgaatataaatcaacccttgagggttataggctttcaaattggtggtggttaaatataatattctcaagattctatgatgggagtcccagcctggctcttggaaagaagatctcattgtacaggtgtacttcacctgacctaatgatgtgttctcaaagatttgtgtgagaattggctcctaaatttaggatgaaataggagagcttgccatttctagtaatgctattatgaatcattttctaatgtaaaaaatccttttataaccacagtcatgcccaatttatcttttaagtaaattcataagtccacatattagatttgtttaaaccaaaggtatttttctttgaaatgaaataattgtaggggcacataacagttaagctttagagtaacagaggaaaaattgggtaagattttataagtcagtatattgctttttagggaggaaattctgcctaagaagtcagacagcttctgctgttattacgggaaaaggagaaggctgcccaacgtatttcagggagatttactaggatctcttgggaactgcagtagaaatcactacgaaatattttgaggatagaggaaacaggacaacagcgtttactaggttttattctgaagaaagccaaagaaggtggaatggagttcatcttgagaaagcggtagaagattgagaagctaagaaaagacttacacagcagcaaaaagaagaagagactggagtagtgggcagagttttcagttagcaagagagcaccatccaattgttatgctggtcagcagcaaggaacattaatgaaggagatgaagaatgaccagggtcagtttttgttcatccaggtttgagcagggtgttgcttatgatgctccatgcagttttgcctcccacaatctctctctgatctttgcctcctgatctgctcaagtactgcagcagcaatgcattctctactgaaggctgtcacgtttacttttcactgtgcctagaatgctcttaccctcaagcctccctccttcacttgattcaggttgctgctagaagctcccttatcagagagacctttagtgaccattctgtctgaaggaggcagacactcttcccttattccgcttttcttcatagcactcattatcacctcacacatggttgtttaatgtttccccaattttctctgctagaagtaagttctttgagagttcagcttcagtttcttttgcccatcagtgtattcccagtacctaatttatataaaaatttgtggaatggatttttagggtatctcttgcctatcacagtgagaagagctgagaatgaagaatacaggactcagtccttgtcctgtgttatgcaatgtattacatagttatagtaagtataacagcctgagcacagagtgctgtgagctttgagaaataagctagagatggtcatcacagaactggatcttgaatgataaagaggagttttgttctgtggtggagacaaggaatgatcttctaggctatcaaagcagggtgagtgaagttggagagatgtagaaatgagttttgtgtttggatgtcattgagtgattttgatttggctgctagagcacaggtacatgggaaagcatgacaaaggggcctgagaggtagggttggggaggacatgtgaaacatatgttgagatctgattggtaaagttattgataggcgtttggaccttgtcttttgggaagcagggaagtagcaatatccaaaagagagtgcttaaggatggattggaagagggaagattatagaggggatagagagcaaagcaggatgtgactttcccagccttgaaatgcatgagaaagtttgggatcctcacaatgaagggcaaaaaaaaaaaaaataaaaagcaattctgtttatggatgtatagcaatatattgtgtataggtggtggctattagaagactagtagttcttggaactgttcctttttttctcacaatagtagttaagctgtgtcattgggatacaaagggaaggagaaggctatttccattcttagaatagaaaaattggaaaatgccttggcaaatggaggtattcttattctacattttttttttttttttgagaccaagtctcgctttgtcacccaggctggagtgtagtggagccatgtgagctcactgcaacctccgccttctgggctcaaacgctaccacacccagctaatttttttatttttgttttttaagagctggaaatttgctatgttgcccaggctggtcttgaactcctgggctcgagtgatccgcctgccttgtccccgcaaagtgctgggattacaggtgtgcaccactgtgcctggccataccttacaggttaagcagctatgtggccttgtgcatttcatttaactgtgtttcatttgtcctttcatggagatagactttgttgatatcctttcatcgttgatgtgcagaacaaagtatgctgcttgggaaattataaacatactttcatttgaaatattgggtaatatcaggagtcctttgctttaatagaagtagatctggaattgcttttttttttttcttggaatatggtaacaccaaagcatctgagctactcacacccatttccagaggaaaacatgatcatttccaggagatggcctgcagttttaaagctttttgctgcttgttttctacatgtcaaaacacatcccatttcagcagttggtgagcgctaccatagaactgttcagaagcaagagggaggattgagtcatgttgtacgtgcagctgcatattaacctgcaggtcatagcagtccctgatccaaaggactgtctgacactttatccccgttcttactgccttcatcattcacagcagccagtgtaggactctcccactttagccttgatcatttggagtagcagaatcgtggtcttgtgtatatatagagtgttatataggccatgtgattctcggagacctttttaggaagtttgagcaaccttacatattggaattctttcctctttttgagaaggaggaaagaaatgtatgttttataaggattgctttgaaatagatccattttgcagggtttaactcaagcaaagaacagactagcttaatggttaatattaagttactggagtttgaatgcctaggtcccaattcaagcttcaccattattagctatatgaccattagccagttttctcatttgttagatgatgataattacaggaagatactgtatcttcccacagagtggtccagaggaatgaatgagtaaatacatgtaaatcacttagactaaggactggtattatggattctctgactgttagctgttttattcctgattttctcatagccactggcatttctaagaccttgcaagaaccactggtcaacttttctgcctgctatgtttaactagtagaagtcagaaagtgacttggtggcagagtgctagaaatgattcattgggtggactattgagcttcacaccccagtccactggcatcatgtaagaaacaactcattacactctaacggtagtttagtgaaatggatgagtagtcttagtctgcctcctcaggctgcaacagaaagtcaagccaagcagccaggaatgtctgggaatcacctggagagaggacagacatctgcagcacagtggaaggtgatagatgagtgggacccaggaataaactacagaagcagtgtggattgtgttgattctagcaagcaggagggggtctccatggtatttctgagtataagccaaggaaatgtgttaatgtggggggaaaaaaatcaccgaactgggagagagtcagactacctcgggtgtgacctttgccctgtcaccaacatattgtatgtcacatccccatggggcgagtcacattttctttctaactctgtttctttgtctgtaaaatgattaaatgatttcttgactctttcttttctagattctttttaacgatttcattagcttttaataactatgtgaggaaaggagagcaacctgctatagaccttggcctgtgtgagtctttaattttgttttttgttatttcaaagaagttcttgttcaaaagaccatgagacatttcatcattggactttttagggagttgtctctttaatctctcatatttccttttttccctacaaatgatatccacagtactgctgttgtcttgtgctctctggatcagcacttttccagagaaatgaaaacactgcacttttaacggcacagaaagcaaaattactgtagcatcaggattcaaggttacagaattggttaactttctggtttgttttgctgagctgaatgaaaaagatttgatcgaatgttactgcttagggataaatattaataaccacaaactctcttagtgatcattgtccccccttttgcagaaaatttcaaattatggtctaggacttagattgtgattgtcagctgaatatgggcgtgaaaaatgtggaataaccagataaaggacccttaattggttgtagaggaacaactttttggggatccatgtccagagagggaattggttctggattattgatttgtatcattactttgattaagtgtctagcagttgctgtagacctttataacattatataatagaaatggtattagaaaaaagtcatcaaaggtaggatttttttaaagatataagaaccgaagtttttaatcttcagtccttcatagagaagaatttattaggtttgagagttctcagtaccaagtaaattctaactgcagacttaaaacatatgaatacactcacatatagtcaccccatcctctggcctggttttgttctctattatagttgactttgctttaggggaaaggagggagagtattggtattaatttatttgaaaaattagcaggagtatatcaaacacttactgtatgccaggacttaccatgataaataagaggtggacccctgtccttatggagcccacttgaatcaaaaagtaaacatatgagcatgcaaatagatggctgtaagaatgtgatgggcatgccattttttctagcaggttgcctaccacatagtctatatgtgttagagatacacattaggtacacagaagagggtccatttgtggcatagagagagattagaggaatcttcatgaaggaagtgacatgatgatgatgttttgaatgacaggaaggagtatgcaaaaaaaggcagggttgacattccagacagaaagactagtatggaccaagacatgtggacatggaaatggtttgctccttttggggtcctgaaggtaataagtgcaatgaggctggagaactgggtttgtcttaaggggctatgggaaatgagggtcagagtgtaggctcttatgaaggctgtctggtcagacttgaggggaaggtatgctggtaaattgcactgagaatagttcctagctgtcccatatttcagcatctcctgaaatagatgtgtactgtgatgtacaagttccaggatacaatcagttcatgagtatccagttaatgtacctgcaggatttgggcagcaatatatgtagggtgttgtgtgaaaatattggatatgaacaattacaatcttggcttgcacaagaaatcattgtgatgcaggagggaagggtagaaaagttagattattttttttcccctctaatgcagtgcctctcaactttgttacaaattagaattacctggggatcttttttttaggatattgtttacatgcagtgaaatgcacagatcttaagtgtacacatcaatgaattttggcaaatatacatacccatgtagcacacttacccatcaagttatagaccatagtcagaacctgaaaaagttttttagtttccggtttgaatcaattcctgcccacccctcccatatgtaaccactgttctgattcgtgttaacatagtttagttttgcctgttcttgaatttcatgtgaatggaattatacaagtatgtgctctattgtgtttgccttcttctgttaacataatgtttttgagattgttctatattgttacatgtcagttttttttaattgctgaatagtaccctgttgtacagatataccacaatttgtttaatcattttcctgttggtagacatttaaattgtttcagatttttggctattatgaataaagctgtaatgatcagtcttgtacaagttttttttttttttggcagacataggtcatgatttttttttaacgtaagtgcctaattgtggaattttgttataggtatgtcagtgtatgtttaactttataagaaactgccaaacagttttccaaagtggttgtaccattttacattccctcctgcattgtatgagagttcttgttgttccatactgtcaaacatttggtatgataagtctttttaattctagccattctaatgggcataatatggtatttcagtatggttttaatttacatttctctgatgatttatgatgttgagcactgttttcttttgtgaagtgtgtggtcaagttttttttgaccattttcaatttggttatctttatgttattgatttatagggctctttatatactttggatacaagtcccttgccagatatacataatgtgagtacttctttcagtctgttacttgcctttttagttcctaatgacatctttggataagcagaattttttaattttgatgaagtatagtttatcttatttttccattatatattttgtgtcttttgtatcctcactaagaaatcttttcttaccctaggttatagaaatattcatctttgttttcttctagaagctttatttatcttttggtgtatgttccatcacaaatttttgagtgtgatatgaggtaagggtagaggttcattttctccatatgtttatctagtcgttccagcactatttgttgaaagaccttactttctccattgaatgtccctggcacctccgttgaaaatcagttgcttgagggccaggtgcagtagctcacacctgtaatcccagcactttggggggatgaggcgggtggatcacgaggtcaggagttcaagaccagcctggccaatatggtgaaaccccgtctctactaaaaatacaaaaagtagccaggtatggtggtgggcacctgtaatcccagctacatgggaggccgaggcaggagaatagcttgaacctgggaggcggaggttgcagtgagctgagatcgcgccactgcactccagcctgggagacagagtgagactccacctcaaaaataaaaataaaaaaaataaaaaatcagttgcttgtttatgtctatttctgtttaggtctatttctggactctgtgttctgcttcactgatttatttgtctgtcatcccagtatcacactgtcttgtttatctagctttatagtaagtcttgaaatgcagtagtgtgaatcctcccactttgttttcttttcaaggttgtttttactattgtaggcccttttcttttttatataaggtttagaatcaaattgtccagttcttaaaaagaaaggtagctagggtactttaccttacaaaatcccttgatacccagaccatacttcatcccagttaaatcagaatcatttagaaatgaacagaatctcgttcattccctagattcttctgagtgcagccaaaattgagaacctatgtactaatgggattttagtgtggtacactaaagaagatactgtcatggattgctgggatggaagccattccagtggaatgtatgcataggagctgatgtgggcccctacacgaaagaaattgttgatgtttatggaaccaggagagctgaatgaggaagagaaggagcaggagtgagaagccctgtggtcaaggtagtagagttccctctccctggggcacatggagccccattgctgaggcgctgccttgtgtggctcctattcctgattattcagggtattcccaccctaaacctgctgcagtgcagccaacaaaccaccaacttgaaatctagggaatactcttagtagagcgtgtaaatgtactattttaaagaatagctttcccctggattagggaaatgcttgtgaaatctgcatagtgatgaacagggtaggcacattctagaagtgcctgtgtgggttttttgctttttgagttttttctgtctttttaatgtaatgtctttagacaaacattgagtcatccattcttcccaagggtaggtagttcagtcagaagtgatgttttcccaaaaggctttaaagaaaaacgggacaaaaagttacgctcaagtaatatgttctttgggagcactcaaagtatgcaggctggtaggttgcttgcttgtggcttttttttttttttttttaatttaaacacacattttcctctttgaaaagagaggttggaactagtcagctgagtccctctttctgaaatacacgttccctaaacagctgtagagaattaatttcagtcaaagatagcagagctttaatctcagctttctgctcagtgttatggaaaatcctttctagaaaatagccagtgtctacctgctatgggatgttaaaaaattcaaacgaacattggattttttagtgttttcctagtagaaacagcatggaaaatcctttagtgagctagattttacagtgcacacagaaagcaagtatctatgatacatttataattttgtgtgtgtcacatgttggttgtactattttcttattcctaatagaattgaaatataccatgtccaattccaaaccttattttttttgtgtgtgaagggttgaagcattttagacaagaaagagctttgatactagcaactttaaactcatttataggatatatatacatatataatacatacatatgtatgctctttcaaggcagaggaagaaggtaggcagagtatgagaggagagttgcttttctttctcaacttatgattgtatttaacacatactcgcatgcacacacacattcttttaatagcattttttttttgtagtgagagaaaacttatctttaagaagtctctaatctattatgggattaagagttttaaatgtcccccaacacccccccccccatttttatacttttatttctacgatttatatgtcacgtgaacatcactttttggtggtgtgattatatcggaatacttttgtattttgcttaacattaaaaaagccatttcttacattgctatatcatgatagtaatttaatggcagcataatagtacctcaaattgtgccatactttatattcttctgttgtaagttttctattttgtgctgttaaacctcaaagaacttatttgtgcatagaatccctcttaatttcttcagtacatcctctgtgtagaatagtcacaaggtgcattttgttttttccttatctgtgtacagtttacactgtatatgatcctcagtgatatagggtgtatttaccttaagaatgatcattatttacatttctagggataaaaagctactggatttctttcataactgtattatttaaaaagttgttcttcccctttatttttgtgcacaaatttgagccacatttatgtttgtcttttaatgggttatgggttcaaatttttttcttaactggtatgtttttttttgttgttgttgttttaatttttttttttttttttttttttttagaaactaggtcttcctaagtaagttgtctggtttggtctcgaactcctaggctcaaagtgatactcccacctcagccgcctgtgtagctgggagtccaggtgtgtgccactgcacttggcaatatgtaactctttgtgatatttgtcatgagtattttttccaagttttttctttttttattttagtgccattgtgcctggcaatatgtaaccctttgtaatatttgtcgtaccttttccaagtttgttcttttttattttagtttttcattacaaagcagtttatgaagttttttatattttcttctgttgccttaagatgaacaaacttgtcatcccttctgagatctaacatcaattctgtccccacctgccccccaatatttcctgtggtttaattaaaagcaatttttaaaatccatctgagtttctgtcgatacatatgccctctccttacctgctgtgctatgaggaaaggtgggctaaatcaggagctcgtgttattcatatcttgggagaggaatagaaacagccagtactccaatctcagcttcctgtaatgtctacaagtcagtgtttgctcatctataaagctgggatgagaataacaaatgtacagagaatttttttaatgcacttaagccttctcttaagcactgttaagaacttcagttgaaagtgtttaaaataccaaatagctgtaacctttgattgttaatatgtgtgcaccatcatttcttggatttttctcaatagctagagaccacatgggatctttggtgttttccaaaatgaaccaccatgctattacctgcagacattaagggtctgattatacaaagaaactgagagttgaggatgtccatcagaaatacactgtttcaaagtcagatctgagtacttggtgaagactttggggactacttaatagtaatgattactagaaaaataaacactggcaatatagatagtggttaaaaaacatgggctttgggctgggcatagttgctcatgcctgtaatcctggcactttgggaggccaaggtgggaggatcacttgaacccgtttgagaccagcctgggcaacatgccgaaaccctgtctgtataaaaaatacaaaaattagccaggtgtggtggtatgcaccttaagttctagctatctggggaactgaggtagaaggatcgcttgagcctgggaggtcgaggctgcagtgagccatgatcatgacactgcactctagcctggaagacatagcccaaccctgtctcaaaaacaaaacaaaacaaataaacaaaaaacgtgggctttgacagagagacttgtttaacttaattaaacaagtgccacttaagtgatttggggtgagtaattttagctctctaaactcagtttcctccactgtaaaatggggataatattgatgagtggtttaattaagaaaatgtatgtgaaatattgagcatggtgcctgacccatagcaaatgctaagtaagtagtagctgttattacttttattaacaagtaacatttgtataacatttatgacctacagagccctttcacatgctgtttcttatttgtgaactgagtgttttatacagaatgggtttttaaatgttccataggctttttattcatggcttcaagaggttgttccctttttgggacctgtacagcttgtgtatactcagttggcatttgtcacgtatcttcatgccagtgtctttgtatctgaattctaaaactgcgtgaacacaaaggttatgtcttttgtcttattcatctgggttgtcactggaacagagtcaggagacattcctatttattatgtgcgtaatcgtaggcaagtcaatctctggcttgccaaagctgtcctttcctcatctgtaaaatgggtaacaagtttcttgtgaagattacgttaaataatgcattaggaagcactttgtatagaaaattacaaatagttttttgttttttgttttttttttccgccatgcctcactagcctagtatcacagtagatgctgtaaggttggaggttgttaggaaggctatagagccaagtcttaactttagtgtcacaatacctttgttaaacaatgaaattcagtctttgggggctagttgtcatgctgggtgctgtgccaggctaattaatactttggtaccttgcctttaaagtacttactgctgctgtctccctccctcccctttggtattcattatttatagtataaaacatttgctgcttgctgttgtaaaggtgggggatggggtgtagttacacataggtgctcagagcaggttcaatgatttaaccctacatgaggaagtaaacttaatctacataaaatatggatttgggggtgtgtgatctctgtggtcagtctggaggagtgtgcgtgaggtgtgtcagccactaagcaaacaatggagtgctggctctgtggactcttggctgagtcagcattgtttcccatggaatttctttttctcttagcccacaggtgtatttatgtgtcctggtatttcttcgtttttattttcccccaatttgatttcataaatgatagtgcaaagtgttggctatggttaatttcagtaaataaggcccaaatatgaggtatctgtttctctcttgagtaaaaaataaagtcatgttatggggaataaaagcaaaagcatttaataaaaaaatccctttgttcattttagaaaatggtacctttgttaattccttaagagacaatttattatattctgacactatctttgaatagtcaaagaaggcatgatgtctcaatttaaatttcttcttcctggcacagcttttattctgcaaggtttgtgcttttaggaagagggtattgtttctcataggagagtagagtgcctagtggacagaaaaaggtaaagattgtcatttccttgaacatagattggtgtttaatttctacttaagggtgtcttttgagaagaacagagcccactctgtttagcagcttgctttttgctaatcatgtggtgcatggtgtgttttcatctagtccgttccattaagtcttatttatgctttggggatatggataattggctacggctcaggtgaggtgcataggtgatgtgtcatttctctcctgaggggatagagatgacaggcttcttttagataatcactgtcagtggctgggacccaggaacctttggtattcacctgtttagtcagtggggggcaaatttgatgcaagagcagagagggaactgtttttaaactatgtatatagtcactatgtgattaactctttggtggccctttaagtacaggataaatttgcattagaacttagtgtctcagagtcttcgattacatgaagtctgaaaaagtgatgaccaattgtcaatattttggacatattccatgagtgccccctcagaccattggtagagataggtttgcaggtggtgaccctggtgaaatcctcctctgagaagggagtgttcaagggcatacgttggcatcatttaagtagcagaagagagcaccccattgagatggtttaaaaatgagatgctaactttcaaagttttttaaattttattttttacaatgcctgtgatgctactacattgtataaacagtatgtagtgttaaggatgtgcctcgcatgtaagccaccactagcatccttagtgtgggggtactgttccttttctacccaaatccctgcaagatgttctgagattttggtgccaaggagtctcccaacattcaacattgttaaaacacacttccttatcttctttgaggttttttaatagcaaatcccaagccactcacctttttctcatagtattaatgttctaagagtggctatacattatgttaaagtcagcgtagttctccacgggaaggctgttttttaaatgagacttattcaacctctttttagctggtgtttcattaccaccgaggatttataatgcaatagctctgaggcaaagctggtaagaatgccagcttcgctaatatttagagtcataaaattctggatattggacaagctcttaattactctgaatccgtctttgtcttaataaaagttggattgtacccactaaaacaagatggctgtgtttgcattaatctccaaatgtaggttaatacctttttaaaagctgtctcctagacaagagacttgaaaattaatttcccattttcagcttaaaacgaagagctcttccacgtgtggagattgaagggctgccatttttctgatgctgtagattcaagtgccaataataactctttgttcctctttagtttttttttttttttttaatgtcttaggtaaagaagtctttcttttctggtgcttggggacttgtattttttaaaaatctgcttcaaagtaaatagatgaaatttcattttctcagtggagtttggatcactgggattgagggggatgaggaagggctagatagatagtatgaaacctattggattcatactatggctgcagaagtctgggctttacacattaggttgctaccaagctggatattttgaaatatatatatgtatatgcctgtaatgttttagcatttgcttgttgggttttttttttccccataatggtaggttcttaactgactttttcaaatgcaaggtaaaactttcttttccttttcttgtctccagagtactgatgtgtaaccacttagtaccactaatgccaggattcatttctgtgctacagatggtcagtgagattataaaagctctgaaaaggtttttatataatttgaggtcttctcagttgagagtttgtgtctgacatattaattccttcccatccaccccctgccccattctcaatgtaaaccatatgggacatgtattaaaaaacaaatttcagacattttctggagattttaattcagtagttctggaataggttgcaggaatctgactcttaacgatcaagcacatttgatattcagacaactctattgcatcctccagaagctccaggattctgtatataatttgtaggatatacttgcctcttctatgtcaagtctcttacccagtctgattatgtgagatgtcttaaacagagcgttttttcataaacctttatgtaggataatactactcctaaaacactttattacatagtttttggattggtaatggcaaaagaatgagaaagcacctgaggaggcaccattgtgagtgatgaaactggggtatcagacctggttatgaaaggagatgataacccttgtactgttttcagacagttgcagagttatcctatgaaggaggaaccataattctggtggccctgcagagcagaccggggactgatgaatggatgctgtgggggctgaacataaagagaacaggtttaacagaagggaccaacatcctttgagagatactactttttaccttctaattatttaacccatgaaactattattttctcccaaagacacctgtttttagactatcagttaataaaaagaatggggctacttaggtggaagctggctgaggggcacaaacagattaagccccttttctccccagagctagcaagcagtacccttagccagaagccttgggctccatagaagtggccacaaacacaactagagtatggtgagttctgttcagtggaggtggccgcacagccccctgacaaggagtcttgtgagctccgtaagggctggcccttatctgatttgctgctgtagacagccagtgcaggggactagcacagagggcagagcttagtgaaatgtctgtcaatgaaagctgtggaggacatttgtatctcacattcagtgctgaatgagatttaaaagtcctttctaacataaaaagtctgtgatctctgcttccaagattaattcttaggtctcagtatggatggcccaaggatataagctttgtgtctgcagggactttgtttcctatagtgctggatttccagtacgtagactagcacctgacattagtgggcactcagtgaatatttgttgaatacatgcatttgttgaaaaaagtgaaaattgtttaaagtggtactttgtgaacctttttttctcttttttctgtcatcctggagacttctcatttaacccccagtctgtctcgtgatccatgccccatccttccttcatgcctcacaccacctccttctcaatctatacttggcaaagaggaataaagacgctaaggatattgtggtaaaccaaagtcatctcagaaacacagtgaaattccctaggcatctgaattgggaaacctattggctgatttgctttgacttgggtatttcctgtgattttcagccgggatgtgctcctgtgctcagaagtgaggatctgttgtaggtttatggcctagattaattgggatattttgtgaagtctctgaagtgttatcacttcatctttatccttgcctgctattcctcatgaaaagcatttgaattattttagagaagatataaatttgcttgtgttatccagtgtcagcttaaagctgattagcattttgcatcacctttgcaactcataaatcatccacttaccctctcagtaagcaggctgtaagtcagcatggaagcacctgctgcagcttcttgtcctgtgatttagaggacactccagattctctgcagacccttctgtggtgttattctctggtaaggcttcacctatatgggaaatgagtaaagacttttggtgacttttttttccctagggagttcttaagggttaccctggacgagagacttctcagaaatatagtctttaataaacctggtccaggcacaggtttggttcatttggcatatttgttgttttaaaaattttggaggtacttttcaacatttaaagtccaggacatttcacatttaaaaaaatccagatttagggttattccgggaaaatcagaacacctggcagtgtcaggccatgctgcatgcctggcttcatttgttattgagagcaggagtgctctaggaaaggggtacagattttccattttgctgtagactctacccctctcagtttttccatgggagtcaactttactcaaagtcctgcactgtagatgcttgaattggtgacatccttctatgttgtgcgagtgtatagattgttttttttgtttcttttttgagtaatatcaaccatttaactcaattgaataataacaagaggctaacatttatcaaatgctattaatgtaccaagtactgtgctaagtgcttgtaatatgtttgtttatatattctttacaattatcctaattgtatagatgaggaagaaattgaggcaaagagaggttagataacttgctcaaggccacctagctagtaaaagtcgggcagagtcactgtggtgtcctcagaagcaagtccctgcttgggctagcatttttgcctagtccgggttatctccagaacctggtctgctcctcattcccatatcccattaggaacagtgggcatcagttgcaaaagtagatgacagtaacacactccctaagtccccagtctgctcctgggaggagcagcctgccttgttcatggcagtcatagccacagggggatgtttgaaagacagccccttatacagtgtctattgattttcttcaccctcttgttttgctcatccatcctgttgttctaggatgcttatttgtcatgcataaaagccttgttacagtgaacccaaacaagtcattgacatttaaaattaaattgcaacaggtattgtcaatagctaaactgctcattgacagtgcattgctaattgcattgagagaacatcctaactgggtatattctgccaaatcaaatcggaaacattggctgtctaccagcaaattcattttgacttgcacagagtttggggatccacagatccctcaccaatctcaaaatactgtgtttatggaaacgctaattattatttttttttttgctgaggttctttgcagagaaggggaattctgatcatcttcactgactgctaagccaggagtcagaaactgtgcctttggaagggagagaactacagatttggggtggagtaaagttcaatgcaagggggtcatttggggaggtgggccatcaggttctttatctgtaaatctaagccatatccttggatccattttttttttccttctctcctttttcatccccttctctctcttctataggtacatgggagggggacaagggtggagacacttaatttttattaagcactgttcgtggtattttatgtgaattaatttgtttacttcccacaatgaccctggggagcagatatgctatcaggtaaaaaaactaaggcacagagagggtaaaactcttcgaaagagtcttgtggttagtcagcttctgtgagagtgagagtgggctgccctgaggccatctgttccctctccccagctgatatttttgtgctctcagggtaaacatttaagcctgtgagttaaactcagccttggactagctgagttcctctggaggccttgcaagtagcagtttggttggcagggcaattaagtatgctaggtgcactgtgctgaaccccaggagggagggaaggaatggaatctagtctttgcttgcgttatacatgcttattggtttgtggcaggcgtgattgatgccagaatcaaaatgacttaaagcagcttcccttgagaagcactactctaacggttttttttcctctttgttgccctaggtcccttgtgaataggatttagctctgattcagctgctgctgttcttttggtaatcagtgtggaggaaggagatgagggctgctattaatggcttcttattttgcattctcctaatcagatatcctgcagttattagtgtgaatgcaagatgttcggtggtgtccctgggtggttttcttaggtgtactggactgttagctttctaagatggaatgttttattaggttctggcctagggggttggttagatgggtggaggttgttaaaaagcactaaagaaaaggaataggatataaaaccaatcttcagggggtgggaataacaacccaccaccttcacttccctcccctcctgccctgaaaaccttatcttgctaatacccttcagatattaaaagtgaaataacagagctatttactaggcagctaaatgcaaattctctcccccattagttttaattaggatgaaatcatacatttaaataaccacttctattactaataactgaacttctgattcactctgaacccaggcaaatgcctcttctggtatgaatggcccacctctgagtcattccgcacctgcatattgacacagccaggctcctgatgtgggtacacacatctgggatttaagggcatgactggcatgttgaatcttgggtataaagctttctgcactataccctggggacaaacaggatagctcaactggagaataaagagcttgcaagctcaaaagaaaacaacaaccaaaaatacctcaaccaaattctgctcttgcttctatcctactgtttctttaggtgtttaaagggctgtagttttaaaaatctcccacccacctcatctttttaagtaaatgtcacaacagtactatgtcaatacagttgaaaataagtatttgagttgaaagaattggctctttgaggctttaactatcagatttgtgctaattctttactgtttccttgacatagtatatgcagtctgtgctaagagagtatggatgttgtcgtcggtgtatagaatggtggctgttgtaaacttctgtatgttggggaaggattgaacctgctgtctggagaattagaaaccagcagcttgacttaaatccctcagtgtcacaaccagctaatgaaggagaggactgctaaactcccagtggtctttgtggctacgaggacttactcaagtttgagactatctttagtgggccaatgacgtaggaacacaatcagcagaggacatgtagtttacagcagcctgtaatgtgccagagacatgactagctgcctctttggccctggggaagtgtgtctggccctgcttgcatcctctgtgagtgggaattgtgccagacaccagctagacatgaccagctgcttcttcgatgttctgtggacatgattggctgtagcttttgatcaggacagtgttcctaatgaagtgtgaccagcgtcatttagacaggaaagaatgacagctgatgtgcaagaatttttcttgattggcagcatttggaactagtaaccagagaaggtaggtggggggaggagaagccagctctgattgacaagagcttatctttatttaatctacttctgaggcactgaagttgaaatcttaggcaagtgaaagaaaggaagacacaattgtgaaacataattaaagattcttgacaaaaacatacttaaatcagaaatgtcttttttttttcttttttgagatggaggtttgctcttgttgcccaggctggagtgcaatggtgtgatcttggctcactgcaacctccacctcccgggttcaaggaattctcctgcctcagcctcccaaggagctgggattacaggcgcctgccaccatgcctggctaatttttttgtatttttaatagagacggactttcaccatgttaggctggtctcaaacccctgaccttaggtaatctgcccgcctcggcctcccaaggtgctgggattataggcatgagccactgcgcccggccagaaatgtctttcaataggagagcaatgcagagtttaggtgtgaggttatcactgctccttcggctatgagaaagagcttttgcccagggattgttaatttttaggcaaaatttaaagtggcgatgggcttggatagttctagcaataaaaaaagttctgcttctagttaccatcttgttgactttccaacctacttggaaagatttcctttggagaggccaaaaacaagtgctgtgtatggagtgtggcctgtggtggtaatttctcatcaactcttgatccactgaggatttaaatcttaagtcttcatgtgctttgagaaaagatgacaagcggaaatagtatgtttgtttcctaaggacacacatgtgatttctgagagctgattgtatgcaatgtggtggtattcttttgcaaataggcttgggaacttggcatcctggattcgaatctgggcaccaccattttccagctcattccttcttattcaactccaccccacctcgaaccccgatttggttttaaagattcacatactattgttttagtaattacccttgaaataaagtcacatatacttttaagtctaaagttaatccaggacaggtgcggtggctcacacccataatcccagtactttgggaggccaagttgggcggattgcttgagcccaggagttcgagaccagcctgggcaatgtggcgaaaccctgcctctactaaaaataaaaaaattagctgggtgtggtggcatgcacctgtattcctagctacttgggaggctgaggcaggaggatggattgagcctggaaggcagaggttgcagtgagccatgatggcaccactgtactccagcctgagcagcagagcaaaaccctgtcttaaaaaaaaaaaaaaatccatagcctaaccaccttggataatacaagtgactaccctatatctgatcatactgccaccccaacctaaatccagtatttgttttgccttttttttttttgagacagggcctccctctgtcactcaggttgaagttcagtggtgcgatattggctcactgcagcctcaacttcacaggcttaagtgatcctccccacttagcctcctaagtattaggcatgaagcaccacgcttggctaatttaaaaaatttctatttttgtagagacagggtctccctatgttgcccaggctggtgttgaattcctgggctaaagtgatcctttccacctcagcctctgaaagtgctgggattataggcataagccactggtgcccagcctattttacctttttttttttttttttttgaggggggagggcagatggtcttttagatttacctatgtatttgacaatttgtttgttcatatttctttcttgtgtctcagaccttccttcaggtttgacttttctttagaatttccttgagcgagtgcctattggtagtaaatgctcttttttgtttatcatagatgtctttcttttgcccttcatctcaaaaggtagttagctggatacacagttctagggggaaagattttcttctctttgagtcttgtaggtttgttgtgaagattacctgggttcatatctaaagcccttagcactatgcttggcatgtttgctctgtaaataacagtggctgttacattctcagaaaaatactggaacagttggaggcaatgcaggcttggttgggatgtccatactttgactaactttttacattattttcttaaaactttgatttcattgagattggggtgggagtacatttaagcatcaaaactaactttgaagatagatttgattgaactgtgagttctatcactcgctagttgtatatacctttggtagattatcttacctgtcctaagaatcagtttcttcatctatacagtgatcattgtaatacttcctatttctctgagttgctgggaaggttgcatgagaacacatttaaagctcttctccaagcctcacatagtaggtggctagttgtggtaattatttgttgcctgtaaaccacttttatgacttttatgtagagatgttaccaacttgtcttttttattgttgttgttctagctattctgtttttatttgctcttccccagatccacagaaaagatggggtatctcctgcacaattaactttctactctactgatggggaaggccttctgcagagttggtggctcttgcttggaggcaacactttgatgcttgtctttaggtgggaaagtagctttccaggcccagtactttgctacttgtaagactctcacttacctgaaaattgtttgctctggtttttcttgtgactttgggcaagttacctaacctctcagtgcctcagtttcctcatctgtaatatgggaataataatagttccttcctcacagggttgttgtaaagactagatgggttgacacacatgaagacctgagagcatgcatgacacagaggatgtgcttagtactttagcgttcatcagtgttgtcagtagccagggcttccttctgtaccatattgttgactttcagaataaaaaatacattgtttgctatgactttgtcccagggcgtgtgtattaagcttccacatataatttatatcacttattccttaataacattgtcatgggttagatgggacatgtatttttttcaactttattttttacatacaataaagtgcatcgatttttaagtgtacagttttatgactttgagctacagtcaccactgctatcaagatataggatatttctgtcaccgtaaaaattcccttatctctttcccagtcagtctgtcattcttacatttggccccaggcaaccactgatctgcttcctgtcattatagagttttcttatttagagttttatataaatggaattacattttacacactctcttatgtctggcctattcactcagcataattattttaaattttatctacctacctgcatagtacctatattttgagataggatcttgctctgtcacccaagctggagtacagtagaacgatcatagctcactataacttggaactcctgggctcaagcaacttctcccatctcagcctcctgagtagctgggactgtaggcatgtgccaccttgctaggctaattaacatttttttttttggtagagactgggtgtagctgtgtttctcaggctggttttgaactcctagtgttaattgaggcctcagcctctcaaagtactgggattataggcatgaaccaccacgcctggccagcgtaattattctgaggttcattcatgttggcatgtatcaggaggctggtcatttttcttgctctgtggtattccactgttgaatgtactacagtgtgtttagccgttctgctggcgatggcttttgggttgtttccaatttggggctgctataagtgagctgctatgaacatttatgtacaaatctttgtgcagctatgttttcatctattttgagtaaatatctaggagtagaacttctgcatcttaaggaatatgtatttttaacccccttttactgatcaggaggaacttagagggttggaactgaccaaggtctcacagccagaaaggtgtcaagcatggaccaacatttgatactccttttctgtttcctcttcaggagtcattctattagaccagtgatttcacacttttagagcaccaagactctttttaaaataaaatactgtaggtccaggtgtgatggctcatgcctgtaatcttagcactttgggaggctgaggtaggagtattgcttgagctcaggacttggataccagtctggactacaaatcaagactccccacactacaaaaaaaaaaaaaaaaattagccgatgtggtggcatatgcctgtagtccctgttatctggggatgctgaggatcacttgagcccaggaggtgaaggctgcagtgagctataatcacaccgctgcactccagcctaggtgacagagtgagaccttatctctaaaaaataaaagataaaatattgcttagaatttctataaacaagctacacaaaagcactgtaaacaggctccttagaaagttcagtcacttttttgctgttatcctgttgtgcacccaagtgcttctcaaggaatgtcttttttgcaaagtgctgcagtccatttggctgcttcttgagaggagagtcgtggaccccctgaggcctagttcttaaacatctcttcttagtccccattgcattagttgtttcagaacaggtcattgagcatttcgcctttgcattttggtggttcagagagtaagaaactctttctccggctgaccaaaaaaccacctctccctacgcctcgtgtatagattgggctgtacaactggtgagaatagtaacatcaccatccctgttgctataaatcactgctggtgatatagctccttgatccaaagggtacttcgggggatgtagggccagataggtacattcaaactcagactatttacctttgtcacctggtaatatttacagatggagcagatgccagtatgttccattgccctattctggagtagtgattctcattttatgttatcagagcctagcttatgaaatttgaaatgcacttttgcctcctttgcactgttaccactgcatcagagcattttaatcagcttgctttcgttgaagtgtacaatttttcttctcattacgtctgcaagctctcaagtttacagacatgatctccttggctagactaatattacttggccattcttgcatgcaaatttaaaatttaatatcttgctgcaggtctgttgagttttatgcaaattccaatatagattatattttggagctgtaaattagaaattacatttgggggaagtaatatttgtgtgggtttaaaaaaagtaatcttgcagtttgtatggtacatggcatttcttctgaagaaacgggattttgagtattctgtgtgggtttagtagatgtcttgccaattgtgttactgataatgaaaatacaaaaacaatgccagtatgtacattaaatttttttccttaggagacaaagtctcactcttttgcccaggctgaaatgcaggagcacgatcatagctcactgcagccttgagctcctgggctcaagtgatcctcctgcctcaacttcttgagtggctgaaactacaggcgtgcctcgctaattaaaagaatttttttttttttaatttagagacacggtctccctatgttaccaaggctgatcttgaaatcctggcctcaagcaatcctcctgccctagcctcccaaagtactgggattatagggcatgaatcactgtgcctggcctacatcaacattttttatgacatttggctgctttttctaagttatttgggattaactgtgttctctcatttattaattcattgagtatatggttatggatgcttgataggctctcctcttggctttgatgatacagcaacaaacaaaacaggctctgtgctcatgaaacttaccttctacttgggagaaacagacttcaagcaaataaacaccaagtaaatatttggtatctctgatggtgatacattctgtggagggaaataattcagggtgtaggaataaaggtgtgctgagatggaggtgctagtcatcaggaaagacctctctaaggttacctttatgcaaagacttgaagagggaatggaatgagctgcgcaactcttcttaggagaacattagtctgggtggagacactgcaaggtacaagtgtcctaagtgggtgctcttgccgtgtttgaggagtagcaaggacgtcagcctgactagagcagagagggaggtagaaatagggcagaggaggggtagcagatgatggagaggtgtcacaggtcatataggaccttgtaggtactataaggactttggcctgtgctctgaatgaggtggggcactgtgggcgagggctgtattaggtaagaagactctgaccattgtgttgagaatggagtttgtggggggaaactcagatctttggatgatgggcatgggacaccatcatcagccattgcaggtgtggaccttggatgctgcctgcctaaggctggtgaccaaaaagaaggtagagttggatacaagagcctggcattgttggcatttttgtgtttgagtgtcggaaagatcgtggcagaagcctaagtatctgtgttgcttgggcctagcatctgtgttttcacaaatcccccaggtgatttgatgcctctttaaaacacagaatgttgggccctacccaaagggtttctgattcaggaggtttagggcagggcccaagaatttgcattatttacaaatgtcaaggcgatgccagccagtgctgctggtcagggaccacgctttgagaaccactgctctggtgaatgggtattgctgtgttgttatctgcaaagttacctttgtgtacttctgctttacaaaataggatgtagcttgaactctgagtcaaactgccatttactgtggtatgaccttggatatggcatatacagtgattcctcacacatggtgttaataagttcttagtaaatgctggctatttgaatatggtatgtaggtataaaatgatgtggtggaggtaaaatatgaataatttgctgaatataagctctggactgtggacattataaacaagatcttgttttgttttcagcatgacatgaaaggttcattagctttgttttacacatagggaagtggcttattcatgatcacgcaactagaagtagcaacggtagatttcaaattcagttctttctggcttcaaagcctgagatttgccaccaccgcatgagctgcttggagtactggattggctctcccacagtttttgtcattgtgtgtgtgtatgtgtgtgtgtgtatatgtatgtgtgtgacagacagagagaaggagaggggtgtgtgtgtgtgtgtgtgtgtgtgtgtgtgtatgagagagagagagaaagtgtgccagaaattatttgcgtacgttttaaaatctctgttaggccattttttaaatctgtaaaatgggcatgaagcatgcagagttcatagggtttctttgctgagtagaatatgggatggcttagcattgtattttttttccttttctaattaaaaaaatttcaaagccaaatcgaatctagatagaataaatttatggattttttctttagggttccttattagaatggattcttcctaatatgaaacttgagttattgaattttgtgtggagaggatgcttctcattagggtctcagtttgggaagaagagattatgttccctttaaaaacagcttactgtgtttgcaattttagatttcttatctcaggaagttcacatactgttaggataaaactttcctagataaggcatctgtacaaaggaatgaagtatatgggaaactgcgtgtgtggggagaccatatctttaatttttgaaagggctagggtagcctggtggtttggaaaaattaaaagtattgcataaaagtcaaatgtaatagcaattattgttagtgttgtaaacttccacttatccacaaatcagatgggtggcagtctctttatcttaagttctggttataaaattgaaaaagccattgattaacaaatagctgtcacaaagctggaactttcatagtaacagtttctggtgaagcttcccttgatccctgactcaatcagctaggtagagataaaagagaaattttgtattctgaagatgtacagacaattataaggaactctggttgactgcagggggaagagacacaatagctattaaaataaaagtatgacagttgggctaaacaggcagcctcaaacatcctaggagtccctgagggcaacactgtatgtagtgactcaggttcttagaggaaagtgggtcatcaacaagaagcatacaggcttgtttttggtatctttataagaatagagggaaataatgagtgtgtcagagagctcttgtcaagtttagtttcaataaaacaatttgcttaggggtaagtttatttgggaaaataaatcactgataacagcataaatactgtgttcctcagtgatgagattagatgagtagggaggtagtggggtgaggtagaaggagcatggacttggacacagatacttgattagaagcagaatcaccttagatatctctgcgccccagcttctctgtctataaattgggaataatacctgaagaggtcattgtcaggattgaatgagatgatgtaagcagtgcaccttgcccagggcttaataaatagtgatgagactggtagatttctctgtgagggggcttcaggatatacctcccttatacagacttctattcctttgagtccaccgccccccacaacatctttatgaactgtaatgtatctcatactgtacaagtcacccatttaaagtgtacacttcagtggcttttagatttacagagttgtgcaaccactaccacagtcagttttagaaaatgttcatctcctcgaaaagaaatctgtaccctttagttatcattactttattccctcatcctcttcctcatcagatgttgtaggcaccacctttcttcccttccttcccttatcttcttttcagctgtggactgtgctgatttgcctgttgctggatcatgtgattgaaattctttgaatttttctgtaaatagccaatttagctttttcccttccagagtatttgtttctttgggtgtggaagcagctgctgcagccagtgcaagggctcaccattttgcgctttgcggctgttcatatggcaactttattcaaaaccgctcctgcactgcttaagttatttgttttatacaaaaacagttctcgctggcttgcggcttctctgctgccatgttgacaaatgttgcttctagtgaaatacacaaaaataaataacagcaagggagaggggagcacagagctaagtgaattcattttgcctcttgagtgccattctcatttgttttaaaaaccaccctggcacagacagaaaaggagaaggcagagaaccgcaggaaaagaaaaggccacatttgattctttgaattgggctgtaggggctggctgaacagacaacttgagaagtatctggaatgtaggccctggggatgaggaaaagtttacaaggaatctgaataacctgcagatattcatattgcaacagcccccatttacatagtcttcagagttcatttggtatgttctcttgttttctcgttctgttgatgacgagactcaaatttaagcactgctggtgtagtagtacatgaccatggttggtttctgtcagtgtggtaggttgtgtattaggaactggaaaaaggcaaaagcgtaagggtgtgtgggttctcaagtttcgatttgaaggtctgacccacatgagaaggtggagggaatgctgacaaatattgattgcctttctgagccaagtatttccacaaatactatgttattagtattattattatattaagatatattagtattatactattatattagtatatattagtattattagtagtattatattagtatattagtattattatttgtatataacaaatactatgttagtagtagtagtagtagtagtagtagtagcagtagtagtagtagttttcagagagagggtctcccaggctggagtgcagtggtgagatcataactcactgtagcctcaaactcttgggcttaagtgatcctcctcacttagcctcccaagtagctagacccacaggcatgagccaccatactcagctaatttttagattttttgtaaagatctgggccttacaaagtgctgggtttataggcatgagccaccaggcctgacttcagaaacattgtttcattggttagcatgacaaaggttggtggtcttagcttcatttcacagactagggaggacagagttttgaggaattgtggtacttacttgccaaaggtcttactgaaattaggggagtggaatgaaatggaaaccccgtgcttccagacctagaacttgttccttttctatattagtagtaagccatcagaggtatggaagaagaaaaggagaagggcattggaaaataaggagggataacagcaagcagtagaggccaaaaacattttgtttagaaaaattgtacatcttctttgaaggtttttgttcattaaaaatcaccaggaaaacgaaagtgacttgcaagtccacaagaaactttgttttgggtgtgtgagttaagaatgatcacctgaccaattattattgactagaaaaacatttccctgagcctttcataaattatcttaatgtgcatattgttgaggcagtgtctgataaataacagcctaattggccacccagggtctgagaggtttgcttagccacaactagcctttcattctgggtctggcagattgatttctttccatttgttgcatgattttcaatgctatttatgacctaaatattctgttcaaaatattttttttttggtctattgctaatagtagatgcctctagggagaagaggagagaagcaagagtgaggtgacagggacttacttttccttatattctccttggtactttttgaattttgttccgtgtactattccatatgatggaaaggaggtaagtgtatttaggcaggtggaaggtaagaagggtagatgaaaggatgaattattgacctgaacttcaggcctttattcatcagtggtttagcctgtgggattgtttctcagcatataaacttcttcagttatgtagacatataatagttacttgttcgatttattgcatctgcaaaggtatggccaggtgtcatcatgaggaagtatagtagtatagtgtttaggcttaaaagattctgaaacctagacttcctgggttgtaatcctttctctaccacttagtggctgaacgtgaccttggatcttactttatctagcatttttgtgtctcggatagcttgtagttaaaatagtagttataacaaaacttgtggaattggaaggattacatatattacttaatccacatgaagttcttataatagtgcccaatacacagtactcactaaaagttaaatttttttttgatgactattatcacagatggtgatttgcctcatccatctctctgtcccttaatgtggtccaaaatccaccccccgccccacacccggccttaatgcccagacagtgcccctgtactgactaaggagcctttcttttgagttcactggtctggcactggctcctagaagtgctgttttccagtgacagcaggatatttggaccactgggagagtcagtgggctggggtgggcccttgctctctgcagaggtgttctttctcccagtgggaggaaacaccacttgtcagaacacagctttggcttgcccaggttcctgttgtgcagatggggcctagagtctctctgggccccttgtcatggatccaagccaaggctgtcgcttgctgagccaggaataatataggaattagtctttttcttctttatactaagcactaatcaatctacagttaactctgtatctaatttctgaaccagatgccgtgaataactgcccctgaatgtgtttttgccaataaaaggataagtttaaggcttttaatcaatgccgcttgcactcagtatttaaggtcagaatcttgtgtgcgacttattttgatcaggataattgttgggttaaaaaatgaacggtttttgaaattgtgacactcgcggttgactcgtgggtgaattaatctttgagaggatggaaaattgtcgagttcataagagttctcttgctctctagttgtctttcaggtcacttatggaaaaatatgacttttaggaggaaggcattctttttcaatgggaaaggagataagagactaatagaaatttctaaggagtcagtgatggaggctcaggggaaattggaaatgaagctgggtgttttggatctgcggtgagctgagggactggaacagcagctgtgtatgttctaggtaatattaacttgttgtaattttatgtctccagcatacctttttcaaaggaactcatgtttcctgaccaacgactgtgtactgtctagaatgaagcatagtgtttagaaacatctggggtttagatattggcttcactgaatggcctagggcaagtcactgagcctctgtgccctcagtttttataattataaaatgggatggtaatagctacctcgcagttggaaaacttaaatgtgatcatgtatgtgagaatgtgaagtgcagtgcctggcacacaagaggtgctgaaaggagcatctccttttacttctttgtggagtttgtttggctggtctgctggtctgtcatacatttgtctggtgtgcctctagatacacgtaatgtggaaatttccctaccttgtaacagtgagttggaaattgttcctgttgatctgtttttttttttcttttgtgcttagggaaaggcatgagaaaaatgagtcaggatgccctccatttctggagaagcttggtggtaattctgttccccagtggctcacaagcctgggcagttcagagaatatgagaattggtagatcatggagaactaggctctgcccctttggctatgcgggagttacttagtcttcctgaagtttcctgtccatgaaaaggggatgtgtgagggtgcaatatgggtaatgtttgtgaacaacctttgttagtgtcaggaaagtccaaaactatgtggtgtggtattttcatcatcttgagttgacaacagtgcttatccaaaagtcaattttggtattttgtcaaatgttaaaggctcaggaaataacttccaactcaaggaagatttgtatccactctggagctggaggagcttatattaagaatgtaagatacttgggctcccaggatttctggaagagctggcagtctccctgaggttcaggttctcagaccagcaggccatgcatgggggcttgtgattaagctggtgccgaacattgctgaattatataggtctttctgtgctacaggttggttttctgctgttcacatgtagtctaacagtggcctgttttcctttgcctcaactgtgacatcccctcgaagtgacctttatgaaggcagagcttggatctgccttgcttcttgctgcctactgtgtggttttgtgcagagtgctcctttccctcctctggtgtcttcacaggtgactcaactggaagaggaggttaaagaaggtcgggttaccaagcacctctcttcatgcctcagccaatccaggccccaacactgtgtgggaagaggtgttcatctgttgagaaggggtggggacaacatatgttacatacagaggctccaaggtggttttgatgagcatagagtatagtgggagaaggagcaaaggatggtttgggaggtaggaagtaaaagtttcagctagagctgactgtcaaaggccttttctgtctttagacttttactctgtaagatacagggatttgtatgtgaggcttttgactttaactctgttggaatagggatttgttgcaggctgttaagtagggaggatggtatgagagatgcattttcaggggtttcatttgctcatggcatggtagaagatgaagggtggatggtgagtagagtagaaataggaacacagaagactgctgcagtatttcagatggggattgtgtggggcctatttaggtcatctccagtgcaggtgcccaggagaagttacagtagatactgttgtacttgtaaaggaaaatgacattcgagttcctgttttgtgccaggaactttaagtaatctgcatatcttagctcatctcattctcaaaacagcaacaagcggaaggtgttatttctcaccgtttttcaaataaagaaacttaggtttagagcataagtaatttgtttgccatccctggacagctcctaaattgcagggttgaggttaatacctgattacatccaactccaagtcctttctgttcgcattacaccacactgtggccctcaggacacagcctcatgtagtgattttgcattagcaaataactttgtaaggactagtctgttaatagtgatctctttcaacattcccatgagatgagggagcacaattaattgttcagctgagggattagagatataaggaggttaagtgacttgacgaggtcacccatcaagtggtttggggcggacaggcagaggtgagtgaggcttggagctggccattttgagacagtggccttatcgagaacaagaattttccagcctcattttataaatccaggcttctagttctatagactagggaaactatcatggaaatggtatgcaaggcaagtgcctgaggctgagatggcacaaagcaccgtggtatcttggggttactttataatcaaactctctcttctagcatagtctttaattaaaacaacaatcatctccaccaaaaactaatcatctttattaagcatacagattggaggaagagtggggagtcttgtgtctgagaaagatctcaccaataaattgtttcctttgccataataattgtgttgctgagtttaataattagaattctcactctacgcttcctttttctgtttgattttacgggtctgacatcgctgttgtttttcctgggaatacttgaggtgtcacaaagagcaacattatgatgagagccatgggaaacacttgctaattacagtatattgtgcccctgttccttatctatcagtctctattggttattattactcatttaatttttatttttgagagatgaatgcacagggcagaataggtcctgagaatgaatctagagctttgcctttgacttggatggacactttgggcatgtacgggtcaagaaatagatgattgggtatcttgtggtaggagctagaggaactattaatacatttgggagtggggagtgaaggccatggactgaaaagatgccgaactacaaacctgaatgattttatagtttgctaatggttatccctggatgccatgcaccatcatgatttaactgagccttgcaaacagggacgatacttttcctaaccccctgccatctactgctttctcaccagaggtcacagggcaaagacaagtaacactggcattgtgcatgtgtgacaggtaactgtaggtagtaaagtggccacctgtaccattgcaaccctgtgtaatagtctagtgaagtgatctgctttctgcagtcaggatgccaaatacggtggagaaggaagtgacagtcatttacagtgtcatgtttagtcttttgcagatgtgcttacagttttaacaaaggcggagaagaaattatagggtgggaaagaaatgcctacagacaggctgctaaagcctaagaaggaggaaactagtatttgtgtgttttaggaatgctaagcccttgcttacatatcagcaagcaaaatattggcattcacttctgacttgaggaaggcatctctgaagtcaatagaaggaaatgcctaaacacaggcctcactcagaaagaaaggagagctgtggaaatactcaggattatctcataaaagctctttgtgtatttgaagcctctaatgaaatcagccttgttctccaggccagacaactccagttgttcttacctttctttattgtatcttttttttttcatttcttttatgcttttgtcatctcttgaaatttcttttctttgaataataccaataaaaattgaactttttgcctgaatgcagggatgacttgctagtaactaccagtttttatcagaaagcagagtgggatgctcagtgatgttgttgatggtgaggatgtccaaatcttctttttatatgctagctccattgtctgctgcatttacctgtttgtagcgttggtgcgtggaacattggggcatataaatgtttattgaattagtgaatgaagatatactgaattttttccttaaaaagtcagtatttgctttgggtcaataaagaaaccctttattttgctttttcttcataaacaccaaaatcctaggaaatattggttttactttgccacagcactctgcagcttgtacagacttttccagagatgaaaaattctttctcacttctgtattagtccttcgctttatcctctgattcctccttccttccttcccttttctgccttcctctcacccattcatgtattcattaattcagtaaatgcttcttcaacctctgctataagcactattttaagttctagggatattgttataagccaaataatgtctctgctttcatgaagcttatatttgggtggtgggtcaaggaacatgattgatcagaagaagttagatttccctgttgggacaaggctttcagagaagtaagtggttgtataggtagtagagataaaaggattgctccctgtgagggacttgctggcaggataggctgtgatttcactttattttctatttacataacaatctgaatcccaatatagtgtttaacctgatatgtaagattctgtttgggcagggttttgtcagttatcatttatatctcctttcttgaaattagatcagattcctttgatttatttggagagaaaaatgggcaatacacaatgtgtttctgctgaatattttgctatgatgttgacacagtaatgtacactttattttgattttagtgtgttttatttaaacattccattattcagaaattgttaccccctccttgttattactgtttgcctgcagttatttagaaagcagtttaattaatgttcttttaccgccccctgcttcagtatgagtttcaacacttttaatacaaagtgttcatatcactgtatgaacttactaaaacccaggacagtgatattcattcattcattgctttatccagcaaatgtgcaatacaaaaaaagatacatgcttcctctctacacatttcagtctaatatgaactgtttggttgaaatacagaaacataacatgcaattctctgggataaacgtttcactaaataaacagcagtgagaattctgaagatacacttaactaggtcagcctaggcttatcagagaaggcttcacagcataggcgatctttgatctggttcttgaagggtaaggatgtgttttccccccagggaccagttgagaaatagctagaattaattagttctgctgtaatcattgaggtgctgatcctagagtgtggcttccactgcagtactggatgtggggatgatgatctcattgcaaacacagcctgggtgggtgtttttggttttgttttaaggattctgaagcagcatatacacaaggttgacctcaggacctctttagttggttgctgctgctgttcacaatagatttagattggatagggcttcagttttcttactgttgcattccagcattttggatcagtcactttattacatcatttactttctggcttaggcttagttgttattaagtgaatcagggataaaccttaggctactctcctgcttcctttttcaaatgatccggagtaaataaaacaactacatctctttcgtcactgtgtttcgttcccatctcagaacgggtaaaatggccaatattttcagtgaaaatgtattgaaatgcatttcactgaaagaaatgttcacattcagtgaaatgtatctaaactctaaaaagagtctagaaaagctcattgacacatttgttacttgctgaaagccccagtgaattttccaacctccgtattgtccttaaaaattgccttttagttcttaaggtggtggaggtgtgtttttttcttcccccttaaaccctcttctgagcaatctttgcagagacacctggtgagagagtaggcccttctgctttgtgtgccctctagtaagagatgatcatcagcagctttatatcctaatgtagaaaatgtgctgtgctagatcatttcaacccagcaactcacctcttcatgcctaatgcctggagctagggccttgtttctctctacattagacaaaaaataaataaataaatgtgggtgaggataataataattatgatggcaggaacacttattgagtaagcaagtgtttgcttatttaatctacctgacaaccctaccagatgtaggtactgttattttctccatttggtggataagaaaactgagtcacagagagactcggtaatttgcccaaggtcagacagctgtctgcccggggaacctatacacttaattgctctgctgtactgtggttgagtatctcttatccgaattgcttgggaccagaagtggttcaggtttttgattttttttttccgagtttgaaacatctgtatctacataatgggatatcttggtggtgggacttaagtctaaacacaaaattcatttatgcctcatacacgtagctggaaggtaattttataaaatacctttaatgattttgtgtgtgaaacaaagttttgactgtgttttgactgcagctgctcatgtgagtccagtgtagaatttttcacttgtggtatcataaaagtttcagattttggagcatttcagacttcagattttcggattagggttgtgcaacctgtacttcatgagccaattgagaaaaatgccttcataatttctttctagggcctcaaacgcctggacgtcacccctgactattgcatgttgtgcattggacagttagatctcctcagtgcctgtgaacaagtgttcttttgagtgatactcttctttttgtgactgtattatataatatagctttcatagcccccactttatttgctgttattttattcccctctcatccccgcccccccccccccccccccatataaaggactcatttcaaagatgggcgaacctggaagctgaacctgactctactcttcatgtcttcaatttactggccataaaggttcagttttgtatgggatcttctgtcctctagaagatcccgtacaaatagaggctttaatttatgcttgcattcttgcattttgtgtgatttattgcctaataaatgaaagaaaaaagtttatttagatagtaaactgaaaatgaaaaaccatttttttccacgaacttgctaattttcttccattgtatagtatgaactcaatctacaaagatctggcaaaaaaaacaagtatcatgttctgtaacaaactcagttacactaacaccagaacttactgagtttaattggagataattaaaaaaaaaaagttctttttttctttttttttttttttttaaatagagatagggttttccatgttgacctggccgatctcaaactcctggcctcaagcgatcctcccatctcagcctcccaatgtgctaggattgcaggtgtgagtcatcgcacctggcctcttaatgtagatgattttttaaaatgaagatttttttcatagtaagaaaagggaaaccataattccagaccacagagaaggacttctttaatatatttaacctctttatttacagatcacttctttctagagagactaaaattagggcagagaaacctaaatcctacatacaaagagctgctgcccattcaaaataattacaagtgtgtcgggcgcggtggctcacgcctgtaatcctagcactttgggaggccaaggcagtggatcatgaggtcaggagtttgagaccagcctgaccaacatggtgaaaccccgtctctactaaaaatacaaaaattagctgggcgtggtggcacaagtctgtaatcccagctactcaggaggctgaggcaggagaatgcttgaacttgggaggtggaggttgcagtgagccgagatcgtgccactgcactccagcctgggcaagagagcaagactccgtctcaaaaaataataataataattataagtgacagtaaagcatctccccacataatcctgtatatcagtaagaaaatatgttttgagattcacaaaactcaatttacgaatctctggttgtagttatttgacttaatatataagacacttaccagaggagatggttgcaaacagatttgatgacaggtaaatttttctaaaggtctgctaacttcttattcagtcatggccaaccactgatacaatgctgagagttgctttctcctttcccctctactagcttggggtccacagaccaaaaaaatctataacttgcaaggctaataaatgcatgcttcagctgcctggaaatgctgttggactggcaatttgctgccccgctctaatagagactgcctcagatctggtctttaacctggattagctggataaagagaatcctctgggatcctgtgtgccatcacctgttagtgtgtttgctgtataaatgtaacatccactaactttgtcagatgatgtctggcctggctgctgtggctgtgattggaattgaaacatacagcttgttattaaggtagtgactggctgtgggggacaccgacgtctgttgtttttcattgttgatctagtgagttagaatgcctttcctgggctgttaatgttaaatagttcagtcctgttagtcgttttgtgagatcatctttctgtgtgatttgtgtgtatttccttgatctagtggggtgcagggtcagggactgaggggaaggtataattgtttacagaaaatgtgacaggacatggatttgaaatcagataggaagttaaggaatgccgggctcctctgaatattaaggaaaatctttaagcccctaattaacttcagaaaatccccttgctctcacagatgggaatttggctgggtaagctaataactggaatgaaggctaggagttgtgggttaagtttctccctggcaaataccaatatttcaggattacttcgactcttgtcctgctgcctcccactggatctttacaaactctgtgcagtagagattatcttgataaagattttggatgcatgttgggcctttattgaatgatgaatgctgttttttattcatttgcacatttattgggtacctactatatgtcagcctctgttcttggtcttgtatggtggtatacaagagaaacaaaattcttagccttatggaatttatatcctagtggactataaattacaatgttcactatttgagaggacccaagcttcagatgttgtggctgtttggcacactggtccgggttgaaagaagagactgggattcaagttgtagttcctgtcctgatttctctgggcctgagtttaactaccggtaacataatgacattgggctgtatctaattatttatagggttctttccagttctttcacttatgatcctgattttcccaaacattttagccaagttgtctttttttttttttttttttttttttttttttgagatggggtatcacccagtcacccaggttggagtgcaatggcactatctcggttcactgcagcctctgcctccctggctccagtgatccttccacctcagcctcccaggtagctgggaccacaggtatgtgccaccacgcctggctaatttttttgtgtttttgatagagatggggttttgccatgttgcccaagctggtctcaaacttctaagctcaagccatctgcccgcttcggcctcccaaagtgctgggatttcaggtgcgagccattatgcctaaacagcccagttgtctttaatctagttgggcttctggctaattcgtgttggtgaccaatgtttgcatattaaatcaaacaatcagttattgtactggagaagaaaataattgtttctaaaaagttcatatttcgactacatggtcatgccatttaaaaaaaagtagtaaagcaacaataaggaaatactcttttattctggaatgacatacctacctgaaatctttgagtttcccttgtgtcatgtgagctggttgattacaggtgaggagaattgcatgttcttacatgctcctcagaaacactcatcactgtgtaaaaaatgcttttttgtttgtgtgaaatcataatatagagcccattccaccatacaccttcatcatcaagctcggggatacaagcctgttaatcaagtgggaatacaggaagtgagacatgaaacactggttttattttcacacctctaaatgagtgactgcagaggatgaacttaaaaataataatgccacctcatacttgcatcacaccttttaataaggcggtttaaaaatatttagggtgaaccttcatcaggatgctttaattgcctcagcatagttgaatagtacattagggtaatgcctctgctgtgctgaaaagcctggagggagatactgtcactcaatgatgcgttgaggatgattaggtagaaccccttcagatcttgggatctcagtttcctctcaaatgcatgctgtgggtagagaagcctgggctggtgtgtgtataatttacatctgttataagtgactaaacttgtaagaacgggtacacaaggcatctttagtaagaagtaataatatctgccttagtaataatatcttctcattcttgtaggtccatttgaaatggctccatctctagtacatctttcctgactactcccacctggccatcatatcatctttctccattagatttcaggcagactagaccgagactgtgggtttttatcctgttagccacttagaggctgtttgatcttgggaagattacttgcttttctgtacaaagtatctttatttctgcatctgtaaagtgaagataagaatccctacttcatagggtgttagtgatatgagttagtaaacatgatgcccttagaacagtgcttggcatgtgctgctgtggttttgtcatcattattactccacttcttccttggtacatagctcatgttctccttaactatacggatgtatttagcgatctgccttaaattgtgatgtgttccttctggtctgagagcccttgtcacacataacatgataactttgacttggtaggtacctagtgagcatcttggattgagctcctacaggatttagttaagaattcaaagcagggtgtattctcattctgacttttaaagcctttgaggtcagttgggggcaggtcttatttgtttcttaactggtgaagctgccataccaaggccacttgcccatgatcgtctactgggtagcctgataagaaggtcagttactcaaggctgtggactcgattccattcttgctgatattactagcgtaaatgagatgcttttggataattctctgagcaatttaggccaggtgaatactggacagtaatttcctgaagtgccatgaagtggcaggaacatgatttatgtaacatgggctcttgctagctgggatgaacactggagcccctgccgtgctctggaattatgagtgcctgccagagtgcctgcctgcttttgttctagagagtttttttttttttctttttcctttaagttaaattctcaagttgcgggcaggggcgcaggtctctatggtgatgaatggagagatgttgaactggctggttgcaaaccttaccctagcagttcttagagacaactgggataaggacattttagctggttgacacttgggttgaaagtactgatgtaaaaaaaaaaagtgatgtgtgtatggggagggacatatacaaagaagtagtaccttggcattctagccagataaaggagatctgtgttttttaaggtaggagctttgagaaaaatgcaaaacttgtatatttcagcatgcagaaaattgcacttcactatcaggcaaacctcattcatattagcaagagaagtatatgagaagcatgtggttgtgggatgccattatcaggaagttgctgtgttcttgaccttgggctctggaagaacaattagccccttgcatgcaaacttgctcagtaaagaaaaagttttggccctaaggcctgtggaaccaggcttaggatggatgatgggtttattgtccttcacagccaaaacacaacagtctttctccctttctttccaggctacccacgtgagtacgttgataatatttctgagagttttaaagaattttccagcagaatgagagaagatagaaggaccatcttgataatttaaggacatgctcttatctcttgatctgctgcattttgtttttgcttctgtttaggccagtgttggtagttatattgtcttctctccactgggcggattacatgtagcaatccaaaattgtcaacataattattccacttcttctttggcacatagctcatgttctacttaactgtactaaattgtgatgggttccttctggtcaagagcccttatcacacctaacaggacacattggacatggtaggtacctagtgagcatcttggattgagttcctccagaatgttgttaagaattcaaagcgggtgtattctcattctgacttttaaagcctttgaggtcagatgggggcaggtctcatttgttttggattacatgtatgcaatccaaaagagttaggttttttaaaaaaattaattacccccaccccttttgttaaagagtcagggtctcactgtgttgcccaggttggtcttaaactcctggcctcaagtggtcctcctgccttgacctcccaaaatgttgggatcacaggcgtgagccactgcgttcagtctaatttttatttaaaatttaaaatttaaaatttgtggtatagtccgggcacggtggctcatgcctgtaatcctagcattttgggagtccgaagcgggaggattgcttgagctcaggagtttgagaccagcctgggcaacatggcaaaaccccatgtctacaaaaaatacaaagaaaaaaaattatctgggcatggtggcacgtgcctgtagtcccaggtactttcggggctgaggcaggaggatcgcttgagcccaggaggacaaggctgcagtgaggtgagatcatgccactgcattccagcctggctggcaaagtgagaccctgtctcaaaaaaagaattaaaatttgtggtacaatataaataacataaaatttaccatgtacagttcaacagtgttaactatatttacatcattgtgcaaccaatctccagaactctccgtcttgcaaaactgaaactgtctaccattaaataacaaccgcccattctctgttcttcttagcttcctggaaaccaccattctggtttttatctctatgaatttgattactctaagtatctcatataactggaatcatatagtgtttgtctttttgtgactagtttattttacttaacataccctcaaggttcattcatgttgtagtatgtatgtatcagtatgttcttcctttttaaggctaatattccattgtatgtgtataccacattttgcttattcattcattcctcagtctacatttgggttgcttccactcttggctgttacaaataatgctgccataaacatgggtgtgcaaatatgttcttgagaaccccctttaaattattttgaatatatacccaaagtggaattactggatcatatggtaattctatttttatttttttgagaaactaccgtactgttttccataagcagctagatttttaagaagtacatttaaattcatcgttttgggccttggtctccacgctgccttgagttgtccctaggtaagtgaagttctcagtcagtcacctgctctggcatacctctgagctttgacacacctcagccactttccatggctcactttggccctttgtaggttggtgcctctcattagattcaacgaacaatttctcaggatctgggcctaaccagtggtgttgaatcttagaaagactgagctgaaatgctcatcagctggtgccatgcttctcactttaggttatacctccagttgtgtttggataagagttggagtggcatgacagtctcccacagaatctgaaaatatagttccagatgtgcttctcccaaacttcttctctgccattggggttgcaccactggaaaagtgtgtgaagcaatacttcactctgacaccctgctactatatgcttgaggaagaactgaagactgtatcatggaatgagctgcccataggtcgcgcatgtgcgcacgtttgtacgtgtgtgtgttgagatgggagagggaatctagggatccttctatactccattgattatgctaacatggatcttatttaatattacaaggacatttctttgtcatcgtctttttttttttttgagacagagtcttgctctgtcacccaggctggagtgcagtggcgtgatcatggctcactgcagcctcgacctgctaggctcaagtgatcctcccacctcagcctctcaagtagggactataggcacacacaaccatgcctggctaatttttctattttttgtagggacaaggtttcaccatgttgcccaggctggactcaaactactgagctcaagtgatccacctgccttggccccatcaaagtgctaagattatagagacgtgagccaccagcctaaaaagacatttctaattagaaagtgtagtgtgaacttttgccgtagttggacttctctccatgtgggcccttaaacactgatatctcagtcatatgaagctatcaaggaccaaaataagggggcatttgccttttctgtcagtgcagaaccaataggggccaggccaggtatgaccaacccattgtatgtgcagtggcttgctccatctttctgtctctggtttatgtatgtgatcatttgcggattccagcaggtacatcctctccaataccttacctggtaagctgtctagtaaggtttatatttcagaccattgggggatccccctcttcatggcacacactgtgcctgttgcctaatattcctttattgtctgcagcatccaggaccaatttaaatgtcactttgtgaaacttcctcagaccctcctctagagcaagttagtcactgcctcttctgtgccttgctttgaggttattgtcatcactgaacctgacccagtgtattgtaattacttcagacggtctctcccaccagagtttatcctcctctgtgcaagtgctattttttagtcctatctgtctaccttagaaccttctgcagtatttggtgtattgttctgtctgtggcaattgtctggtaaatgttttatcagacaagtctctgatgcaatgggatggagtggaattaatagttttaatcatgaccatggcccgaaatagccgtttgacaacatccaagccactcactctctcagactctcacgctgggttgtgtaaattgaattctttcaaatgagcataagttaaaaaatacttagcacttaccatgtgctaggtactttgtaattaagcattttacttacataaactcatttaattttacaataacctagtggagtacatttcagtttcatagatagtgaaaaagacacacagaacggaggttacctgctcagttcaaaccctggagtgtagcctgtgagtgtatatttctttttgcatgtggttaataaattaatgttgtatttacagctttgcagagctgggatgcccttaacacatgcagctctggacctatataagctgtcaggtgtagaagagtgagcaggaaaaccttgtgggggtaactgattccttgtacaaaagaaccagatttcagttagtgatgaaaatggaggaagtgaagaatccaagtcgaatgatagaaaaggttatgtgtcgttgggcaagggttcaaaagacctagttgtcttgattagagaggaggggagctgagggaaaatgagtcacagaggaggaaataatgaagatgaagtggccagagaagacgggctcctgcaaggaggggcctgggttttagatagcctccaagaaggacaggaagtgtggcctgatgggattagctagtctcaagacaccaggtagaatgcaggccatctttgtagactgggccttggggtgtccaaaccatgaaatgcatggcagagtgtggacacacttgtttgtttatactctttctcccatcctgtacaatgaggcagaacatgaaggaaaaattaacaaacaccccaagtctcctgacacagggatcaaaacatattgatgatgtcttgcaaatctgataatttcattgaaccatgtgaagcttaaaattgatacataggcatacccttaacattaagtgctgctgtcagtctgacatagctggataaaccaatgttgaataatctattaaatatgtcagacttgaacaaagaacgtaaatcatattatattatttcagctgtaattaggtgggagataaaatcacaaatagatgagtttagtgaatatttcttagtgtgtacacagtgtcactggaatttctttccttgctctatgggaagaaagaaattgactgccttccaagtattgactgctgtccaggaagtgggaggttgaagggtgacttatgtaatgttcacagagtgggtttcatttataaattcaatgagattagctacaatcttcctgaagttaatggtgatggaaatgcaccattctgcatttagctggaaatagctagctatccaacttggagacttaattgttcctcagattatgatatgtttgcatttatatctccctcccctcctttcctgggagctggctgctgcctttattgtctagaaattaataatgcagaccagagcttgtgggtgaacagggcgatgtattgccagtcttttgatgttcctgtttcccaacccacggagtaaacttgattattgagaataaacaagggacataaactaaggtggaaaagataaagaaattgcattaggagggtccagtgaactgagctgtagctaagaaatggagataattctagtcattacttcacggggttgttgtgaagggtgaaatatatgttaaaccttcagaacagtgcctgccatgtagcaagtgtttcagtatatatcaggttgctttcattgttataagaaaactaattggcatttgtggtggatggtcagggtggtgtgaatgtgaaattcaagagcataaacatggttgtttcctcccagatggttggtatagtgaaacagacagttaagggtaaggaagtgtaggccctcattggggctacacatcacagcatgctattaatataagcagtgtatactggtcatcttttattgagaggctatggcttttttgtgtgtgtgctggtggtttttaaaatattagtttgattcatttcaggtgattttgttaatctagcaaaacatcttcttgcactttttacattataaatgaggaccatagaactttgtgtggacattgcagtcattcagcagacatttagcaaatgcgtataatgtgtgtgaatatttttttgtatgaaaggttttcgacacctgagactcactaccctcagccctgagttcacatgatgggtcggtggatttccagagaggcaggtggaggcgccgcagtgggagcatcctggctacctgagatgtgttttgaggtgccagcctcttggctccagctggagccaattggcctgttgggcatgagctacatggcatgtagagtgagctacatgacatgtagagtgagctacatggagttagaggtggttatcctacttcttctacatcacaactttgcagagcgcttcatataagacttttgtaaatttcggagatagtgtgctttatatagcaaggatttccagggacctactagaggacaacagaaggctgacatttccccctccaggccagtagcttgtctttcattactttgcataataactacttccgcttgctttttttcccccctcacctcagctgcacttaggaggacttaatgacatcatttaacgttaaggataaatataaaaccgatctgttcatgaacaccagtaaattgcacttaaaaaaaaatggtttcacataaggcagaacaggttgctacttaaaagagttaatggccagttggttttagagtagatcacaaaaagaaatgtgacttcacccgccaactccttagttaaagaaactgtgtgtttgcagtgttggagaaccatggaggaggattcagaactttaggcaggaagaactgtgaatgagtagccctgttattcccctggccactgtgcactcatggcttctgcacattactgtgtaaactcctttctcaccacctaaaacctaccaaagcacccagcgatcttcctgtatgtgaactcacaggtttttcttggataatttgcctttccattgacctactttcaagagcaattttccctatagctttagcaggtaactaaaaaggggagtggtgagaaagtaaatttggagttccaaagggaaattacttggctttgagctacttagtcaaaaacatgtattgcatgcaggtaggtcccaggcacagtgttgaacacgggggtacagaagtgaataaacattgcttctgctgtcaaggagttcacagtctagtgtggaagatctgtgtgcaagtagatggtttcagtgcagcgtggaaacctgcagcagtagaagtgacaaaaggtatgttggtagcacggaagatgcagtgctagttccgtgtggcaaagggtgaaggtgtcttagaggactccttggtcaagaagagtttggaggacaacagggagtttgcctagtagacaataaggcagattactggggcagaggaacagtggtctcttggggagattaggagctgggaatcaaatttcaagatcaggtttttttatttcggttcagtctcatacctgctgcctgtcatgtgaccttttttttttttttgagatagagtttttggtcttgttgcacaggctggagtgcaatggcgcgatctcggctcactgcaacctccacctcctgggttcaagcaattctcctgtctcagcctcccgagtagctgggattacaggcatgcaccaccacgcccaggtaatttttgtgtttttagtagagatggagtttctccatgttgatcaggctggtctcgaactcttgacctcaggtgatctgcctgcctcgccctcccaaagtgctgggagtataggcatgagccaccccacccggcccgtgacctgactttttttactgagaagaaacagaaatggggatccttatgtcttcattccttttgtttggcataggaagctggactgcatccaaaattgttaccttgtgcaatttctggataactgaagcttacacagcctgaagtgtacacaactggttaatgacagatccggttcaactcagaaattcacatttgtccagattcattcagttgccctataatcttaagtgttttttctgatgttggattcattccttctcttacttgttcaataaatgtttgccaagtatgttataaacaactgtgcagtctgatagaggtataaggtcctttctgtcagggaacttaaagtctttttgtttgtttgttttggagatagggtctcgctgtattgcccagactggagtgcagtggcacgaacattgcaaccttcatctctcagacttaagccatcctcccacttcagcctcctgagtgacttggactacaggcacataccaccatgcccagctaatttttaagtcttttttggagatggggcttccctgtgttgcccaggctggtctcaaactcttggtttcaagtgatcctcatgccttggcctcccaaagtgctgagattataggcatgagtcactgtacctggctggaatttaaggtcttaaagtggaaataactttgaaagtatagacttgtatcagattatgaggagccagactaagaagttaagacttaatgatttatacctctcagcccagagaggatgccagtgagtttctgaatttacagcctaaggcaaattctttttgatttctgtgttccttgactttatttattactgtaggataatgccttagtgtatttgaataagtttaaaaaatttatgcctaaaggtaggtttatgagctttgcattgtataaaagagtacggtatgtaagaatgaggactccaagagccaaacagccagcttttgaatcccagacctactatttatttatttgaattttttggaaggttagtgcgcagccgacctagtatttatgagctatgtgaccttgggaagttcatgtaaatgcagtgtctcttgccttacatggaaaatgtccatgaaaatcatacccacgtgaaagttattacaaggattaagtgaggctgggtgcggtagctcacacctataatcccagcactgtgggaggccaaggcaggcagatcactcaaggccgttcattcaagaccagcctggccaacgtggcgaaacacaatacatgtatctgcaaagctcaataaggcaaagcatagtaaaacagcttgcctgtgtctcatacacggtgctacaaaacctttaaactggaaatgccaagaggcacagaccaaaaaaaaaaaaaaaaaagctttaagaaaaacctttttccccaagcctttggcttggggaaagggtgggctacaacagaaaggctttttgacagtatcctccctattgctgccaaacacccagggaaaaaccacaccccatatcaccaacccctgccagtgcagctgggctgtgcagagttgatcttccacactggtccttggaagcaggcggtgcttcagttcctctgccaggtggtgtcaggagaacggagaagggtgctgatctttcattccccttgctgggcagaactagttagtactccatggcagagccaggagtatcagcggggtccagccttatgctgagcttccgtctctaccgtgtagcaaaaaaataatgtgagtcagctctcctccctggtggcagtggggctaaggggaatcccgtcgaacaccctaacttggaggaaataaaccagtgccagtcagtgcctcatattcagtggaaagttgtctgcagggccaagttgggaggcgaacttctacctcattgtctgcagcaggcaatgtgacccagtgccctgctttttccactctagtgatgatagcgccctggaggaagcagagtccacacccaccaccccatgctacatgtcaacaggggtactgcctgctaagcaaagatgtccagggctgggagcagtggctcaagcctataatcccagcactttgggaggccaggcaggaggattgcttgaggccagaagtttgagaccagcctgggcaacgtagacctccgtctcttaaaaaaaatttagctggcggtggtatgtgcctgtagtcccagctactcaggaggctgaggtaggaggatcgcttgaacccaggaaattggggctgctatgaaccatgattgtgccactgtactccagcctgggcaacagagtgagactgtctcaaaaataaaataagtaaatatcttttgatgtccgggatacagtcaaaaatctcaagaaccaggaagatcaccgcatgaatgcgaatagccagtaatggatacaagcactgagatgaatcggatgttggaattctgacaagaattttaaagcagacatcatgaaaatgcttcaataagcaagtatttatttattttaaacaacaaaaataggaaatctcagcaagaatttatgggcctaccatgagggaaatttttgaggtgatagaaatatatatcttggcattgtggcttatgcatttgtcagactcaacaaatagtgtacttagagcaggtacttttaattttctgagtaaagtatacttcagtaaagttgatttacaaatcagggattttcatccctgaagattctggttcagtaggtctaggatagagtccaataattttttttttaattaatgccccaggtggttcttgggaactcctgatatctccagaggaacctaggctagttgagaattcttcagaatattaatctgttagcaatctgtgtaaatagaaactaggtctggtaaattatgaattaaccagataactacttgcagaataaacagaatacataattagaaatcattaagtgtgttatcaccacatggaaataattttttgtattttttttattgggtagtgttgtgaagaatattacatggtatccttagaagctgtaaattgtgatgctgggttataaaaaaactgtattgtggtatgtttttgcctctctcacttaaccccacccttcactccattccttctcaggacacttatcttcttggtggctaatggcagggtggattccacatttgggaactgctgttgcctgggcagtcatggttttcatcagtgtgtcccagggcgtggtgctttctgtcaacatcctgctctccatagaggctgagaatgatccctgatgcagtcatcacggcttttaggcctctcccattggcctcactttaacctgatgactatcatatttccatctaggctgcatttttaaatcttgtcaaggaagcccagggactctcctcactgataagccatttccaatccaggcctggggttgagtcaggtcaccttatgttcttactctttcccttgacttagattggtctggctggtccacccagataaagtgtagcagtgtctgaagctggatgtgaggggtcgggaagttgttgatggggatgccttcattccgcagcacacatttcaaggcaagcagatcattttcctatagcagtactggtcagagctggattcaggggaaggctgtctgtgtttcccacgtgggccgggtgagctgctagcatttctgtcagtgctagaaggaaagtcattctttcaatgtggtcccagattcaaaatcagttttgagtgggtgtcagaatgtcattcctgatagcttctctgttttgacagtgcaaataccccggtctcatttctctgcttttaaataatagatccttgagattggccctgggtaggagacctcccccaccccacttctttctctgagttcaccatgggattctcctaatctagccagagctggatttgatccttgggtcactcctgtggtctctagccctcctcagtgcttacttagttggtctttgtttctattggttgtttttgcatgtgtcgtggttatcgtcatcatatgactaatgtcagggggtcaggcacagttatagcttctaattgtgttgcgcttttggcaagggaactatgtgtgggggaaaaatacttattaggaatcgtcagcctgcattaaagggtcgtaatacttgaacaatttgcacatgatatctatctctacatcctatatggactgtgctttctaggagggattagttaggtttttcctttcctagtatagaaccaggactagtaggggaaggcatagaggaaaatactatggttctgtttcagagagagcattcttgcaggggtttcccaaatgtaaatttttttgttttttagagatagtgtctcagtctgatactcaggttagagtacagtggtttgattacagctcactgcaaccttgaactcctgggctccggtgagcccctcgcctcagcttcccaagttagtgagactacaggtgcacgccaccacacccagctaattaaataaaaatattttgtagaaatggggtcttgctatgtttcccaggctggtcttgaactcctggcctcaagtagtccttctgcctcagcctcccaaagtgctgggattacaggcatgacccaccatgcctagtcaaaaatgtaaatattaggtcttatgttactgaaggtattccaggaatgtttggatgtggtacagaagatgtgggtattgggaaacctctaagaatatttccaaattttatcttctgttgttctttaaaaaaaatataagctgtgaatacaaccgtggaaccacaagtaatataagaggagctgatttcttggtgcctgcactgctgactaaagatccagtctggttgcttattcagtaaacctttgagttagtgcagggagtcactctctgttttctcagggagcccttatttgagtaactgtcattacctctttccctaacccactacctttaattgtccttctgtggttagaaaaacttagtgtttgaaaggcatagtatctcaagggaactttagaagtatatcttacctttgctcttgggcatttccagatgaccctggcagtgtggccacaagcaaactggagaaggctgccagtatgtgcacgttttaataaatggaggatatctagcacctcctaacccttaccttctcctccatctcatcccattttctgattgaacagtcacgttatttctagtcttaaatacttagcttttctagttgtgttaatggaattgttgtatgtatttcagttgtattacttaagtgtcttctaaaagacatttgtatactttataattcagagaaaattctttggttgattgaagatcttgctaccaggtcctggtggaagcagctagaatttcttaagcagttcctgtgaatgtttcctttttatgtagatcatttcttggaaagctgtgttttaaaataaagctctacaggcactactgttttactctaaggcctttgagctctgatatctaagacatatttatttcttcaactatgcccaggacagtgctttgcattcaataggtgaccagtaagtgttgagttttgttgaatataaaattatttacaaatgattttttgttttttccctttaaaaattaggcttccgagaaaactttgggcttcagagtccctgcttccaagcccctctttgtaacactctatgaaatgaaaagcatctttggatggtatggggagagctgaacaatgtgaggtgggagggcgttggcctttaatcaggtttctggggacagatcactcatgctggttcatgctggcccaaggctgtcttctttcttgtttgtggatgtgggttatgttcctatactgagatgtgctggatgaaaagctaataaatattaatgaagcagttacttctgtcaggcacagtattggctagagagataggtagaaataaatagaaaatacagttcttgactttgagaaccttattgtgtaattggaaaggtaaaatgtaaatgccttaaaagttaattaacagtaattcttaaggatccttagattgtctaatacagtggttctcaaacattagtgtccctcagaatctcatggagagttattaaaatacaaatcacagggccttatccccatatatatatatatatatatttttttttttttttactcatttggtctgtgtcatgagaatttgcatttctcagttaccagatattgctggtccatagaccacacttggagaactactggtgtggtgcagttattctcaaccttggctgtatgttagaatcacccagggagtttaaaaaaaaacccatgccaagaccccacccactgtagaccacttaaatcagaatctcagtggggtaggacctaagcatttttttaaagctccccagatagttgtaatgtgcagtaaggtttgggacttactgctctaacgtgtcagggccacagaactttggattcagagatatgatgttaccatgggctgcagcagtgtggacagaccagaggagttagcctgatcttaaagaatgataaataaagaaaaaggaatgatttttgttcttgtaaagttaatgctgggaacaagccagttggttttctagctgtttcttgggacagactgatgagtttgtgagctcttaggagtcagcatgatttcccattcagcgtgagctaatgagtgggactgaggtgtgggtcaccaccatcaataataagcattcactgaccacattctctttttcctgatatagatgagcttgtgtttatcctaacaagcttagatgtgtgtgtgtttggggtggggtgtggttgtggactgtgcaatagtgagaggctgaactttgaaaaatgactttgccatttttacatttcatctctttaagcctctgtttattcatgtataaaagaaagtactacacatagttgtgagcctttttttttttaaaaaaaaaaaaaaaaaaaaaaaaagagtctgggtcttgctatgttgccaaggctggtcttgaacttcttgggctcaagtgatccgtctctgcctcccaaagtgctgggattacaggtgtgagccaccgtgcctgtttgttagtatgtgtgtgaatactactacaattttaggaacactgttttatttatttagggacccccagaatctatcagtgagcctgacacatagtgtctgtgcagtgaatccagattggttgaatgaattggaaaggttatcttttcacattgactgcccaggcattagaaaggatgggaagagcttgtttcctgatctttacaaaaaatgctgccaccttgggttttccaacttaggcaagaaatctgttatgttcaaaataaaggagtataacttaaaaaatatatagatagaagccaggcgcagtggctcacacctgtaatcccagcactttggaaggccgaggaaggcagatcatgaggtcaggagttcgagaccagcctgaccaatgtggtgaaaccttgtctcaactaaaaatacaaaaatatagctgggcttggtggcacatgcctataatcccagctactcaggaggctgaggcaggagaatcacttgaactcgggaggcggaggttgcagtgagcccgagattgctccactgcactccagcctgggtgacagaacgagactccatctcaaaaaaaaaaaaaaaaattaaaaaaaaatatatatatggaaatacattttctcagtgtgtatactagtcatagctacctgtgacttattctttattttgtgtatttttttcagacagggtgttgctctgtcacccaggctggagtacagtggtgcaattagagctcactgcagcctggacctcctgggctcaagcagtcctttcacttcagcctctgcagcagctgagactacaggtgtatgccaccatgcccaactaaaattttccatcttttctagagatgggggtctttctatgttgaccagtgttcttgaactcctggcctcaagtgatcctcccactttggcctccccaaatactgggattacagatgtgagccaccacagctggccttacctgtgatctaaagaggtattttcaattgatgtttggccatatcagattttagttgctattaaattttattcttaatttatcaagtttaattgattattaaaaaattgcactctaagaataagcctgtgttttatttcttggaactactagagccttcgttacaatacattttagagggctccaaagttataaaataaatactggagatttggtgcttgttaaaattttgaccttttctattaaagcccattggagtgatgtacagagaaaaggctgtcttgtgttgtgatagggccatgctccatccacaggtcctgggaaggatgatgtaactgtggtctaacagcattgtctgaatttttggcctagggcaaagaggaggagggcgggtaaagaaacctgatcagaccatttgatgctaatttcacaggtgactggtcactgtgtgcctggctgttgttatttatagagctgtaagtggctggagctacacacaggaacctgaaaggatggtctgtattagagtgtggtggtagatagaagcacagcagtagaatctagggacaaatggtcactggtgagtgtcattgctggagttaaatgagactcattagtggctgttatgatttccactcttacttcattgctattcctgagtctttttgaaagcaaacaacaaaatagaccgaaacaacctctgatagactctccgttatttttaattgaggttgataggattttaatcaggtcaacttgcatactgatttcaaccaccatttaaagagctatccacaaagctataaattagaattatagttcaaaaggtctgactgttttaacctactgctcctattccccaaattattgatggggaaactgagatctagcagggttaaaaaaccagcccagtttcacagttagcagtgatgctggagctgtgatctggatcttaaatctctcagtttagccttttctgttttctaccgtattagtcctacaatgaaaatgcacttctctgtctttaaatttcagacgttgtctccatggcctagatgaaggttatcctttgttatgatattttctcagaattactttgaaaaatggttccattgttatttcttaaaatgaaagtaatatgaaaacaaattccttctattgataatacatttgcccactactgatagttttaggaataatgagaaaagagggggccaatttatggtattggccaagaaggagcgctcagcagcactggactgctatgtgtgggctggaggtaccagcagataacactcggaggcagtgggtcctgtgaatcacagcttggcctcggcataagctctggagaccagctctcctaaggagaactgccttctttggccctgccctcagcagcctgttggcagaggactagaataattgtttgtttaaaagttttactagctaattatactgcaccgaattgacaggcatctctattagagtctttccagtctcttgaaggctcttctccacattacttgtaatcttgcctcagtgtagactgcagtggctgatttttgtttgtttgttcttctctcctttcccttcccacttgttgcaaaggccacacaccaagtctggagagagagctgcctgtgggctgggaattggctgccttcatctggtcagccatatgtggctactggaaaaagtgcctttgggtcattcattctcaggtcaccaggccctagagtaaagccctaaacatgggctctctagcagaaagacttattaattccccttctcttaagtggaggcaaggaggtgtttctgaaccttcagaataacccgagggaacttgaaagtacagattcccggatgctatctcctggatgtgggttcaggttcagtaggtctgaaatgggaccaggttttagaatcttcttcgcggcccggctcacacctgtaattgcagcagtttgggaggctgaggtgggcagatagcttgagttcaggagtttgataccagcctgggcagcatagtgagaccttgtctctactaaaaagagagatcagctgggcgtggtggtgtgtgcctgttgtcccagctacttgggaggctgaggtggcaggatcacttgagcctgggagatcgaggctggagtgagctgtgatggtattactgcaggtggggtgacagagtgagaccccatctctctctcttgttttttttttttttgtttctttttaaaagaaccttcattacattaattgacttccaaggtctcatccagtcatgatggtttttgcatggtccctaccagtagaagatggatttcagaccacagggaatttatttgtagctacagtcaattttcaaattatttgccttacaaatgttttcaatcccagagacctttttcccagctggttcctgggttatattgccaaagtccctggttggtatgcactcgagaactgaaagataattttcttcttgattttaagaaaagataattaaggagggaaatctaccattaaaaaaaaaatcagacattacaaccaagtataacttttagagcagatcctctattgggaaggagcaatatgttatgttaccttgtatttgagcagttaattagggtcagatgtagttagttctcatgctttggccttgcaaaagtaatcccctttttggaaaggctttgttgagtccctaggaattattttaatggtctctaagtatgtttaactcagtcataatattctagttgtttggatttgttgtgtattgacattgacttagatattctcccctgctctgggctttacctcttactcgtacccaaatccatggtccacatgctgtggtgtcccctgggcatgcccagccttgccatgtgtgcaaggtaatccctttgaccctctcaagagggtgctgctcatcttttttttttttttttttttttttggcttcacttatcccacttgacattgccaaacgtgctttgacttgaagcaccgctgctcctgtggctgtctcctttgcttctcctcttcggctcattgagaatctgtttgagatacttgtcatcctttggagattagaactcactttagagggaggaatgattttacactgggactgttaggatcagtttaggaggaaacaggcccacgatgattttaggaggggtttctactgtggtccttgtaaccacatagtttgtactgagctggacactggccatttgagtagatgcttgttctccagttatagaatggttcccagctggcagatttcccactgggattcagtttccttggccgctgctgtttgttgtgctcacactgatttttgcggcatctttccaggcccttgagtcttttccaagcagaagaaatagcagaatgccttgccctccccttctcttctccttttgggtattccatggctattagggaaggacttcctgtgaaataaaatgagggcaaaggaaagtagcatgcctgtggcataaaaatgctgttagcaagcttgaggcatatcagagagattggtcctaagagtaacatttactgcctttctgcttttgaacttttctttcccccttcctttgcctgtttctgaggtctgggatttatccagaatttaagaacggactgtttttgatcatttgaataggtatcatcattcagcagggaatacatgtgcagactgagatgtctcttaaagccaatttatagtataagtcatttgaaatgatttcttgagtcagtaatgcatttctgcttcaaattctctgcctggatttgtgcattcatctcccattttaccaggtgatttgctttattatgctgctatgacagcccccctccccaaccttcaactgctatccccagatacgtgggcatgcttttcagggtgagtagccattaaactacccaaaatgacaccgaacgttgtctacacaggcttggaaacatggagggcctggattccagtaaaattctccaggctgcttcgtcaggctattgcagaaaagattacagggtcctttaagattagttttggagagatctaggcagatggatgggtgaagtcccaatgggaagtcagtacccagttgccacttggaataatctaaaatcctggcatgatctttcctctcataacttgaagtactcagctagaggagagcctctccttcgcaagacccagctatctctttgagaagaaaagggggtttggatggagtccaaccttctggtttgttttgcccgtctgccatttgccttttccttgttggtgtttgctgctgtttgttctttggagtctgaggggcttctgaccttggctgaagggcttctaaccctggacaggtcccgaaggagtggcatcagatagttgtgttttaatttcacaaatctgttatttctttaagaggaaatgagcaactggtagacccagaacagtaccaaggggagctggggagttgttatttgtaagtgtagagaaagaaaggaacagttacagggaggtttggtgcatgatacacagctgatgccttcagagaataggaggttttctttctgtgctttttctcataacattggaggaagaagaaagaggaggcatgtggcttgttggtggttgaactccagtgcagaagttaacattccactcatttagctcactaatttattaattaatttcacaaatacctattgtgctactatgtgccaggcacccttctaggtactgggtttacagtggtaaacaaaaaaaggtccttgctgtcgtgaaccttatactctagccaagggggtggtggtgatgaggacatatttataatggtggtggtgatagtgataaatactatgaaaggaaaaaaaaacaagaaagggaagagaatgggatagggagctattttagtaagtgtgttcatggaaggccttataaatgactatacaatacataaataatcattaaaatgagattttattacctaaaatattttgaacacttcagttgttcaaattattatggaatgctagcatgcatagggactgaaaatatttttttctctgaagttttgagggttttccaaggatttagcttctctttgtttctctggatattcagactcacatagctagattagagttcaccatcacagttgctttcagcattgattgagacagtcttatgttgtaagggtctgctttttacaaaattgctataaaattgttctgtgtgattgagaggctccctctcactcaaagtagatgtttggctgtttttgttgttctgttttaaacagtaatgagtaccttttggtaattaaagtccccttcacaaaactgtagtgagtgatgaataagacataaacaaagaatcccttctgcggagcagagtgccaatggccatagacataactcaggggctgtttgaccacataactcagtgcagtggcttttcaccattggaagggtggaatggtctggtatggttttctggattgctctgataaacaggagttatatttgctgtcagtttctatgaaaggacagcattatatgagccatggtttgtcaggggcctactgtgtgctgggctctttgctataggatcaaatgctaactacatctattccacaagacaccctatcacagtgattggtttttttgttgttgtttgtttttgagatgaaattttactcttgttgcccaggctggagtgcaatggcgcaatctcggcttactgcaacccttgtctcccaggttcaaacgattctcctgcttcagcctcccaagtagctgggattacaggtgcccgccaccacgcccagctaattttttttatttttagtagaaacggggtttcatcatgttggccaggctggtctcaaactcctgacctcagggtgagaggtgaagccagctggacttcctgggttgagtggggacttgcaaaacttttctgtctagctagaggattgcaaatgcaccaatcagtgctctgtgtctggctaaaggattgtaaatgcaccaatcagcactctgtagaaatgcagcaatcagcactctgtgtctagctaaaggattgtaaatgcaccaatcagcactctgttaaaatgcaccaatcagcgctctgcgtctagctaaaggattgtaaatgcaccagtcagcactctgtaaaaacgcaccagtcagcgctctgtgtctagctaaaggattgtaaacgcaccagtcagcactctgtaaaatggaccaatagcactgtgtaaaatggaccaatcagtaggacattggtggggaaaaataagggaataaaagctggccaccccagccagcagtggcaacccgcttgggtcctcttccatgctgtggaagctttgttctttcactctaaatcttgctgctactcactctttgggtccgtgccacctttaagagctgtaacactcaccacgaaggtctgtggcttcattcttgaagtcagcgagatcaagaacccaccagaaggaactaactctgaacacaaggtgatccacccgcctcggcctcccaaagtgctgggattacaggcctgagccaccgtgcctgacctgtcacaatgattttttaaactgcatatcttaatccattagtgggtgacagtcagaattttattttattcagtttaaaaaatagaatcaaatagatgacatcagagtatactacacttagtgtgtgtattgtttcaaaaaaacttgttttaagtgtatgtgcatgcaggcagacatcagaaatttttatgtgtcatgctctaaaaagtttgaaaacaagcctatcagttgaggtttggtatcatttataggcaagtaaactgaaactctgaggttaaggacgttgcctactatcagaactaaaatttgaactcagctctttctggctttcagcatttgatccaattatgtttctcacagagctttccctctctaatggttttccaagactcttgagatcacagagacactgatttgctcctgacgttgttctaaaatcagaggaggaacatgcactctgatgaccagacccaagtttgactggtttctcaaaacatctttacataacatagtctatttcaggagaagggaaaagaaagatgactctagaacttgtctttattaagaaacaaggaaaatctagacactctttttctgtcatagaaagatagcctagttttaccagagaggagaaattctaaccagaagtagtatcaggatctttctctctaaagcacttaaagtcttttgttggcgagacgagtagagcaagaggaatctgccaccttgtgtaaaacattttggttttactagtcaggcatatttttgaataaccttcactagcatttattatagtagttattttattttattttgacacagagtctcactctgttgcctaggctggagtgcagtggcatgatctctgctcactgcaacctccacctcctgggttcaagtgattctcctgcctcagctgtaatcccaagaagctgggattacaggcgtgccaccatacccagctaatttttgaagcctctattttagtttcccccaactttactagagatggggtttcaccatgttggccagggctggtctcgaactcctgacttcaggtgatccgcccaccttggcctcccaaagtgctgggcttacaggcgttgagccactgcgcctagctgttacaacattttggcaccagttttacctacttccccagcctcctaggaatgaagtggaacttttattaaggacagatttttcagaggggcattattctcactggcattccttccctcttgcctggaatcacccttgaatgaattcctgattggttcagctagactttttcttttacagaagaaattgctcttggtgaagatgccagaaaaatatcgtaaaaacctgctctcttatcctcttctctgtactactttgttaccccaccccaccccacctcaagcccccagtaaaaaatgaccttttggcccagggccctatctgagtatattgtgtggcagagttgtctctggctgactcccaggattgttaatgacttccttctctgtccctaaataattgcttgaaaagacagctgtggagagacattgcccccagcttgcaggctcattaattcagccctatgaaagagggtgcaaaggaagaaggtggaagttactttgccaagagtagcaggcttgggggaaactaaaatagaggcttcaggggaagggcagcagcatggtgtcagagattacacttggagtttgtgaagtctgggcaggcttcaatctaaagaaactttatgcacaaaagcccaaatccagggaaataaatgaaagtgattattcacttttctaaagtccttacagtagcgttcctctggtattgtttgaatacagtttaacctgaagggcacttggtttttgtgcagctcttcaagaacagaagcatctaagtaagtagaaagtctgagaaattaacagagaagattccctaaaagtcagccttcattacttgaccattattcataattctgcatttgtctattcctccagtggccttgaagcaaaattaaaaaaaaaaaaagacacttctatgccccttaaaaaaagaataatcaaaacttgcatagacagaataagaatcaaatacactggggaacaaatactctgattagctgtccggttcagctctgacgcgtctagcactctgagttataagggaaacgataggacacttggtttttgttttccaacaacaggaaacatatcaggtttctaagaagatgtaaagtctttcttaaaacccaattatagaaggaatttatgcaagtctttaggcaaggagtattaaagaaattaatgtttaatgccatcaacaagttttcaagcagatgcagaactcctagtgtgggtgactttttggtgtttaccttatatcaagaatgcagcatttaaggccactttgacagagtgcagctaagctttttgggtttgcttgtgtggacaatttccattcagcaatggctctcaaacttcaatgcacatcagaattacgtgggggcacttaaaaaaaatgtatgcccaggctgcatccagaccaattcagtcagaatctctgatggtgagccccaagtatcaatattttgtaaaactgattccaaaggttagctaagtgtgaatcagtgcgttagatgatctttaacgttaattatcttagctggatttctcaaaggggtagtcctagaatgctgatattccctgttattaatttaagtaagtccctgttgtttctgttaacattctcttagaactctgagacttgtatttctgctgggacccagggctactgcacctttcttggcctataggagtgttgtcagaaccaaagtacttgttaagcagcagcttaggatcaacattagcagacctcattgtggctgttggagaatatagaacatcagatgaagtaggggcttgacgtttccacagccctaaatcacatatttcagagtacgttaagattccttttggaactcagatctttttctggccatggatagactgttgtcttggggggatgccagttgtctctccagtgagaaaaggagatgtttatgtattctctagttcccttctggaagttaaaaatacctgtcattgttagatttggtttctgaactctctgcccctaacaaagctgaaatgatgacagtgagtgaagtatttgcttaaataaatatcttttttttcaactttgaagaactaaatatatctcaacgtgttgaaacatcagagaattggctgggcccagtggatcacacctgtaatcccagcactttgggagtctgagctgggaagattgcttgagctcaggagtttaagactagcctgggcaaaatagtgagacctcgtctctactaaaaataaaaaataaaaaaaaaaatggctgaatgtggtggcacgtgcctgtagtttcagctatttgggaggctgaggtgggaggatcacttgagccctggaggtcaatgctgcagtcagctttgattgtaccactgcactccagcctaggtgacagagtcagactctgtctcaaaaaagaaacatcagagaatcattgattttatgtaatctagattttatcccattccaaattgtgcttctgtgaatacacattatggaggataacggaaagggtgtttagggaaggggatgacaatgggaggagagggagaaaagggtggtgggagaggtaatataaatgataattaccatgacttgaatcttggtaaaatcgtataataggaaccatgtggtactggtgttctgattaaaaaccacttcctggctttgtgaccttgagtaagctataactctatttttcagttttctcacctgaaaaattataatgatacctgcctgttaggattgttttgaagattgagattgttcgtaaaatacttagaaaagtgccttggcacatagcaagtactatttaagtgtttatcagagcatagtctcaacttgtcccattaagaatattataaaactgtaaggtccagatgatgctttattctgtaaaggccattaatggagatgcttgaacatctctaaattacctttccctttgcttgctcaggaagtttgctaatctaaattcttcatgctgtgctgctgagtgtcatgtgtgattgcttgtgcaaggagacccaactgggttctatccgcacttaactgaaactcaagttattccctctctagccttaattcctgtcttctaactctccaatcgatttcttggctccactaattgaaacctaccccagttttctcatgctgttgagcagggatcttcttgagactgattatgatgggagaatgacctcatagtttctgatgccatcttccaatttatgtaactcagccccaagcatgctttttaaaaataatggccctaaattgctgacatcttgtcatctgctcagactcctaaatctttttgtgttccctcgactgaatgggattcactggagcaagatgcctttgtgcagtctgcatttagtgcacttggcgagtgacctccaatagagctgtgtgttcccttcgagcaacatgggtaatgattacagcgacaatgctgctattgtgtccagaggtttggggctgtaatttcataatgaaattgaaaaacatgagattaaaaacctgaatatagcacagtaattatatttaagtatcacaaatcatctccctgtatttagttaggtgtttgagatttggcctctttgtggagtgcagtcacgtcgtttcatacatctgcaaaatggaaggcttctaatttatggctaaaatgtgggaattgctttctcttaatgggaaggtgaggagaatggtattgaatttgaaggagctggtttgcttcattgactagagtcaagaagggaggttgtacaatagctgcttaaggtaaagaaatgtttgggtcttttcatggtttaattcccagatacttacacatgactatagtctctccctttagaaattaactgacataggctggcctgggaaattctacagtcctgcagcaaatggtgcagttgcagaagtgtgaatctttacctaaggcagggtttctggtatagataaagacttaactggggtttgtttcccacaggtaagttatggatgagctgtgcctggcccatttccatttactgtctgagaatctgcatgtggcctgcaggctctgtagttgggctgagtcctcctggagtaggaggctggggaaggtgttggtggtggctgtcgataggcattcctgcaggatggtgggtggagagttagggtgaggggtgttctttaataaaggaatagaaattagagtggaaagtggtttaaagctagtgatacctccttctccttgatttctaggaactatcaagtatgaaatgaacatagaaggaagttatgaaaggaatcattattattgtcagtgattcttgattatctactataggcaaacacgttaagttgttgttttttttttgttttgtttttttttaagacggagtctcgctctgtcgcccaggctggagcgcagtggcgcaatctctgctcactgcaagctccgcctcccgggttcatgccattctcctgcctcagcctcccgagtagctgggactacaggcgcccaccatcacgcccaactaattttttgtatttttagtagagacggggtttcaccatgttagccaggatggtctcgatctcctgacctcgtgatccacccgcctcagcttcccaaagtgctgggattacaggtgtgagccaccatgcctggccaacactttcagttttggttaccatctttaaacttcacagtagacattgatacagaggtatactttctctgtgcacatatactgcctctcaccccaaataatttttgatacagcagtgcagagtgtccctttttttccaaagctttcctcccagattcttagtgaatctacgagactgagtatctgaattgcctaaggccttttatcacaaaggccttaggcaaatgtatgcaagtgtacatacattaccaggcttcatcaacatgccctactcagagacatttcggttcattaggtaggggtgggagaggttgtggcctaggaatctgcatttcaacaagcaccaggaatttttatatacaataaattctgagaatcattgccttaggaccttctttctcaggggccgggctattccagtgggtgtgttatgttgagatttgctttgtggagatgtgaacttgctgttcagtcccttttcctagcccctggcttcagtatatctttcacaaaaatacctacttttattctgtttccactggatacaaggagggctgggctttttgctgctttacccactattacagatagcaggttgggagacagtttgagtcctgtgtttgcactccaggcctactagggaagaggtggcctgcctccagcagtaaactggtaactatctaagacctatggtgctctctgtttccactggaaactcattgaaaatgctaccactattcatgtttttgacctctcagagcaaagtatataaaagcagcagttcaagtaaattcgtcaaacatttattgagtggtggctgaggctaaagtattattttaaggggcctgggacagataagtaaaacacagtttccattctccatctatcctgtctttctttctaatgatgtagacagtcctgacacagaactatggcagacttagtgtaacctgtgacatgatcgtgtctttgaacaagtgaaattaaagtgctataggaatgtctgggtgggaacagttagtttaggttaggcaaaaggcttcttaggggaagtggctttgggcagggtgtagggcagaggctctcaccttggctgtgctttacaatcacctgagagaattttgaaaaaccccaatatttagaccaaaccctataacaatcagatcagaacttctggaatttggacagagacagcattttttaaatgtttaaacatttaaaaacattaaattttttaaatgtttaaacatttttaaagcttcctacatgattttaatgtgcagccaagactgagagccactgacaaagaaggataaataggctgtcattcagatgggggatagtcagagaaggaaaggtattccaagcttgagagaataacataagcaaagctgcagaggcagcagagtgatggcttaagttggagaatgccactcaaagcgggggtgattggagcatggggctcctggcatgagcgtggagggaaaattatgctgattaggtaggattggattaaaatactgcatcaaggaattgggagacatgattttgcactgcctttggaaccccttttcacctcatattaggatggagaattgaggttcggagaacttcttgcttgcccaaagtactagtaagccagcaggcatgcttggttccctttgcaaggctctttgccatagacctgctgtctcaagctgtgcagtacttaagacttctcttttggcatctgtcctatagcacttttctttcatcagagcaccctaaaggtaatttagggtcagaatggtaggaaggtattggtgttaggcaagaatatggcacgatttcttatctttttgctgggcccctgtgggaatgatatgggagaattgctgggaatactgggggcagatgtttgcaagtaaaagtgtatatgtttctgtgttcttgcagctgcattcgttttgtgcctgattccactaaggactgtactttatctgcttattgctgtttctaggaagttaatttgcaggtgctataagtatgcatgcttcatatacttcatttattctttcttccttgaagcctctcctctttattaggcactattcatttgtctacttggtacctgtatttttttaatgtcactattttgacagtaccaataaaggtaaagccactcaattacgcagggctctctctttatgctttgggtaggtgcacctgtgcaactgaggggacggtcagtgttatcaaggttacctgttattacaagtagaagaacccacagagatcaggagagagctcattttcctccattagtaggaggtaggactatacattcacaaacacgaaccttaaaatagctcacaaaatagtgtcatacatgtacccagccatctttccactcattccttctcaaaaggaatgtagtaccatatagtagttaagaatatagacactggagccgatcttcttgagttccaatagtggctcttctactttttaaatctcattttccttcatctttaaattgaagatagtaacaatctcatggggttgtgataactaagggggtaatgcatgtaaagtgcttagaaaatgcctggacataggaagctctaagtttgctgctactactgttattatggttactattattaatcattgcaaggaaaatgtatcaacagatgaatttggttcaatactgccttctagttttgtgaccttagaatttataggaacaaaaaagatttgaaagggaggttgggctggatcatagagagccttgattccatgttttaggatgtatacacagtgagaagtccttcaggttttggtcttggtaagagttgtgaatcagaaagttaactcttgtagccaggcggagtggctcatacctataatccaaacactttgggacatcgaggcaggaggatcacttgaggccaggagtttgagaccagcctgggcaatgtagtgagacccctgtttctgccaaaaaattactcttgcaacttcatgaaaaataaatgattagcagaattagagcagttaggaggccatcttaatagtccaaggcacaataaggcaaggaaatgaatgagagcagtggcagcagacatgaagatgagcagttggatgcgaaaggtttgttctatagatagattcctcttggcttaagaaggggaaataggaaattaattagtaatcagaaatatttgcatattagtcttctccatcttcatccttgatgagaggagagcttgttatgtatgtaccattgctgggtacaggaggcagaagagctagcgccagaacaaggagctcagctttttctggtctctgcttttacgtggctcgttataaaccaggacccaattagttctttaggcatgcctgcctgttctctttccatgtaattactttgtggagcttgggttcatgcacatagttacctcgattaaaaaataagtttttggagctataaattttcaaacactgctttgagagggtctgtcaggcattaacattcaaggtttctgtggtgggctgacgatagcctctagcctctggatgtttttcacattccaggaaatgacacctgaagttttcagttccttttcgcatcttcagcaatccatagacagtggggtgaaaagatgtaacctaattgaagacggatggagtggagtagaagttgaaaatagggaagaggctgggtgtggtaactcactcctgtaatcccaacactttgggaggccgaagtgggagaatcacttgaggccagaagtttgagaccagcctgagcaatacagtgagacttcgttctctaccaaacaaacaaacaaaagctagttgtgcatggtggtacccacctgtagtcccagctacttggaaggctgaggtgggaggctcatttgagctcaggagttcgaggctgcagtgagccatgattgtgccacttcactccagcctaggcgacagagtgagactctgtttccaaaaaaaaaaaaaaagaaaagaaaatagggaagagactgcatgagtcctgccatgcagtctttcccagaattggacatttttgtggtgtggtctggaagaaggaaaacatttatggtcatacctctccaaattgaacaattgtgggaatatgtacagacagatttgcagggtagctgaaaagaaatgcagttctgttatttttttgttatagagtggtaacttgagtgaggattatgaaacattgcctagcagaactgtttttttaattgaccttcatgtataattaagaatatcaattattaatgttaaatatattggaattttaaaaattgtgattatttctttgtaatctgatttgtgctatttgccctgattatcagagtgttgtttgagattaaagtggtctagcttgggttcagtttgcaccaggagttttgaattaactaggctccatctgaatgtggaagattttcgtcgtgaggatgcaatggaatcgtaagtgtaaagggcctagtatagtgggtagtaatttattttactcctttttttccactttaaatgaagagtggctaaacttcaacttttgggacattggtctctacctgcacctccagaatgtaacctcttggggaagatatttggagacctggggacttttgcaggtgggtagtattacgcagagcccagatacccctgccttcttgtctggaaatcagtgattctcaaactgctttgtgcttgagtattacctggggggacatgttccgttttcagctccccaagccatagagttaagattcaatagacttgaggagctgctctcagtccaggattatgtgcagatcccgaatctgatcttgggctgctgtgcttttccagtgcccactcagtatttctggggctgcaaggaaggcagtggttccccttcacaggtacgtgaagctcttaactccatttttgtccttttaaattcacattaaagagagttttagatatgcaggaaaatgagaagggaaattgaccttgcctgtctctgggtcttgtgaatagaaaggaagagcctgcgcttggaggccactgggaatttgtggtgttccagaagacctctgctctcatgtgggctcttggcagcctcactgagagccacaatgggcttccttatttaagatgctcttaaattttcttttctaacactataaggttatgtcttcaccagtttctcagattttaaaaaaagaaacagggaggtaaaacaaatcccaaaacattttttttccttcttgtaaaggttacaaacataaatcatatttgagaacaatgaatggaccttattttttatcttcagaatgctgggcctctggcatcttagaaagtctctttactttcgaaaggaaggagacttgtatagtgagagcatcacactctggggatcaggtaacttggctatgctactgggcacctgggacttcttggtcagaacaagtctccactgtgagcttttttttttaatccatgaaatgtgggggtcctgaagctatcaaagcgttaatgttttatgattctagtgatgggcttctgtctgcgtgacaggcattttccagactttgttgatctatttcgagcttgtgaggaatagcatgtaccacccttcattacctcactcatggttcctcttcatcagtgctttataaactgtagtgtgtttgtgctgggaggaacgtaagagaacatgtggatcacccctttactcattttacacatgagaaagatgataccccaagtgattttctctaaggttgggacatgactggggctctccttgcgatttgcctttcccttcagtgcgttcggtaaacgttgcattaccccctcttcagggtattattctttcagttccatatgcctttcctttcccctgggatgctggagtattcagttttatttctaggcaaaagtactcctaactgtggcccctaatttttttttgttatgtatcttttctagaaagagaatttgattatgcattgtccatatgtttacatactgtactcataaatgaagttataaaatatatgtaagttaaaaatgtggagaaaagggaagtcttgtgcaccattagtggggatataaattattattggtattacggaaattagtacggaagttgcccgaacaattaaaaatagctgggtgtggtgactcactcctgtaatccttgcactttggaaggccaaggtgggaggactgcttgtggccagaagtttgagatcagcctggacaacatagtgggatcctatctctacaaaaaattaaaattttagctgggtgtgatggtgcacgcctgtagtcccagctacttgggaggctgaggtggttggactgcttgagctcaggagttcgaggctgcagtgagctttaatggcaccactgcattccagcctgggcaacagagcgaaacctagtctaaaaaaaaaaaagtgtgtatataagtacacacatacacacccctcaataaggctagagagaaaaaaattatatgtaagtatggtattttttttttcctcaatcacagtggatcagtttatgccttccctggatccagggtgaacttgttttgaggaccactgatccagaaagtggtggagttaagtctgtaccaccagctttagaatctcctgtggcacttattaaaaatacgaattttggtatctcaacccagattcactgaatgagaatgcctcctggtggaacctgggagtctacgttgtcttcatttttatgtttttaccaatagacatggggtctgttgcccaggctggttttgaactcctcagctcagagtcctcccacctctaccttctgagtatctgggaccacagtcacaatgcccagcaaagtctccattttaaaccagaggcaagtctccaggtgcctctgaggtccagcgagtttggggaaccggtattttagacaggcagggaagtgtcattcatgggttcatgagcatgggacttcttacactgacatctcagaaattgctcagctgttactgttaaatctacagtgatacagttagcactctggaaaatcagatgggcagttttcatttgagttacatatgagggactataacctgcataatcatacatggaatttcttaaaactccttggcattctctatgtggttttttgatttgtaaatccaaatatttgctattgtgcctcagtctttttttcctcattagaaatctaagctctccccgccccctcctggtgctgttccttgaggggctgtgtttttatttctgagcttttcccatttgtgtgtgttccttttgtctggagtatgcccaaccccctcacctttttacctgggcagttcctactatctaaaaaattccctataaatgacattatttttcattcttaaaatctaaagataatgaagaactagctgataatcagcatttaccaaaatagatttaagggttattatttgtaataactcatgtgtcagtaaccttatgtatgtaaggatagatcagtatcttggttattaagcatatactctctgaaacattcgaatcaaaccagtgtaagtcagataaatatgtaacaggaaatttgtttctgactattcactccaggtcaatgtattcccagctgccttgtgggtatcagggttatctgttccaggatcagctttaggaaagcccctactcaaatctccatgtagcaagagtgcaggctagttgagaacatgtgataattaaggttaaacaaaaaaatcaaggcagaatgactagaaattaggacagcagggaaagcaggggaagcggttgagctggtagaaatgggtaatacctatgattatttctgggatcaacagatacatccctgttgtagaagtccaaagcagtccttctttttggtgtcttttcctgcctttggtatgataagcccccctaacatctggcacactattggggtgacattgtgaagttacctctgcccacagtacttactccagtttgatatttttaagaaatgctcactttccactagccatagtttattggctttcagaaagtgtctggcagtgagtatgccaaaggtcaagaattctggcagagtttgatttatctctgctcccttgatagcagctagccttggaggcatagaagctcttgacaagtactatgagtcagaaggccacatgtgactaggtccctgcccacctctccagggtcaaatagatcttgcctttttccccagcccctccctgcactgttcctgaagagggctgtgtttttctttccaagccctcccatttatttacattccttctatctggagtacttcttaccccctcacctttttacctggctaattcttatatatcttttagataattctacataaataacacttctttcacctttcctaaactagaataggtattcctgctgtatgcttctatggtcccctcatttcccctagaataacttactacagtttttcgttcatacttactgttatccccctggactgtctgttctgctaggataaggattcttgctcaccatttcctcattgctaggcataaggtatgggacatagcaggttatcaataaacattttttgactgaataaaagcataataaaacaatatgttaattaatggggtgactggcagggatctagttgccaatttcagcattggtaattaacatggctagatttagctgctaggttctatgagaaagaatgattaaaaataaacagaaaggagatggaagttgatacgattaaaaacattttatgtgcctgctgatggacctaaaactgggcaaacctttctgcaaataaagctctaccttgatggtcttattgatataccatatatacatatatatgtatgtatataaataagatatacctatatataaaatatttatacctatatatggtatataaatgaatataaatataagatatataggtatatatatgtggtgtatatatacataaatatgtttgtgtatgtataataaaagacattactctccattgaagtgtttactacattatgtactatcttaaaacaaaacttcccacaggtgtcagtacaaacatgcatttgttcatttattcattcattcaacagttttgttgattgtttgatatatgtcaggcacttttctaggtgctcaagacacaacagtgaacaaaacagacaacaatctctctgactcaatggaacatgcattttagtggaagggaatgtcaataaagaaacgtctaatatctagagtattagaaactggtaagtgctaggaaggaggaaagggggccaggaaatgatgtgatgtgtgctgttgtggtggtggggcatgcaattttagattcagtggccaggaaaggagtcactgagaaggcaactcttgagtaattacctaaaagggggtgaggaagtaagccaggtgggtatttgggagaagtgaggtaggacagtgtgcatagctctttggaatgtgctcctcatccctcatgtttattacgttggccagaccagcaggttgggctttcagtggcctgtttgatcagaatctgcaaatgtttcctgtctttggatagtttccctgactaaatcttagcctgaagacgtatgttaaggggagagcgtatgtttcttcttgccaacttagttttatggaaaaggccctaaggaaaaagcctgtcttttccttttcatgggtcagaatttgtgttttgttattttctaagctctagtttgtggtggaaccacctctctcagatcttgtttttccttcagggcacagtgtatttctcacttaagtagtttatgcagtcttatcacagtgtcccctgcatggggacctgataacttactctgattgataacggaagggcttttctgtctacttctgtctccttgatggcttccttatctgttgtcctgtaacactaactgtgaactcatttcattaggtaatgaaatgttatcttctgtaattgcttatttgtgcagcagtcttgtctctgcaactggagaggaactttaggttctttctgaaccttagagtactggctcatagtgcctgtgctataaccatcattgattgctgttggtcaaagcacctgactttttggggtaagtaaaccaacatcttgcttttcagtgttttgtttttctggattacccatctatgctttgggtttaatgctccttaggacttggccttagtatgctgctggagagcccaagggaacagtatattagtaagggatgaattctttgtgaattcttaaatcttccattgcgaagatctttgtacagaatactggttctgtttatattgacagttcttcagagaattgtgtgttgactgttcatggcagaaacaccataagttaattgctgtttcaaatttcattgacactttccccctcatttggaggtcatttcctcaaaaatgtcgttgtccacatgacagtttgtgtatgcttaataaaagagaatgacaaacccaagttcagctgttgttactggactgggtggtttttagctcctcccacaatgggcaataatcagtttggggtctcagcagaattataaatacctgcatttcatagtcttcctgaaggaattgctttacttggaatactgtagttcagactgctgatgtaccgtgcactcctttctctttgatgatcagctctgaagtgcaccaattggagagaactcttgaataaatgctgtcacttgtcacatgtggtcactttctggggactgtgcatgtgccagtgggggccatctagaagccaccgatgcccactaatataacaaaactcactgggtttgcttctctataatgatgttggattgctttgctggaaatccttaccatcttggtttctctcctctgtttcctgtaaacaccaaataaaagtccttgcatacaaatgttaccatctttggaaaaaaaaaaagtccttgtagttgttaacagttacagaaaatataacctgaagacttggagtcaaaaaacaaatccctgccttcccatacagtcagtaccagctataagctaattaaactcaactgttcccacctgttcccggggaggcctctaacagtggcacatgcttttctctttgggacttaacatttttcagaactctttaaatttcattttctaggccaggcatggtggcttttgcctgtaatcccagcactttgggaggccaaggcaggaggattgcttgattctatgagtttcagaccagcctgggcaacatgacaagacactgtctctacaaaataaacaaacaaattagccaggcgtggttccaggcacctgtggttccagctactcaggaggctgaggtgggaggatcatttgagcctgtgtggttgcggctgcagtgatcattgtttgcaccacagcactctagcctgggtgacagagtgagactcttgtctcaaagaaaattttttttcattttccattgacaccatactaaacaacgtgtatttccagaatcaacctttatttccctaagaaaatgtagattgtgatgtccctggtgagcaataagttaatattggctgatagtatttgagcagcagtgacagataggaggaagacaggagggaagagatgggagtgttgctgggggagtgggtgtgaaaccataacacacatatatggtcacgtacacatctgtagtttactcaaatggcattttcacaaagcacagtagtgttgcaggtatcccccagtgggcacacagagctttcagtcctcactgtgtgaaacttctcatacctttgatgttgaatttaagttcattagtggctcctatagcatgtcagaggtttacctcacttggttcctgactcaactctgaaatgctgagtttagggtggatttgaagtgtcaccttcgtctctactttctaagagtcagtaaagagctgccatgatagttaatcctatagtgcctccaatgaagacttaaatatacttactagcccagactttgctttatcattctcctgatctattagttttattcctgttgacagccaaaatgtaggatcatgaaccccacagttacatggatggtgacagacctgagttgttgtcgagaatcgtgctgagttttgttatcacatttcttgtctcgatttgtagcatctctggattttacttctttaccagaatagtggttatcaaagtgtggtcttcgaagcagcaatatcatcatcatctgggaacttgtttgcaatgcagatttccaaggctctaccatgacttcctgaatcagaaacctttgaggaggaagccagcaatctgtgtcttaacaagccctcctgtgattatacccaactttaagaatcactacacagacagacgttgctttccttttagtctcttgagcttgtaacagttgatattttaacttttatatgagagaggacagttatatcttcctttaaactcttatttggtgcagttgattgtcagatgcagagtgctgatgtgaggatggactgtgaatatgatccactgtggcagtgtttatagtctcagcccaatgccttgttgacttaagtagcagccttgataacaggagataaatctgcaaagatactgtgaggttacatggcaaggcttttaaaatacaccaacattacatttgtggcaagtgctttgctcaatgttggcatttttgaagtcaccctttacctctgccccctgcccagaaatttccttgtgagaaatgtttttacgttagacaaactgccatgggggaggatagtcagaaagaggagacaaataatacgcagaggcagacttttttttacatttgttgctcagaagaaaaaaattccaatgaagaatgaaagaggcttcatatcctgaataaagtaaatgatctgggtaggatggtacaggaatagaatgtgactataaaaaagaaccaaattgtgcagacaagaaaatatgaaggaaaaaagaataggaaaaagacagggaaaatgcaaattcttatggaatatttttgcaaatctgtgtacagaaggaaccaagcaacgcagatcagttcttctgaggctgggagttctaaaaattatgcagtatcaaggaaggctttcttcctgagtcaagtgtaggaagcagaaccaacctttatttctctatgaagatgtatattgtgatgtccccagtgagcaataagttaatattggatgatagtatttaggcagcagtgacagaaagttttctttctcctgactgaatctcacaccaaggtccctttttatttttaattgtttagtttaatttttgttttttgttttttgagacagggtcttactctgttgcccaggctggagtgcagtggcgcgttcatagctcaactacatcctcaaactcctaggctcacacgattcccccacctcagcctcctgagtagctgggactataggcacgtgacaccacacctggctaattttgtaacttttgatagagacacacacggtcttggtcttgctatgttgcccaggctggtctcaagcggtcttcctacctccacctcccaaagtgggattacagatgggagccaccatgcccagccaaggctttttttttttttttttttttttttttttttaaaccagcgtcacaaccacagaagaaagacaagaggaagatatgaagacaaaactcaattttttttacttagtgtgtctaggtaaaggtttagtaggagataatgtagaaatgaaatatgataatagcttatttgtgttgagtgctttgatgtatgaggcattattctaagggcgttatacttgttgaactgtctacttcttacagagtctgatgagctacactctgtttgtgtatttgtttttggtggcttttttgagacagaggctcactccactgtccaggctggagtgcagcggtgccatcacggcttactgtagcctcgatttcccaggtttaggtaatttacccacatctcagcctcccaagtagctgggactgcaggtgtgcactaccacgcctggctaatttttttgatgagctagactctgttaccctcatttgctagttcatgaaattgaggcagagagagaaagtaagcaatctggccaaggccacacagctagcaaatgggatttaatccctagcattttcattccagagccttgcctttagccatcacactctactgtttctcttccatagtcgtcttctttcttgtgattccaagttaaagaattgtcatggatgagctttttccaggagtaaaggtacttgttggactcttcatcagatttggtcgcgggaaaagaggttgttgctcttccttagagacctgttctttctgcatttaaaatctgagtgtaaatttttttttagctggaaattttaaacgtgtagcaagtgtggccagcttgctcttgtaatgtttagtttcctggacctcatgttgcctccctaaaacttaaatggggttgtggttgcacaacagtatcatggaaatgaaatgaatcttaagcctaatgagtttgaataagatgagcacaatctaattttgtttccagtcgtttttcctcctttaaacaaagaatatcatgccaaattggaaacattggattgtgtcactgtgggtatttattttttactacatgtcaccaagatccagatttgttgagtgtattagttacatatggggtaaaattctgattttttaggtgtattagttatgtatggggtacaaaattaccacaaaacttaccatcttaaaacagcaaacttttactatcttagtttatgtgggtcaggaatttctgagtgacttatctgggtagttcttgcttgacttctcttttgagattccaggagtaaaggtacttgtcagactcttcatcagatttggtcccgggaaaagaggtcattgctcttccttagagacctgttcttgttgcatttaaattcttagtgtaaatttttttttagctggaaattttcaacctgtgtagcaagtgtggccagcttgctcttttaatgtttagtttcctggacctgcagccgaaatgttatctggggccactgtcatctgaatgtttgactggagctggagagtctgcttctaagatggctcattcatatggcttttggcaggaggccttggtttctcaccacatggacttcttaacatgacagctggttttaccagcgtgactgattcaagagagagaaaaatgacctaatcttgcaagtcagacactgtcacttctgccacattctgttagtcagaagcaggtcattaatggcagcctgcactcaaggggaggagaattaggcccaagctttttttttttttttttttttgaaatggagccttgctctgttgcccaggctggagtgcagtggcacgatctcccaggttcaagcagttctcctacctcagcctccggatcctgagtagctgggactacaggcttgcactaccatgcctggctaatttttgtatttttagtagagacggggttttaccatgttgttcagactcatcttgaactcctgacctcaggtaatctgcccgcctctgcctcccaaagtggggattacaggtgtgagccaccgcactccggccaaggccgcacttttgaagggaggagcattaaattgtggacgtattttaaccaccatagtaggcctgactccacacctactaaatcaaactctctgggtatagtaattttcatttttaagattctctcaaatgatttttatacacacttaaaatagaggacaactgggtatctagaagtaaatgaatgctatcatggcactatactagtttatttaaaaggccagatgtttttcacatgtttagcattctaaatatttgaggtttgtggatgaggtcacttggaagtaaaaaaaaaattttttttcaggtttgcgcttaggcactaaatcatatactaggtaatatagtacactctgctcagactgcattttatctggatgggcccttagctttttttctgttgctcattcaggcagatgagccccactctaatgtagcctgtggtatctgaccagctgctctcagtgcatatagcccaagcaggagctgtagctcctgattagaaagaatgaagtatatgtctgggcagggcaagccaaaagggattctgaggttcttgtctcaagatccagggtgaaccaggcaccatctgatgatggtctttggctcattggctcctacagctgcatactttgttaggagacatgaggggtacagaaccaggagtttgcaaagaacaatcatttgccttctggagcccttctaacctggacatcacacccttttgatgttaaatgacagacgtctggctctgtgtgacatcatacctatcttatcttagtgtacctcagctaacctcctgaggcttttggtggggaatcaggcctcattccccatcatagacataatttcctttttttttttctgagatggagtctcgctccgttgcccaggctggagtacagtggcgcgatctcggctcactgcaagttccgcctcccaggttcacaccattctcctgcctcagcctccccagtagctgggactgcaggcacccgccaccacgcctggctaattttttgtatttttttttggtagagacggggtttcactgtgttagccaggatggtctccatctcctgacctcgtgatctgcccgccttggcctcccaaagtgctgggattacaggcgtgagccaccacgcctggccgatcatagacatcattttcttaccttcccattcacattagctcttagccatctgaatgcatgcctacaaggaatgcaattggttgcttaagaacggaggaaacatgttatggaaatctatacttctcttcaaatgtttgtaccactcacctacccaattcccttcccaccccaatcaaaagacaaatacccatgctcagaacctgggggctcacattttacctgaaattccacaagtaacagaagcacacatttaggggataaaaccctagagagagagtaacacaatcctggctgccatctcagaacaagagagcattgtacccagagtccatgatcacatactggaatgactgtgtgacggagctgacatgccccaataggtacaacagattgttctgcttgtaaccaatcaataccacaattaacaaatatttattgaacaccccggaagcaccctggtatatactgtcctcatcagctatttgttagaataacacgaaacctcctgatcctctgtctgccttcaggcttgcctctgccccaataaaatcaattctctacatcaaaaccagagtgacttttcctaaaatatacacatttgaccaggtcatttaccttgaaatgttctggttgatgttcagcatccagataaagcccacacttcccagcatgacctaagaacctgaccgtgtgactctgcttccctcttacagcttctccacacatgttccagcgtccaggcactctccactcctcgtgcctcccaccatgcccacctctcttgtccttcccatctttatgtgccacataacagcggctaagagtgccggcgtcagagctcataaggctttgattcaaaacccaactctatgacttaataattgtagagtcttgggtaaattactggatgtttctgagcctcagattcttcgtatacaaaaataaaccaccagcctcacaggattctcataaggattaactgtgatcatatttaaaatgtttagcacagtgcctagcccataattaagactgagtaaatattgctattgctatattgatgtatggaaagcccttggcacacagtagttgtttaattaaaaaaaaaaaaagatccttgtctccgggagcctcagtttttttttgatcattggaacttctcagtgtgacattcagagtttgatataggagtggggatggcattggtgtgggtagagaactagggttttgagggaaagagagagaaagttgataggaggagcatagatgtaaaaaccattgtgtgtttccatgtgatcttccttccgtttgaatatgactaaaaatgtcattcgttttggggcagggaaaaatggtagactaggattcggaagaaactgacattctgacgttgagtaagtcactgctttgcgcctttattagttcatatgtaaaattggttcatcagatactgtttttgagagctttttaaagactagaaaacataacgtgaaataaaatgacaatattatacccctaattctacatttacagcatattcaacatttttttgaaagcaacatttttgtttacacataacagatgctgaagcacacagccccctagaaatggaggttgccaggaggataaagaagatcatgaatgctgccagtgtctctaatctttgccctcattccttgtgtgtctctcatttgagaagttctcacctttcctgggggttctctggccagagtgtttttactctgcaccactctacctgccgttgactgggttaccttcataaaagaggaatctgaagggccttatgggaagagtactgctggtggacacatggaatcaggaagcatagtttgaaatctagcacagattaaaacttgacctaacactcaaaaggttttcttctctgtgatctagggctctctgtggtcaccatattgcatcactatgaggtttaagatgaatgtgtgggtacctagcaaaggtctggcatgtgatggatacaggacagtcttgtcttttcctacttggacacctgagatagttccccagtgtaccctgaatatctgaatccaaaatcttcagtcaagaaggagcctctacggactagatccaagcctccctttctgatcttatttctattcattaccttcatgctccccctcccgtccataataattatcctccagactcaaggcccttcacgtgatttttagtttattacaccttagcttttcctttcttctgtatagactttgctgtacctgcaataagtgatacctttcccaggtccatgggacttgaaaatcctgtttccatcaagcttttccgcaaaccacccctcctcaccaggtgggagccatcgttcattccctgttcccccaatgcatgttgttttgcttctattatagctcttatcacagtctgccttgtagcatagtcatttctgtgtgttttccctctggattcggagcccctggagggcaaagactatgttttattttatgctgtatttccccacccccacagtgcctagtgcagtaggggtttggtaaatactgcttgaatcaatgcatgaatgaaattgcctctcctagttctgtttgcaaggctgtaatgcagaccaggtgaatgtagaattttggcttactggatttagtttagcataggaagggagttttccaagaagcaatagtggttttgaaaacagaaattgcctttaatcttgtggaaaacatatgccagccctctccataatagtctcaattacaggagagcatcgtgttactgtaaaaacacaaataaataaacccatgacaatactgtgtttgggagataaaaaccacataaaagccatctttccccaactctccagcatcataattagggtatttctgggaggagaaaaaaaagacaccagcaaaaaacaagtgatactatgtttaagaacacttcttgctattggcaagatgggagtagggagttagattttccatacagcacaaatacaagggttcttcccagctcctaccaggcttgatgctatatagattacactgcatgataaatttgggcactagaggtgccaaagatggtggcagaacctggagggcagaaaatgtcacccagaaggtgatgctgtgaaatttattgctctgccacactttacctaaacatgtcctattattctgaatgctgggtcttcattggctcagggatgcccttggtgcgtccgttgccatgggctacaactttcaactgtattttgtttattgctggtcatttaagtctctatctggtttttttttcttttaacttgagggctccagatttaggttcttttgaggtaagagtaggaatgactttgaaatattgcctacttttgtcagtattagttaacaagcactgagggctgaatgacactgaacagaacccagccatttctcagcacctctgttgccactaccctggtctgagttgccatcatgtttcacctggactgcctcagtagcctcccacctgacctctttgctcctactttgcctccctgcagagtgttcttcactcagcaaccagagtggcccttttaaaatgtactttagatcatatcactcctcagttcaaaatcctccagagtgcctcccatttcactaagaatgcaattcaaagaccttacttaccatggcctacaagacactgcacggtctagtgcctgctatctctcaccccatctcctactatccccttagattaatcctctctgacccttcagcttgcttgctgttcttgaacctggtcaagcatttcccaactcagagtctttgcattattgttctcttagcctggaacatttggtcccagatataaacacatggttcatactctcacttccttcaggcccctgagtgtcaccttgttggggaggtcctgtccacctgtatttctattgctggagcaagcacttaggaagtctttgttggaattgtgaataagcattgcccagagattctagcacatttggaaaaagagagtgtggtttagaaggacagtggctctggagttggagcagttgggcactgctgggtttgcctgccccccattggatagatggctgatgttgggaaaattatttaacctttctaagcctaggtttctctactagttaaatgagattatgtctatctctcagaatcgttgtgaagagtaagtcagataatgactgcaaagtgcttggcaatgagtcttgtacacatactgggaggcttcctaaataccacttctcacaaatcctacttcctgcttgtgaaatcatgttatatggaagaaggggagtgtctgaaaatggtttgaatcttgtgtgtaattctcaagtaccagcaagtagttgtgattatatttaaagcacctagccctgtgcttggcatatggcaggccttaataaatacccaagtcttcctgcttttaatcatcagacttagactctgggtgtgaactaaggtagctctgtgggcacacagggattttggtaaacagaaaaagaagtcagcagctgaggtaggggtggttcacagtcttgcttgtggttcaacagggactgcatttatgaaaatggcaagtgagcccagggcaattggaactttgggccttgccagcaagtgtggtatttcagtttacatcctcagagtaagtacaatttcaccattattccattgaggctctccttgccaagaaaaacccattgtaaatttctggtttaaaggttctgcagttttagggagttgtactttttgttgctttaacattttcttggcaccacacattttaagctgcactggcttaccttgtaaatagtatacacattttgtgaaaagctgaaccacgtcatttgttttcctatgttccttatgggaaatggtgatgcttctgccccactagttcccctgggtttctgatcaggcagtttggagtgagaaaatgagactgagacaaaatatagattgtcagcaagagattggagctgtattcacaaaagcactttgtggacatggtagagccaggcaggagagaaaagtctgtggccggcagggtgtctgtgtgacgtggacccattgtgtgtatgggctcctcccgctgtaccagtggccagctcccagccaggccacccgggcgagggcctctgaagcagagagccctgcacagtctggagccgctctaacccagtgtactgaataggactccaaagaataggagctgtgttccctttgtcacctgcaaccctgctttcagcctgcacagtgaatgtgcacttgggggctgaattggcacttggaaaaatctgcaggaactttgtgtgtgcacagcgtgtgcccagcggtatgggcgaatggagcgtgcacgctggagatgtctgggggctgggtgcttgcagaggagggctgacctctttatgctgcagggtttgccaagaatgctccgcccttgacagtgttgtggccaacagaaaagcattcgtggcatcttaatgaaaggcagcagttccttttttcaagaatgataggcattcttttcttgagcgaggtccccatttagggatggagagagaagccaattatttttcagttaaaatttattttttaaaatagtgatgcctcagttgtaaattaccctggctttgccatgaagacatttacagctagccttctgacttggttttaagttgctgccttgtagaataataaaatagtagcccaaactgtgataaggcatcaaagactttcatatcctatctgtgtagctgatgtgcgttgctccatagctagaaaatggatatattttctgaaagggaatgggtgtatttccctttaccttgcagcttgcacataatcgaacacttcttttattgaaattgggggttttctcccttggacttaataaggagatatagatatctatatatctatatatctatatctccttaagagggagtttcataagttcaaaagttgtcaggttgaaaggattgaggtattggaaacaacaatcttaaagttacctttggaatgatagatctttgaaaaaaacaggtagtttatagtacattggaggaaatgctctgttgttttgcatcttctccaggcctctttatgactactttttttttgagatggagtctcactctgtcgccagactggagtgcagtggcatgatctcagctcactgcaacctccgcctcccaggttcaagtgattctcctgcctcagcctcccaagtagctgagactacaggcacatgccaccatgcccagctaatttttgtatttttagtagagacagggtttcaccatgttggccaggctggtctcgaacccttgacctcgtgatccacctgccttggcctcccaaagtgctgggattacaggtgtgactacttttttaaatgcttcaatgaaacttaacatgatgacctacacatttcagctgcgcatatgttctacctgttaatggtgagatacaacagagccatctttgactacttcacgctgtttactctaagaggcctgtatcattagatgacttcctgttggaagcagtaatttgtgtttggacttgggtgactgtcagtatgaatctagccaagaaaggtcatgtcacctgctacacagtttgctagagggaatacaggccaagccttttgcctctgaaatcaaagtactgtagaaggtgtaatagaaatgatgcctaggtttgtgtattcagggcctgagtttctgattaaagctgttaacaatgggggcaagctttccccgtgggagacaggcttcttggatctaaacctttctgacatctcaaagctttatttcctgatgatttctaaaagggaaggagccagccccttgaaattaaaatatcgacttacattccgttctccccagacggaagaatattagcagattgaatcagttggggttagtactttcttttatgtgttaaactcagttattctggctaagatcagatttttgtctaggacggagctgaaacacatgcggaatcttgttggttgagggctggaaacgaaggttggcttcacacaggttgcttctccaaaccgtaggtaagctcttcggccccgtgcacagcattcacagctgctgtctgctgcgctttcttgctccatcctgtctagtctcagaagtttcatggtactaatatcttggatccttacaaaggactgacttttgacccagttgactgataactatagagtactttacagtttaccaagagctttccttcatgtttgctctttacatcaaaattacaagatgggttttattatccacattctttttgtagatatgagggccagagaggttatgagttagccaaagtctatccagtaattgacagagccaagattctaggctgggacatctgattccaaatctactgctcttcatgctcctttatactgcagctacttacctgctcaaagtatgtcattcactcattcgttcagcaagttcttggtggcatgggctttgaagccagacagctgggtcccagtatctgctcactagctttgtgacctctgttacctcttggaacctcagttctttcatcagcaaaatgaagatagtaatagtacctatctaggaaggctgttgtggagtcctttaaacagtgctctggacatagcaaatactccataaatgtttgccattcttcttcatcatgggctcactcagtggtacagggactccacaccagtgacagcactgctgttgaggatcacttgttctgatgcaaatatgaaaatagaagactgacaattgcatagtaaagggattgctaagatataagcaggatgctggggaagcttgaaggatgaacagctgtgttttcgattgccaagaactcggctctctagcagctcacccttgttgcctctacccctatttggtcacattcctgtcttactcattccttgctgaaggcagtatttaatgtgcaggggttttatgggtactttgtgtataacctctttgaggaggaagagaaggagagtatgtctggctaagggaaccttagtggtcatttgggattataagacctatatttaacagttggaggactgttcaagacaaaatagattccaaggttctggtgtgcagtgttctgtctgagcaccacaggatatcatatgtgagtggcttccagtgggttgctgagggaggggactttgtgggggaagtaggccttgagttggacctgaaagaaatgaggatttggattatgagtagcagaagcgtggagagctgggcagaggtggagttatgatatttaaaccatggcctgccttgggtggcgggacagccctgcccggggatgtgggtggtccaggaggcaggtgctgtcccctcctgcatgagaacctgcctctggaccccaacaggatgcacacagcttatccccaccctctgcaaagctacctaataatatctttgtgtttatggtaatgttttttgctgatttggtgggagataaaacctagagagacccacagcatggatgctaggtctgagtgggtctgtgagctgcaacctagctgcagcccctttgtttgtgagctgtttgcctgcatttaaatgccatttacataaggagctgtcagagttgagttggcccatgattattccttgatgtatgttgaaaaaagagaagaaaagaaaaccctggctaatgaggagctgggttccttttctccattgatgacagcttcctttctgatctgatggtccgtcagaaactaaggtggtgtgtgactgtggggttatgtccccgctgaagccgtcttttcctcagagttgtaattgatggggagacctgtcacttgttatgctgatgctgtgcagatttttgtgcagctgccagccaagagagttgtaggacagcatctgattgggtgcaggttgtggcaaaaatgataataaatagagagctggtgagggtagattttgattgacccgagattgtatattattaaactggagtctgcatgtacatgtcagtttatgaagaaccagacccataatccaactttaggactgtggcagttcgggtttattaaatgtgctttatatcactattaatattgaggagcaaagaggaatatctgtaatcttttaatctatgcaataatggtttggagggagattaccagatacattggactattgtttgtctataattgtattcagaactctccgaagcattgatttgtttctggcatgctgatttggctcagcagtctcataaagctcttttatagtcctctttgctttgtgttttccaaaaataattggagaataataataatgtggctggcgataaagaagagagagtaaggttgaaagcaaatttctagccgagtggatagccataaacatcttctatgctcataaacacctgggtctgtgacctttgtgtttataagatatttatcgcctcatgggctctctgtttgggggttaccacttcagtgccttgtaaaatttgattgtgtttagtaagtagattctgaatttttgctgagtagggaaaaagtgcccctcacctttgttttctttggaacaaccaatctgccaagaggggcagatctcaccaaggacaggagcagagagcttgggtgtgcctgagttttgtggaaatggtacagtgggacccagtaagggtatcttttgtacttgattaagtggcttgtgatggaaatgacttttgaacggaagggaattgtgcaacacatcaaataaactcaagcagtgtcgatgggttttccttttccagtagaaatggaatttttgattcaagtcgaggaagctttcttgggatttggatttttgccacttcctcaccctttcttcccatttccaaaacaggcctgaggaaatgagccagagaaatggtcaaattcagtttcattgactttaatacgaaggtatgactaagtgctgcaaaagcacagttgtcttctatcttcagcagtcctctaaacatttcttggggaagttttaggcactttgtcaacctctattgtcctcctgatggtgttgcttaattactcttgaaggaaacagttggattcctgtgaactgatgacaggtgtatgctgagctgcctgtgtaaactattggctgcctgttcatgttgtgcacagtggatcagaggcatatgggagaatgtgccaaaacgggaatcttaagggagttttttaaaaagtaaaaattgtttgcttttttgctgtggtgcgaacatggctcacttccgccttgacgtgctgagctcaagtgatcttcctgtgtcagcttcccaaatagctgggaccataggcacatgccactgagcctggctaattttagtgtatttttgcagagacagggtcccactatgttgcctaagtgggctcaagtgattctctgtgccttccaaatcattaggaatacaggcctgagccactgggcccagcccccagtaagctttattataactcaactagcttcattataactaaagtatgagccagtcttgaggtgtataggacctatatttatcaaaggagactgttctacctaagacttagtttcttgtcctatgaggttaattgctgctgcatttcatggagtttatgagatgtgcttccctctgcccttcttcaatcagatggtactgcctgggagtcatatacatgcaggactgataaagagcggctcccacagtggcagtacctacagtggactgtgctgtaggtaaagggaagctccatcacactggcatgtgggaactggactaaaaggccacgaatcccccaacacttactctctgcccagctttgtgaaatacaaaataattatgagttccagactccagagatgctttccacctagttggggaaggagaagtttaggtcagtggttctctaagttggtccccagacaaggagcaccctaattctctggggatttgttagaattgcagattttggggcatcgcccagactaacagaattggaaaccatggatggtgttttacaaactctgcaggtgattcagatttatgctaaagtttgacaactcctgctttaggttcatcagttccagggggaataaatgagtaaacaaggcacatagaattaagggcttcctatagggcacagcgaaggagagaataaggtgctttatagcaggatgctaagctggactgtcaatcatgtgggaaaggggtcaaagactggaagagcagggatcatcaaggcagtgtttgctggggagagaagttattgagccaggttttgaggactgaataggagagaaagaggtagagtagcatgaatgagctcagatgtgatagggagggttctgttccttcaagagcttagttaagtgtagtgaaaacacacacacactccggacaagaaaaattaatgtaaaatcaactatagaacttaggcaggtttatgaagaagaaaatatattcctcacaagttggattcctgtgagttcatctcttttattacctctggcaatggtgcaattaattggggccagggctctgcacctggaaaggctttataacgtgagattctcaagaggaagattttatttgcctaaggctactactttaaaagtgagagaggcactcatgaaaattaggggtaactgtaaaaagtgataagctgctcaacatagattcagtgcccagtatgtataaagtgctgtgtgtatactggagagagggaactggaatctaacttggggatgggggtggatccagaggagtagagatatgaagaaatacacatttaagtccagtaagtttttcatgcacctgtagtcctgagaggtgaagccagctggacgtcctgggtcgagtggggacttggagaacttttctgtcaagcaagaggattgtaaatgcaccaatcagcactctgtgtctagctaaaggattgtaaatgcaccaatcggcactctgtaaaatggaccagtcagtgctctgtaaaatggaccaatgagcaggacgtgggcagggacaaataagggaataaaagctggctaccccagccagcggtagcaatgcagcactgatccccttccatactgtggaagctttgttctttctctctttacaataaatcttgctgctgctcactcttagggtctgcaccacctttaagagctgcaacactcaccgcgagggtctgcagcttcattgctgaagtcagggaaaccatgaacccaccgggaaaaacaaacaactccagacgtgccacctttaagagctgtaacattcaccttgacgtccaaggcttcattcttgaagtcagtgagaccaagaacccaccagaaggaaccaactctggacacagtccaagctactccagaggctgaggtgagaggatcgattgagctcaggaggttgaggctgcagtgagctgtgattgcaccactgcactccagcctgggcgatagagtgagacagggtctccaaaaaaaaaaaaaaaaaaaaagtctagtaagtttttgttttcctttaaaggcagaggggagccactgaaggttattgagcagggaagtaacaagattagagttgtaatcatgaatctaattaaaaaatcagtgactggagggaagtagatgggttagaaggctagtctagttttaatactgtgaggcagatgagaagggcttgaactagcagagttctagaaaaatggtgatgtaagcaacaatagagtcatattagttaagggtgagagggaagaaatatttacaattcactgtggaccagccacttatgcctgtcattggtagagcttaaccatcacaattttagcaacacagagattgatttttatagaaggtccaaaggatatgtagcttggagacatattcaagatttgactcatgctgggtgttatggctcacacctgtagtggctcacagctacctggtaggtcaaggtgggaggactgtttgagcccaggaattgggaccagttgggcaacacagcaagatctcatctccaaaagcaaaagatttgattcaagcctgcctgcctgcaaagcctgtaccctttttgctctagattctagactttggcgaatagaatgatacattttgtttataattggacagttgttgatcttggcagaagtgttgactgctgggaggtgttaagagaaaggaaaaagcagcataagatatggaagtttgtttgatgaaactgtatctcaaagagtttaagagttttagcacaggacagatagaatcttgccccacccaagatgatggaagaacaaaacaaagtctgtgctgttttctttgttaaccagagttgagagtggagtccaatccaatatctgcctagtgggagtctcttgagtcctgatcccatgagatcatacatatggctgctactcctgttgtgaggaaggttgcaattttagaaataaacctggagcttttgaaggtcctatttattacttcagcccacttactgccgaggtccccatgttttgcaagtgacaaaaataaatctaaaatggaaaactagggagaaggtgagagaaagtgtccagagaaactggggactttgagttgtttggtctaagctacttatttgcatttttgtctccacttcctagcaagcatattggtacttagcaatggtgggaggaaggcagaactgtaaaaaaaacgaagtcatcattctatccttacacttgagtttcctttcagcaacctctctctcccttgtctttgtcccgtctcataacttaggcgtgatgtgctgctgtatctgccttgctgccttctcctgagtggaagctgcagctacagtgttggttattacacctggcaattagattgtgcaggacagtagttggctaggaatggcataaggttgcatgcctcgttaaatctgaactccactcagcatagactcttgtagaagcaagggggatttgtttaggtaaggagcccttgaaaggagcctgcttgttgaactgtatgttgagcagcagtgatgaaaagatgcctaaacatgtgtcccacagcagctacagtccatcagcattggacacattggtagatcacccctgctgttaacacaggtcttttcagcttactcgtttgtgtacttaactgttgagtgctcttttaattaggggcgactaacatcaaagtactatagttgtgccgggcctgctaatcaacaggtttcacttatactggggatcacttcagctttacaccaccattatcatgacattgatttttctgtgcacataaaaggaagcacttactgaatacaggaaaaaatcatgattgctaggtggaaaaaaaaacaaaaaaccagcaagaggaactcagttacccagggaaaatgtaaacgtttcatatgaacattgacagtgaaatggatttgatgagttttgaggtgattttgttagatactttgagagaaattgagaattctgtattccgaagagacagccggacttgaaactctagaggtatgattttgaccaagacctgaacttctctttgcctcagttttttcatctataaaatagggttagtaataataccaacctcactgagatattgtgaggattttgtgagatattgtgagattgaatgattagcttagtcactggatgtaagtactcaaattatagctattaataagtgtgatacggctgggcacggtggctcacgtctgtaatcccagcactgtgggaggccgaggtgggcgtatcacaaagtcaggagttcgagaccatcctggctaacacggtgaaaccccatctctactaaaaatacaaaaaattagtcgggcatggtggcacctgttgtcccagctactcaggaggctgaggcaggagaatggcgtgaacctgggaggcggagcttgcagtgagccgagatcgcgccaccgcactccagcctgggtgacagcgcgagattctgtctcaaaaaaaaaaaaataagtgtgatacttaatgtcataaatcattgttattatttctgagaactgatatcttgtggtccattgttgtggcagaagtataatttatataggaaccgaaaccagccctcgatttttttttttaatcgccgatcttggttgggcttcactatcattttcatcagcttcacaacccctcagttctgagaaccctccttgccatacaagccactggagtgtctgcgtttcctttctgtggacattgtcacctttcccttcattttggtaaggccatggaaacagagcaatcagataaaagacctgggcatttggcactttcattggccatacttctccttctggcttgagtttatatgtggtttggggtagttactggtgaaattgagctttgcagctgtctacttaatctgcatttcctgatctgctttggctggcaatcaaaagctgtatctatttcggagattgcgcaataagacttttaatgacaagttaaaagacaaagggttggtgggattgaaccttatgcagaaaatacttcactatacttcggtggctcctgtttactggtgattttgtgtggatagtaacttaaaatcaagaaacatttttgctaacatatttcctgggccattttagaaagaaatttctttatttagccagtaagtagagctttctttagcgtttacatagttatctttttaatattaatttttgcaatccatatgaatgaggccacatgtcctttaacaattttagacctcttctgttatgcattactgccatctgtcagtatgagagaaagcttcctggggcagaaggacttaaaacaatggttctcaaccctggggtcacattagaatcactggcagagcttttaagaaattttagtgcctgggccagttccagatacatagttgctctgggatggggcccaggcattgatgtttttaaaaaactccctaggtgattctagggtataactgggctgagaggctctcctccgaaagcactgtcttaatggaagaaccagtggcatgagaacagttctgctttttctcagcagtaaccttgttgtcttccattgcagtgctgattttgacaatggagccatgcggttgtatttgggtagcggtttggagggtaacaagtgtgtcttttgtatctctgaatcctctgcagccagtctagtgcctggcatatactagatgctcactatcctccacttcacttcttttggatgactaaataatggaatggagcccagatgtactagcctttttacttaatccctgagcctttctccttcagtggtccgtaagggagcaggtccacaagcatacacttttattgttccaggaggaggaagacgcccagcttcggaatgcttgaggcataaaactgatccttggttaagatcagcagaggcttgctgtgtgcaacataaattgtcaggtaaagaagcaattaacgtagtgccatttatttcctctttaagcatctagtccttatgagtgttgtggttctgcactccaactggaaacaggttctctattgccctgttttgctcttaaacacagacacctttttcagtcaagagaattagggccttttaaaaactcttctttctttcttttcctttttaggtagcccatattgaatcaggtcctgcagctatagttattcatgcagggagaattctatgaacacaggggagaatggcctgggagtttgataatttgttattttttggtttgtagattgagaagtatattaagtaaggataaccccttatagttagttagttattttatagttttcctgtccagaaggttttaatctctcacacggctgtggactggcaaagtaactaattattgtctccagtttatggataaaaaaatttaagatgcggcaaggttaagtgacctgcctaaggtgatagacctgggccttgaatccacagcttttgactgtaaatcccttcagtacactgagctttggatagtacttttgcttggattagaacaccctataaatgtgactaatggcatctcagggttctgtcctggctgtcatagttgaatcctttatttgcattgcatgtgcttgcttgtgtgtgtgcgtgtgcaactattaatattaagcatcttgccatttgcctctgtagagcacagttgatagacgggaatatacacttgatgtagtcaagagagtgtcatcttttattaagaattctgatcttgcctctccaaaatgcctactttcacttttagtctattgtaagtgtgaatatttgtgtgtggtattttattcctaggcaaggtgtttttctcagtctatgttgtgtgtctaggatgataatgttaaagcttaatatatttagttttggaagactacatttttctggggtggtttatgagttgttttccttcctccaacaaattattgagtgtctagtatgtgttctatgctgtctacctttacttccatctcaaggaagtctaggataaaaataacattgtttatctgtgaagggataaagagtcaacacccatttcatgtcagctctgtctttattaggcatttggctattgagctttctaatttcttgacttttgggagtgtttctcccagttaccagacaggtccagggtgggaaatgctttccttgggccccagaactagctcatggagaggtggttgtagcttctgggaattttgaaaagagccacacccaggaatctgcttggactatgtgttctttctgtcctgcctttactctcctcttttctccctcttataagcaaagcgtctttttgcttccttgcccccaatcccagagagactgttaacttatgtttgcatgtaaggagaacagtcagagttaaggatctcaaactcaggaaagtggtttttgtactcaagagctccctgtgtgtttgcgcagcacacttacctccatccaggatgcacttatcctgcgtagatggattgtaaccgtgatagagggggaaaaagaagaggggaaaaaaaaacccctaaaaaaaccctggattctgaagatggctgcagtatattcttcaatagaaatttgaagcatgaagtggattttagaacaccacatgaagctcttcttacttaaaacacaagaacttaaaacttggccaggggaaaggtgtagggaggtggagaaaagcactccttccatttaaggggaagtaagcacttgacttcatcaattgtggttaagataaacaaagcttatctttttggttggcatcagaaggggcatttaaagtctcatgaaatgagagaagggttgttctgttccttatttactgtacttgaacggagtcactgaaaaccttgatgggatgtctctatgactgctcattcctagttgtctgcagcactgtggccagtgaatatgctggttcccacagaggaaggcccacagcatggtttccttcctcttcttttaattttgcctcgtgtcttttgtagacgagagtgctctgcagtaattcttttgtagaaactgccatgcctcaaatcacattacataatacaggctggggaccagcattccgtgaggacttgatcaatgggttgggaaacaaggttgatagcattgctgtggaggagatgtcaatgcgaatttgtcagctcacctcacatccttgcttgcagaactttgattttatttaggtgttcacttccatgtggacttgagttcaggggggtacatcttgattagtctattccagtcattatatttctactccttgtcagtgatgggcttaggaaggtccaggtctggctggctggacatgaggggaaatcttgtgtgggcacttctagaaaacgtttccttgattttgatgaagagaagtataatttctatctggttgttgtctgcatgtggtgctttgaaattggcagttgccatctttgaaccgtgagccagcgtaagaggacaggcccacatgcaggggacagcaaagctgtacaaaagatagatactatctttgatgatattgtggagctgttgaattgatcagcctgagtccattccattttgggacttcttgttatgtgtgagaaagaaaaatcacgttttaactattttggctggattttctgtttccttcagtctagtgtattataactgataactatcttaccccattcatacaggatggtttgagataaaattagaaaatattggaaatgcttttacacaagtatgacacacacaattaacatagacattaacataaatattatattgtaatgtccagtgttctcatactttgcttccatatcacttctgctagcattttctccaaagcaaggggacaggccatgaggatgaaaaacagccatttaaaaactgtcttgggggttttcagtattctttctgtaagaattgacatgatacataactcctaaaacatagtataaggcaaaaattattctttcctgatgaacttgtatttcttcttattggaaagtggcaaataaaataatccagtataggaggcatcatgctacctgacttcaaactatactacaaggctacagtaaccaaaacagcatggtagtggtaccaaaacatacatatagatcaatggaacagaatagagacctcagaaataggaccacacatctaaaaccagctgatcttggacaaacttggccaaaacaagcaatggggaaaggattccctatttaataaatggtgctgggaaaactggctagccataggcagaaaactgaaactgaaccctttccttacactttatataaaaattaactcaagatggattaaagacttaaatataaaaccccaaaccataaaaaaccttgaagaaaacctaggcagtaccattcaggacataggcatggggcaaagattttaccatgaaatccccaaaagcaattgcaacaaaagctaaaatggacaaatgggatctaattaaactaaagagcttctgcacaacaaaagaaactatcatcagagtgaacaggcaaccaacagaatgggagaaatttttgcaatccatctgacaaaggtctaatgtccagaatttacaaggaacttaaacaaatttacaagaaaaaaacaccaccaccaaaaagtgggcagagggtatgaacagacacttctcaaaagaagacatttatgcggccaaaaaacatatgaaaaaaagcccaacatcactgatcattagagaaatgcaaatcaaaaccacaatgagatgtcatctcatgccaagtcagaatggccattattaaaaagtcaagaaacaacagatgctggagaggctgtggcgaaataggaacgcttttacactgttggtgggaatgtaaattagttcaaccattgtggaagacagtgtggcgattcctcaaggatctagaaccagaaatgccatttgacccagcaatctcattactgggtatatacctaaaggatcataaatcattctactataaagacacatgcacacatatgtttattgcaacactattcacgatagcaaagacagggaactaacccagatgcccatcagtgatagactggataaagaaatgtggtacatatacaccatggaatactgtgcagccacaaaaaggaatgagattatgtcctttacagggacatggatgaagctggaagccatcatcctcagcaaactaacacgggaacagaaaaccaaacagcgcatgttctcactcataagtgggagctggataaggagaaagcacagacacaaggagggtaataacacataccaggagcagtgtgggaggaggcaaggggaaggagagcgtcagaacaaatagctaatgcatgcagggcttaaaacctagatgatgggttgataggtgcagcaaaccaccatggcacacgtatacctatgattacataggtatacctgtacattctgcacatgtatcctggaactttaagttaaaaaataagtaaatacataaatacataaaaattcagtatgttttcttgttgtcttatttcaccaatgagctcagatccaactttaatggttaataacactttgtctaaaattcctaatatatcttctaatattttctagttggttttatttattttagttattttaacaacagtgagtgatctgtatcacatcctcctggaagtaccttggatttcattataactgaggaagcgtttgttatttgtttaaatgagtgtcccagatagcttgcaatggagcatatttatttgtttactctcttatccattcactacacatttattgagctcgtactaaaaattagccagacacttaaatcgttttctttggcttgattgtagagctcataaacaaaagtactaggaatttagaattgtagatcacagagcattagaataggggaaagtcatttttcattgttgagcctgaggagagtttcgaaggtgacttgaaggtattgatttgaggaatgccgatggttttcatcttcttttcccatcactaaactaagtatactcccttcagaggtagagagccaggagacctttatagtagtgaaaggacaggaaaggaaggctttcatagacagcctggtactggagtcagtattcaacagtgaaattctggggtatagaaaatagttaatttatatactttaattcccacctgatccccactccccaagaaggttggaatccttgtttttcctccttttggaatttgctactttgaagggtttttttcttttgaaggaataagaacagtctgttcattgtgctatttagtgcaattagaattagggagcaatatttgttctgtgagttatctaccctgacagaagctctgatagaagctcagaatagttaactgccctcatagaggcttggggcatcattgctggaaatgagatgcctaactccaggacttcatcctgtggactgcagaattaaacggaaccaaagaaaataagcaacaaaaaacagttggaacagcttctcagtggacttactgctgccagtcttggtggggaagcaccagtgcttcttggactctggctactttgatcttcccagggtgctggagaacctggaaggacccaggttgtctctcctatgtccactgtaagccttggtaagaagcatgaaccttctgtaagccaggacccaactgaccttttaagatttttttttttttttaatcatctgaacatgctatgccgttgtcttggcattgctttgatcccagatgtctcagttttaaagagcacctacactaagtggcaaggagaaattagaattatccatattgatgatgaaaaataaacctcagagggcttccaattgcaccctaattcttctcccttaggatattgagagagtgaggtgtagaatttaaagttaaaaaattttacatcactttacttaataattgaaagttacttggctttggcccttggcatgatttaaatcacaatggatttgagagatgctttgtcattgacttaattttcagggttttaactcattcagtaagttggcttggcagccctaagcagcattagtattttgtgtgacattttcaaaatatcctttgaacctatggtaatccctaaggcagccatgttctaaaactcagagaaggacctccccaggggcttgaaatacctgtgtttcctcccctcaccgacaaccccctaccctgctccccatagcaatgttttgaggttgtgtgatctggatctgggttgaactcctgcagcgttttaaaccttttgtttctttcttctttaataacaacagtgtttcttaccctggtcatctattgagaagtgtaggtgaaagtaagcatcaacagaatggtgattttgaatatgggaatgggttcttgggagccactgatgtacctatagggactggggatatgattggtagttctagaatgacgttgcagttgctctatacatgacccatcacgtggaagatcctgacctcagcagcacacagcaagcatgtaatagctgcagagaataatgctgagcactagtcaactggtaagcattacagactcccctgcttctctctcccatgggtcaactggtgttgaataacagggagactagtactttggacatttttacctactgaagttgactcatgctgttcctttagaaggctaataaatttttggtgattaactgaataaattaacaacaggctaagagaataattacagacctatttaggaaatctagttcttggttttgcttggagattcttgccagaactttaccttgtaagttagatatttttacctgttgcttctcagaaaaacctacaagcatactcttaggtttataccttctatccctaacaacaacaaaaacattaactgtaaactgcctcctgttatctgagggtaaagtcgtaaaaatcaaagaggaattttgaggagaaagtcttggtaacagaaaatactaattagttgtctgtgttgtgagatgtgttgcttgagagtgtctgagcttcagagaatgtataatttccctccttgatgtccacaaggagcttctaggatactttattaaaagacgagtaatcagttattattcttcgtaggtatatctcaaactgcagctttaaacagaatcaactagagggctttgttacaatacagattgctggactccactcctggtggtatggtaggtctggaaaagggcctgagaattaaaatttttaggtcctccagtgatgtctaggttaccggtccgggaaccacccattaagaatcactgttgtatctggtcctctgcctctttctgcacatcttatatccatgcagcaggtatgaaaatgagctccccaaaagcattcaccttcactgttgacctgattattatataattataattggatctcaaccttttaaaaggccaatcgtatctgaactacatattaattataaatcttagtgaaagctctattatattatctcaatttttttttcttttgagatggagtctcactctgttgcccaggctggaatgcactggtgtgatcttggctcactgcaacctcgtctcctgggttcaagcgattctcatgccttagcctcctgagtagctgggattatagatgtccaccaccacgcccagctaatttttgtacttttattagagtcggggtttcgccatattggccaggctggtttcaaactcctaacctcaggtgatccgcctgccttggcctcccaaagtgctgggattacaggtgtaagccactgcgcccggcaattatcctgatatttgatcctgaaaaatcttgcttgaacttgaaacttgtcctagaatgtctttgaaaagttcatattccgataagtgtattacattctacaacaattatgctaaaaggttacttcacagaaaattatatccacactcatgatagaatcatttggaagtttaaaaaatatggtcatggttggactccatccaagactgattgaatatgaccctctgggattgggcaccaagtaatatacaattttgaaaaatttccaagggattttaatgggcagctaggtcatgaaccactgcgataggccttggagagggaggggagcagcagggctctggtaagtcctttacacttgctttaacctgctgctctttccccttcccactgttaaactcccctgcacctctacgtcactcttctttacaggctggctagcgtcatcacattgtaggtcgttttctgtgggcttaggaaaacagtccaacagactgttaccctagtgcgtgcaatgaaaggcctttattcttagggttcaaattattttacaacgaaattgtttagtttggagcctagccagtttcatctcttctatactccaggttgatcttctgttttagatggtgttcctcactctgccttcttcacctgaataaaggaaaggcaggcaatgtttccagagctcctgagccacccttagtgctggaggcaggtttaggaaagagctggctccctcattgctaaacagaattaatgttgttcaatcactttattctggctctgtgaaataatacacaggaggaattgctgctttatgactttaatctgataaactacctgctctggtgtgttacattctgtgtgtgtttctctgccaccactgcagaataatctcagccttatgtgtagcaactagaatgcaaggttcaaaactcaaaccaagccttgatgcagacgtcaaataagaactactttagaatgctctgtgataatgctaggcacttagcatgactgctggggctcctaaaaggagccaggaagcagcagagcctgagaatcctataacatttccttttgagcttgggcctgaagcagccaaatgctgtaaccaaataaaagccagtttaccttttgcttttcttatgtcttcttttcttgttctcgtcttataaattatgttcacacttttccttttttcttttccattcatgcctttcctccgttttctctgtactccatgcatctgccgcctgtctgcttgcttggtttttcttctgtgttctctcagcttttcacttttggaagagtcaggaatcttgtatattttgagaattagcgaaacatcgtgggtatttatccaaagtggaccttgtacagtctcttttatgctcgtttttaatctcaccaatttctagaatctcactaatttctaggtttgttaagggacaacatggtgtattgctggagatcaagacacaaagagtaacagagcctcagagctcattaatggtggtctgaaacaaggaaaggagaattaaaataatgtccttaacccaggacataagagatacagatagagagatggcaaaatccatggcatatctgtgacggttttctttttttgtagaaaatatcataaatagatcttagaactctgatcttctgatttttcttaacacagtactctagggagaggccactagacaagatgaatcccatcactgttagtgggagcttagagggaattttaggtgagggaaaatacggagataaatgccatcttttgagataggtcttttgattcagtgttgaagatttgtgtcaagagactcccaaaccataatagatattgcaggccttccctttactgcctgttaacccaggcatgtgacaagagcaagatttctagagattgccatagaggaagaataatttcagtgactttgggaaagcctgaagactgatttagggtgaaaggcacatgtcattaaagagtttcattatagattgctggttttattaggaggtaagtggttggagacattcgtttcctggaatcatgtaggacatttaaagtgttgaatgctatatacaacaccccagaggtgaagaagatgtttatcaatttaggtgcacagatgtcagtctgattattgggaagagggtgaagaggtttgacagtatcagagtatggacacatttgagcagcagcagctcattgtcctagaacgaattgcctcctggccgtgatttattgacatagctgatggagggactcagcagaagccaccatttatctgtttcttcagttgaccattggaaagccttacaaaattatgtgcgtgagaaatgtcaaagtgacagatttgggttcaaaagattgtacacttttatacatccaccctttgcccttctttttggacttgagtattttagacaaaactaacattttcttcagcttagtataaacagatttctgctcagattagctgagaaggcatacaccatgttatccttttatggatgagtgatacatgtgatgtctttgtcaaataggaattgccctctgccttgtgtgtttggagagatgactggccacacctctgaagcaatcagctgtggccaaattaacataatatggtacctgtacataaaactaaatatagaacaattttatctttttgtagtaaggatactatattccgaagaattcatgtaagttgaattatttaaagtggatttagggacattcattgtaaagttaatctttggtaaatccttgtgtggtgattttttttctctcctcttttgcatccccatttgaaagcccacaatttaatctatttgggtaaggtagattcttatgtgattaaatcactccagtttatacgcattgaggagtaaagtcaccagactaaactcctcaggaacaatgacagagagttttgccatgggtgtttgggaaaactgcatttactttctgcacacttaaactctgtttcagtccacatatttgcacgcctaaaaaaattaacaaattttcacagtaacaatgatactagcgtttacttattgctcaaaagaggtattgaccgctatagtgtgtgtgaagttggaaactttaggatgatagccatagtttgtacttcgagctcactctagtgggggaaatagacaagaaaacccataattagtacacagtaaatgttaggtatatttctcatgtgaatgtgtgcagtatggtaactgctcgttagaggggaccctatagaattgattacctataagagaccttgactgcgcttgggatagttaaggaaggcttcatgaaatagcgacaaatcagggttagctcctggcctgggatgatggctaaaaggactaaagggcgagtctttgcctcagtttcttatttgaaaatgaggataataataatccaactttatagagattattatgaggattctgtgaaacaaatgcacatagatagttaggcagtcctggtaattgggaagacatcaataatgatgtaagttatccatgtccctagtcctttatttcttacaacaacaatcctttcaagacagtagtactttccctattttgaagatgctcagagaggttaatttgcccaaggttacccagctagaacttggtagggttcagctttgaatctagacgtctctctcctggttaccttttgttctctttatgctactcagggggcccaaaatgattccagctgcttcctgcttcattatccccctaagtgccccactgagaggagtctacaattgcctgcccctcctctccctgcctcctggtcttgccatgagtcactgctgagccatttgtgtcagagaggaaaatgggggcttgctattcacatgtagcaatttgctatgtgttcttgcttatttgccagggacaccagcagagaagcgttcatcaagaggcgtcatgtttgttaagggaccacatggtgtattttaaaagctcttaactctctctggtatcatcgattatgctttagcataagaaataaagtgacactgagcctcttattaataatacacgttttccatttaactttgactggttaaatctggcataaaatgcagacttgcaaaccagcctccctgggatgtgtagcttctcttaggctatttatgatgcggatctctgttgagcagcagcctctgcctgcagctaaggctctggactagatgttctcttttccttttctctcttgatggcatggattgttttgtttcacaaggctcatgttctagatgggattgtagctggtctactacaagctggtctagttgggattgtagattggtatggataaatactgaaatgggagctggtatctgacaactggaggggttatatatgtgcccccatattctgatcaagctttggcattttgtgcatttggcaaaagtcagtggtcaatatttgaagtttgcatgaagttagaagaattttgggctctgaatatgagatgacttagagataatatgtttattttacagataaagaatcaggcctaaagcgattgatgatgatgatgatgatgatagcagaatctctaacaatggttaagccagacactgttcagagtgatttttgtgttaacttgcttgatcttcacaatgactctgtcaggtagacagtattattatccctgttttacaagtgaggaaactgaggcacagagagtttcagtcatttgcccaagccacatagctggcaggtgatagagctggggtttgtacccaggctatctggatccatcaaaacctttgctatctgtgtatcactacactgtagcttgtccagagttacaaagctgggcaggaatagtccaggacccaaatcccagtcttttgttggctgaactatatttgttatttaaagattcttttagcagtggaactcttctttaaatggagatattactagatagcacaaccaaataaaaaaagtggaaacttagctgctgtggtttaagtgggataggccaggcattgaccatgcattccctttattcagcccttgctgtggcttctgagaaagccacatggagcatagttttattttatttattttaatttttagtccctacaacaagactcacagtagggatatgattttaaaccctggctctagttagggatatgagctccagattgctctcttttgggtcacaattaaaatcctaaccggcaacagatatttttggtcagatctggtcattctctctgcctccgtacccattgggggcaaactatgaagcttttgtagctgcattattgtagatttgcaggatttctgttcgtaatcagaatcgggtatgtgttagaaaaaggccttcctgagtgtatgaacccctttgcctgctgacagtctctgggctggagttaacattaacatctgcatgcccagaggacagtgaattgctaacttttcactggctttctttttgcttggacattttacagtgctccagggtcatcattctgggcagtacttaccttgtaagtacctgattttggctcttttctcactcactagtctgtgatctagtcttctctctgtgtctgcagagttcagtcccatttctggagcaaagcagtagctcagtaaatgtcagtggagttttttgaatcactttttattattccagattataggcatatatgtatagatcaagtaggctgaatatgacttaatccccaagtttcttctataataggaccttattttatctctccaagtaatggaataaagggatggaagctggtctagttggggttgtagatttataaacaagacattaatctgaagcttatattcttttagagagttacaagaaaacccaagatctccccccatccccaattaaacactttgttctttgtaaggatagtagagtagtaggagtgggggtattcaggaaagcaggtcttaaggcagaagaatcacatcaacatcccaagttctattcctcactgcctcacgaatggtctgctagccacctgcagttgttgttgttgttgttgtcgtgttttgtaggtaaaggaaatatggcaggagagtgaagtataagaggtccaggagcttggtggaggtggaggagaggggggatggggaaagataaagaggcagataagaaacaggaatcattgtagaccagtggttttcagagtgtggtccctggaccaacagcttcagtgtcagctgggaacttattagaaaggcaaatttgctggtttcactctagacccagtgagtcaggaactctgatgggggtgggcagcgtctttgaaaacctttacttcactaactttttccccctctatcttaaatattcccaattgttttaggttttagttgattcccatattatacttcaattgtgtgtcagtgagtaggtctgtattaaaggagaactgttgaggaaacataaagaaatctctttgtattccaaaaagcgtttctcagagttaaattacatgttttgttagtgtctgttgcttttgttcagattaagctctgaaacaaaattaagattctcgtcaaggcttgagcttattaatagctgtttcatttgtttagcgctaatttaaaatgtctgatatctgtagaggaagtgctttataaaaacacatacttgttaagtgttccactaggagaagcactgtgaagtccaaaggatgtggagattaggcaaataactgtggttttgttgagctctcttcagtgtaatatatgtgtgggtgggataagaacactgggcttcacaggtcgaagaggcttccactggtcagatttcagacaatttgtgcattcaagagaattactgcaactgagtgtaaaacactgaacaaataaaaattcttgaactcatagtgatgagagatggggtgggaggagagaaagagacagacagacactctgggcatcattggaggtgactatgatgtcaacttctcattctataaattgtaaattacatgaaacaaacaccctgtctttactgagaaactgtagttctttcatgattggtaagagaaacctctgctttacaaatggatgctaccaaataaaatatagaaggatacagaatatcagcatttgcatcctgcagtgaaaatttgaacaggcaagtgccgtcaatgcaaaactagttgaaagcatgttggggaacagaataatcttattagagaataacccacaaattaccagcaaaggggaaagtatacccttaacaatggcggtcaccaccttaacaaagtggttcaacttagcatcacagtggtaggatagcctgacagtaggagcttcctgatgtgacgaactacacagcatcaccaacaatttatgccaaaaatgtttaacctgaatctaaccaggtgtattaggctgttcttgcatggctatagagaaatgactgacactgagtaatttataaggaaaagaagtttaattggctcatggttttgcaggctttgcaggaagcatggtgctggcatctgctcagcttctagaaggaggagaggggttggcacatcacatgacgaaagcaggagcaagcaagagagagtgtgggggaggtgccacatacttttaaatgaccagatctttcaagaactcactatcacaaagacagcaccaagccatgaaggatccactctcatgatccaaacacctcccaccaccagcattggggattacaattcaacatcaggtttgggcagggacagatatccaaactataacacaaggtttacagaaaatagaagggtttgaaaaacaaattaatccacaccaggaagaaacagaccaaaaatgtgggtcattctcaagaaaactggtatgtctgatcttttcaaaaagccagtgtcgtgaaacaaattgctggtgggtattactccggattacaagagactaagggaacataacagtcaaattcagtgtacaaatcttgatgggatctggcttaaaaattataactgctgtaaaagatgtttgaggcagttgtagaaatttgaatatggactggctatcagataacattaggaacttaatgtcttaggtgtgatagtattttggttgtgttaggaaaatatctttattcttaggagttgcttattaagtatttcatgaaagtatcatatctgcaattcactttcacatggttccatgagagagacgagtgcatagataaggtgattttggcaaagttttaacaattttgaatctaaatagtaggcatatgggtgtttgttttatatttatatttatattcagcatagagaaagctgtgaattcaggaaaagtttatatgtaatttctgagatttctagctcatgcatgcatttctgtttgagaatgccttatctagaattttttatcaagaaatctgaatggtgtttaagaatatcttatctagaaatatgttggcatcttaatattatggtttggtagataaaatggatttttttaaaaaaagacttgcaaagaagtggatgaaatgctaatataagaaaattagattttataaggaacatgtgaccagataaacttgtcctaattattgtgagtctctttaaagcacataccttaggacattgtgtgttgacgcttttactgttcataacatattctttaagaattctctcagagccttaagatgatttgtttttgagaaacatctgaagtctcctgtagcttattctgatgttatgaagtaagtgactaaattttgatcacagaagtgtgtgacagggaagtagtgggatattctttgcccctctttgtgtcctgtgatgctggtggaaatttcaaaggaagagtttcaaaagtagtttactttgttcaaactctctagccctaaaccatcagtgacaccagtgagtgtttcttattttacctatttgggtgtgttagatgtattttcactgggactattcttttggtcagagagcctaaagttaagtgtttgagcttctggtcctgtgatctcagcaactggacttgattcaggtgctttgactcaagggcacagtggtagcatcaccaaaaatagatgaatggcagcagatccctaatggctggctctctgctggttgcccgtctcagctcaggacttccgagaggtataaaacctcactgatagccaggcataatggctagggtttactcagagatgctgggggcttgagtgtagtattgctctgttgtaggctgataatggagtatgtgccaggtgggggcaggatggtatccaggcagtgtgggcaaagggctgcagttagtcccttgttacactcagtgacaggtgactctgagctgtctggaagtaagataaagtgattcaaggataggatccatacctgaaagagaggtattcagaatagcatttgaagtcaggtagacttcagctcttccaatggacctgcaagaggtggtcaggaaatatctcatagatgaattaaagaagtgttacatgaaaatgtaaaggggcaaaccaaataaaatgggttcattaggtcccaggactagtggaggggcattcatgttggaatggagagtagtgagaattggggaggggttgcataggggcttgttcttagggcagagtttttcaacaacaggtatatataagaggtcaaaatttaggaagtctgttagagaagattataaactccatgaggacaggagacatgtctgcattgttcaacactggatacttgatataatgcctggaaaatagtagatgtgcagtataaatttccgttgaatgagtaaaaatgttaagtggcgaataaaggaatgcatggggatgatacagacaaagcagtaatctgtggtggttgatggctgacctggttgtagagtaccagggggaatgtgaatattttagatttcctcagaggctagtttctgagatgttttgtttaccagtgtggtaaccttctcatggccctagctcaaatggtaatcaactagtctttgcagcacaactgtgaggtaaacatgctgtgtccattttagagaagaggaaactgagattcagagagatgaaggaatttgcatgaaggtccacaactaagaagataagatgtgaaactagatatttcagctcttgaatacaatcttctttttacttgagcgctcaatgctggggacagttctgcttttcaagtggcctgataaatagtatctttgtatcatgtgagagttattaagactgtgatagaaataaataaggaaaaattcacataccagccaatcctcgttactctgcttattcccctattcatcatttggctgattgaatactgaagatgataaagctgaatcggtagagcaatgtgtgattaaaaaaaaatctgctattccacttaatgggctacagttattagaaagaaatagaaaccccagttaatgttagtatgggctacttatttaggaaaggagatttttaaatgaaataagcctttcctttttattatattgctggagacagttttcatttttgcccacctggtacttaaatggttattgctataaggaaaccagtcttactgataaccgaatgaaataaattaaacagacacatgcaaacaaatccaaaatgtgcctgagaaagatgtggtcttctagctttcagtcattcagtgagacatttggcagagatgggtgcagcagataaaactgtcatggttttcagaagtcattccaagacaccagagaggaaacatgacagacactggaaagagaccctctttcagatatgagtaatatatattttatactcatattaatatttcattggagagaaggtcaaaatctacatttaaatggaaatatttaaaaagcagaagcataatatttgactaagtgaaacactcagggtttttcaagaacacaagctgcacccctgggacctcagctctctagatctgttgtttcttagagcacggtagaatgtttgaattcctttagttttatcggtagatcttagccctggcatttaggaatcttaatccctctactccccttccatttgaccccgaattgtgttacatactacctaacagtgtgttcagtgcacagtatggcctctctcagtcctataaaattatttaaatttctaaaaattcatttttctggtcctgtgaaatggacataataggattgtggagatggacataaataagatgctttcaattatgagtaatggaaaacccatctaacaaagtatggtggcaagaagatgggaataggaggcccagggtttattcagaggctgtgttcatccttcgtttccctctgctattcaaagtgtgttagaattcaccttcaggcttctgacctcatgattataagatggctgccattgtttcagaataatttcttcatggcatctaaaacaagaagatgggatgccaggagcaaaagaatcttcctggtacctttttcctcctttttatcagagaagatgatttttcctcaaagcctacagaagacttgcctttatgtctcattgaccagacttgggtcacattaccactccgttatccctgccctcaaactggcaaagagaatcaagaagaccttgattggcgtagatcactcatgcttgatttcctgaggctcgtctcattgcctctctcagaaacttggggctctatttttattagctaagaagggcaatggttattgtctgccacagtgatgctcttgtgtgaagtaaaggtgcataaaatgcatgtcttccctggactttagtgcatccttggtttgtaagtgactacgattacatgaatcagaaataaatcaggaaaaggaaagttggtaattttggcctattcctgcagaaatcatagcagggaggggagtgtttgtgaacgaagggagggtccagttctctaaagctgtgctggtgaactaccactgcatagggtggccctctgctgaccctagagcaagctggaggtgagacgagtttgtcaggacatcccagattctttcttctgtactctttcctcttctctgttttccaccaatccaatcaaaggcagtgctgatgtagtcagcacaactcctgggatgcaggtgcctggggctgcaattctgttctgacactgactgtggacattctggttctgggcagccacttgaggtaacaataatgatacacagttcctgcttttaagaggttcatgatgaggagcttcactgctcccctgttgctttatgacaggatgaggattcagactaaatgaccacttccctcttttctcactctcaagttttatgatttctttcaagtttatttgggattttttttttttggtctgtgccttttgttaatatattctacatgcattttgcttctaggcatattgatattcacaaagtttaccactgacagttgtagtctgagagtgtacagaaaaaaacgtagttgaccactctatgattattctggactctgtgactctcttaatgcaagccaagaccacattagcctttttggcagtcttattactttgtggcttttgttgggtttgcagtcatccagaatttctaagaacaatatttggaaggtggctttgcagagacttgagccactgaacttctcttgtcatgtgcttcctttacttcactcctttctttaatatatgcctggcattgggcccagaatccataatacgatattcataataaataccaacatcttttgagcactccctatgtgtcgggtgttacactaagtgctttacaggtattgtttcatttaatccccacagcaactttcttcccctttttctggagacagagtctccctctgtcgcccaggctggagtgcagtggcacaatcttggctcactacaatctccacctcttgggttcaagtaattctcatgcctcagccttctgagtagctgggattacaggtgtgtgccaccatgtccagctaatttttgtgtttttagtagagacagggtttcaccatgttggccaggctggtctcaaactcctggcctcaagtgatccgcctgccttggcctccaaagtgctgggattacaggcatgagccaccacacccggcccccacatcagctttctaatctaggtgttaataattcccattttacagatgagaaaacaatatggagcaagctaagtcatttgagcaaagttatatagtagcaggtggttgaggcaggactagaatctaggcaatctagtagcacagcccaggctcttaaccttgaaatgcaccttaaggcattttataaatttgtcttactttccttaatttttcccctctcccctaccccccagtacatgcataattgctttaaatattattacttgtcctgtctttcaagctggcttaatagaacatacgacgtagagatcaaaagttacagagtactaaagccgtagaataagagtttctttattcattaattcatcctttaattcctgattgactcagttcctgaggtattacactgagcgtgtggatagagagaggaaaaagacctagcattctgcctttgaggagttcacaaagtcatatggtaaatggtgggcctgagattcttgtcccgcagcaaattctgtcattctttgtagatcatggggaaaactttgcattttgctctaagtgtgctgagttcagagtgtaacatctactttgctccgccatagcctttaaaacaggattcatctctgagcctcagcaccagtacatctctgggaatctacctggccttcttcattatgtcctgcttccctgacctacatttttttcctttttcagattgatttgttgttcaaaaggccggtgcccctggaatgaggacctacaagcttacttttatactagaaaataaaagactagaagaatcaagcctttgctcagatcatactttgtgaggtgggcaagagtagaaagccgaacacttgaacgtgagagcgaggagggagccacagatgaaggttgaggacagagaaagggaagctggagggctctaaacttgcagaggcctgacctggcacttcatctgtcgcctctgaaaacagctctgctcttgctcttgctctattctcatccaagtactaggcgatcctccttttatcacttcccagtttcttcctttagtttcctctaaggtcattcctcctttgcactggatttactttggagtaacagttgttggtgggaggttctgattctgcagagagagaaactgaggcatgggatagagaacagccatctgtactttgtcctgtaagtcattagagactggcagagccttgtcatagatcccgtggtttgctgtaagccacaggtggccctcataccctcataggaatagggaccttcttccttccttaacatgattggattttgtttttacctgaaaatacgagctacttctaacagaaggaaagacgattgcagcctgtactgcattgcccctatctgtaaccccattaagaggttgtaaatagtactataatgatatctcagtcatttgttttgatgtatccaggcttttaataaatcagccgcagcttgcttaataggaatatgagagcagagcacgttgctgccagcagctgctagtaaattataaagcattcatctgttttacaagggaattaaatgtttgttctctttaaagggttttgactaaacaagggtgtgtgcgtgtgtgtttgtgtgtgtgtgcacacacacagtggcttcctgcccatgccctcccaggtacagtagcaacctcaggttcctggggaacacctgtaaccaaagccatatgaattagagtgcccccaggtaaaccctgtcattattggtctctgctctgcgtgcatctctaaagcaatatttgttggattacatttgtcttccacgtcaaaggattctgtgaaatacaagtcccatttcccgctttctcctttttttcttaagactgtctagggaaggagctttagataaactatacatccagcacaacattcaattgtctgcacaattgagttagcctactttatttgacttttatgtttacatttgaagtggactccccccgccccccgccaccaccttttcgacacccttggttttattgactaaataatcttcagaagacaagacatcagagttggtgcttttggtggaaattaaaccacagcaggtgtttcaagaccagctttggcaacactgcaagaccctgattctacaaaaataaaaaaaattagccagttgtggtggcgtgcgcctgtagtcccagctactggggaagctgaggcaagagcatcccctgagttcaggagtttgaggctgcagtgagctatgatcatatgactgcaccccagcctgggtgaaagagcaagattgtccaaaacaaaacaacaagacgtggggtccagctaaccaatattcaagagctgttggctacttatcttgtgaccttcaacaagttatataggtttttaaaatctattactttattttttgttacttttaaatttggaaataattgcagatttataggaggttgccaaaataatatagagagatccagggtgaccttcacctagtacaatatatgtgtatagctctatgtcgttctttgacatgtgtacattatgtaaccatcactgcagtaaaagcacagaactgtttcatcatcacgaagatctccctattgcttcctttttataacaacttctaccaccttccctatcctcccctccactgtcttacctcctggcaagtactaatctgccttccatctttataaattttattcatttaaaaattatataaatgttattacacatttgtatttatataaaatataaaatatatcacataaatatgaaaatatgaaatatatacattaaatcatacagtacatggctttttgaggttgactttttaaactcactgtaatgctatccatcaaccttgttgcttgcttttatgaatgtttattctttattactacctagtagtattccatggtgtggacacatcagagtttgtttaatcattcgcttattgaggaacattttgattctttttacttttgggctattataaataaagctgctaggaacaattatttacaggtgttttgtgtggaagtaaattttcatttctgtgggataaacactcaggattgtaattgctgagttttatagtgtttggtttttaagaaatgtcagacttggctgggcgcggtggctcacacctgtaatcccagcactttgggaggccgaggcgggtggatcacctgaggtcaggagattgagaccagcctggccaacatggtgaaaccccatctctactaaaaatacaaaaataaattagccgggcgtagtggcatgcgcctgtagtcccagctactcgggaggctgaggaaggagaatagcttgaacccaggaggcagaggttgcagtgagctgagattgcaccagtgtactccagtgcaacagggtgacactctgtctcaaaaaaacaaaaacaaaaacaaaaacaaaaaaacccggaggttgcagtgagcccggatcatgctactgcactccagcctgggcaacagagcgaaactctgtctcaaaaaaaaaaaaaaaaaaaaaaaaaaaaaaaaaaaaagtcagacttttccagagtgactgtaccattgtacattcccagcagcagtgtatgagggaatcagcatccttgccaggatttggaattgttgctgttttttaatatggctgttctgataggtgtgtaatgatatctcattgtgattaatttggatttccctaatggttagtgatggcagacatttttatgtgcttatttgccatttgtatgtcctctttgatgaaatgtctgttcatgtcttttgcccattcttttggattatttgacttttactgttaagttttgaaatgttctttatgtattctagatatcagtatcttgtctgatgtatggtttgcaaatattttctcagtctggagcttggcttttcattattataacaggatgctttgcagagcaaaggtttttaattttggtgaggtcaaatttatcagcattttattttatggagtatgcttttgatgtcatgtctaagaaactcttcaccaaacccataggtcctgaagattggctcctatgtcttcatcagaagcttaagctttacattttacatttaaatgtatgacccattttaaattaagttttgtgtaagtatgaggtttaggttgaggcttatttattttttgcctatgaataatctaattgcttcaacactgtttaaaaggcatttcttctaacattgaattgcttttggatcgttgtcaaatatcagttggccatagttttgtgggactgtttctaggttctctattctgtccgttgatctgcgtgtctgtcccttcgccagtcccttactgtattgattacagtataactatttagtaagttttgaaatcatatagagtgattcctcttactgtattcttttttgttaatagtttcaggtattctagtttctttccatgtaaatttttagaacaatcttgaacgtatttacaaaaattttgcagggattttgataggaattatgatgaatacttttatttttatgttttgtagagacagtgtctcgccatgttgctcaggctggtcttaaacacctggacacaagcaatccccccaccttcgcctcccaaagtgccaggattacaggcgtaagccactgcgcctggcccatatgtgaaatctgcatatcaattttgggagatttgatatctttgctatactgaactttcccatccatgaacactatatgcctttccttttatttagatcatctttgatttctttccatcagcaatttgtagtttttagcatacaggtcctatacatcttttgttagatttgcatctaaatatttcatttttctgagacattatacataacattgtaattttgattttgcttttcctgtgttcattgttagtatattgaaatacaatttgtttttgcatgttggtcttcaactttgcagagttgacttctaggagtttttatttagattttttgggatttttgtaagcatatcatctatacgagcatgtcatctataaacagggacagttttattatttactttctgatataccttttccttttattgccttattatgctggttggagcttcagtactatgctgaatagtggtagtgagagtggacatgcttgtcttgttccaaatctgaagtgaacaagcattaggtctttccctactaaatttgatgttagttgtaggtttttgggtagttgttctttgaagctgaggaaattcctttctattcttggtttttataaatatgtattgaatgcttttttgcatcaactatgatggattatgttgattggtttttgaatattgaaccagctttgcatccctggaataaatcccatttggtcaggatgtataattctttttatatattgctaaattttgtttactaatattttgttaaggacttttgtgtttataagaggtagtatgtgattttttttttctttgctggtatttttagggtaatagtagcttcataaaaattggaaagtgtctgctttccctgttttcttttcttttttttcgagacagaatctcactctggagtgagattcagattcagattcctaggctggagtgcagcggctcaatctctgctcactgcaacctccgcctcctgggctcaagcgattctcctgcctcagcctcctgagtagctgggattacaggtgcctgccaccatgcccggctaatttttgtatttttagtagagacagggtttcaccatgttggccaggctggtcttgaactcctgacctcagatgatccatccatctcagcctcccaaagtgctgggattataggtgtgagccaccgtgcccggcccctgcttttctaatgttatcatttattgctaaaagtttaccgttagtactgcttgtgtcccctaaacttggtatgttgtaatttcattttcattcagttcaggtcattgtttaagttattttgaggcttcctgtttgacccatagattatttgccagtgtgttttttagttcccaagtttttttagattttcctgttatctttctgttatttatgtctgcttttctttcattgtggtcagagaatacactgtatatgatttcagttcttttaaatttgctaaggtttgtattatatcccaggatatggtctatgttatttgttctgaggtcatttaaaaaaaaatgtggcttatgctttgttaagtgtagtgtgctataaatgtcagttagatcctagcctgttgatggcattgttgaaatcttttacatttgctgattttctgtctagttgctctatcaattaattgttgataaaggggcattttagtctccaactaccttttgtctatttctcttttcagttctgtcagtgtttgcttcacactttacaactccatttttttgccacaaatacatttgggattactatatttgcttgattgattgacttacatatcatttttaatgtccctctctgtttctactaattttctatgttctgaagtctacttattttattcatgtaggtactcctgttttcttttgactgttttcattgtatatatttttcatatttttactttttacatatatttatcattatacttgaagtgagtttatggatagcatatagttcatgcttttttattcattcaaccaatctgtattttaattggtatatttagtcactgtacctttaatgaaattattggtgtgttagaagacccaggcagctcatcactttgaagttccttgcatcctaaggtccctagcagttctgcctgttctctctaccttcaagaatcttttaatgttcatgttatatatataacacccaggaattgttttactgtacttagcagaaatgataggaaaagtacatctgttccatctttctggaactgcttctttacttttaaaattaaaaaaaattattgatacacctataccacaatattgctgtaagtgagatgaaagtgaaaaaggattcaacatttaaattctatttggacatcagttattatatctaagtgatatatgaaatcatgttgctctagaacaatattaacagattttatgaggttcccttataggaatgaaaatttatacgtgtactctttctttctctttgacaccactctacccttttctccttctctaacatattccattaagaaattttactcaaacttatgctttgcagttggaataccctaataccgattataagtcctgaatcatttattaagtaccttgtaattgcccagcactgtgctaccaatgcctttcagtgactttctaaattcaccctgttaggtataattatcttactgtgtagctgaggaaacagaggcttagagaagtcaagtgatttgctaaggtcacttagctagggagtgttaaaactgggacttgaatacaggtcttagagtttaaagttcatgctcttaacctttatgttttacttcctccctgtattctcttgtacttcatcaacctgaattctttagagctttttgatctgttgggacctagtttgaattcttaagcattttattatttttatttgcttcaatgaaaggtaaaagatataacctagattttatccattgctagtttcttttagtgccatagtggttttatctgtcagcgtgtctgtgtgtttcttaatgttcctagcaaaatttaagatgtgatctagtaactgtattcttccaattgattcatctttagtgtcactttaattttatttttgaaaaattaacgttatcttctcatttctctgttggagtgtgattgagtgattaattcagcaattatttatagagcctactgtgtgataattattgtgcgagatgctggggatattcagtaattatgtgtttctttgttcttgtaattgttctgtgactttagttacatctttcttcagaatctttcaattcacaagtcatctgtaagatttcactcattttctatttctagagtgtagtccagaaaccatatgtgtttgtgggagtttggtttaattttggggaagatattgatacttctaaagttaggtacaccatggtctactgtttacttttcaatgcaaatagagactttattgatgaatgctttccttctcaagtacatgttttgagattggtgaaaatctacagaaaacaaataattttaccccttacgctgaatgctgggaaaagaaagggtcttgtctataaattaagagcattacctatgagcttcacaatgtacgtgatggacctagtctgtgtaaaatgaagattctagaagcagaagaaaatggcttcaaaagcaaatcagaggttatagttcatggacaagctaagtactaaaccaatcttattgttgtgaaattaacattttctgttttatctctgtggtatcacggaattttattattggacaggctaatagagatctgtttgagcagcctattcattttatagacaagaaacctgacacctgtagaggtaaaatgacttttaaggccttttgtgatttagcctccaaacttgaagacctgggcccttgttactgtatcctctggactgcattttagtaatattttatcatttcattatagtctcatacttacccaatattcttcctttacagggtttcagttttctcaactcaagagagtagataaggcacttaatgtagttcatttctagttggagtctgtaaaggtttatgaattgctttgttaatccacgtcactttgtatcttagctttctagactttaaatgttggttgtagtccgtataactgccagacttaacttataatgaatgccttcaggtaggtagatatttgtttgtgtgtgttccgtaaagaacaaacaaggggctaagaattatcaactcttgctgtgagggccccttagccaggcttccaccctctgcctcttcagtcttagggacttgtcaaccaacttctgcttcagggcctcagggatggtgggtggtggggaccttaggttggctaattttaccatggcatgacttccatttttaagagttattttcttggattgagacacagttagcttgcctgtggcttccccgcagtgattcttctgagtggatggaataaatcaagtttctctgtgtttcctgactaaatattgcaggttgtttgtgccattcctcactttttggattttagataattcactattctacatgcttcattttttttatgtttcctcaggtgagccccaacttttaactgagtactttagaaataggctgagtcccaaggggtcagtggaactttcttgttccacctagcataggcctgaaacagaggctcagtcttgggactccttccttcagcctggaaggaagaagtgagggagaaaggaagaaagtgatcaccaaggcaggcctggtgcctagaagctgagctttgagaagcatactttagtaacgcattttctgtgtcctctcctcagttaactcgtctcttgaatctttattattaaaaattaacacctgaactggtaatctcagttcctgcggtccctctctgtatttcaactttacatcagccactttttttagtattataaacaggagatcttttagacccctaggcttccagttttgattggccgtcaccttctagctccctcatctcattacagactaagctggatgcattaactagttgcatagtcttggacaagtcacttaagtattctcagccttagtttcctcagttgtgcagtgggtctcctcacacctactcacttaagaaataaatgaaataatgtgtgtgagagagttttctgaacaagaaaatattagctaaatatcatctttccttgttgtacccttgtttctacaggacacagttggatcagcggattcagtgcttttcctgggatctcttacaggttccctccatgcttgttgcccttgactgatggtatattggaacatttgtacacagtggccttgaactatagtgggcacttgaaatggcaacattttgtattcttctaggaactactgtttttctttgaaaagccaggaatttcacggctccagaggaggggatgcagaagctatttctttttattttcccctgttaaatcagtataatgagattctatgtgcatagtaatccttaagctctttgcctagttccttttgccctaggcaccttggagtgatggaattgtagtcagtcagacatgtgcagtgtattcacacatacacttagagggctcctcgtctgctccccctagctaagcagcccctttgaaatgtctaataaaatccctgctcttgtgcgctgcattgaaacaaagcaggctcacgcagtcctggaaatgagccctgagaggtattatttctatatgtcggtctttatttgcctgttttgacagtgtcgtacaatgagggtcctgctgctgatgcagcagaatcacaaggagccgtctttgctgtgtaaattctccctcaaaggtctggcattcgacctgcctgctaaaccctctttgaaacaatgcaatgacaaaatattttcttcttactgataataggcagattataattgctataattgcttctacctcattctctgaagggaggaaagtagggctatggaatgagtgcttaaaatttttatttatcgtcttagagatatagatggttcatttattatacagaagtttacatagcagcctctaagtgtacgttgtttctcaatagttggaattaaattcgtacttttggactactgtttattaagacattcccgggaggctgaggcaggagaatggtgtgaacctgggaggcggaggttgcagtgagctgggtttgtgccactgcactccagactgggtgacagagtgagactccgtctcaaaaaaaaaaaaaagacattcctccttggtgatgaataacacctgtgtgccaaaaggatttttctcattggctctgattaaggggatatccagccaataaccgtagcaagccttagggtgaatttttggcaatctccaggtctagtcattgccttatgggcagtctgatggcaccttgggcattgtcttattgccctgagcacaggtgttaggggcatggagtctgatgagccgtgctctgctgtctacccccagtctgttctccagaccccctaaccaaacttctcatagaggtgaccatcacaaggacctggtgtgtggctagatcagtgacaatttatgaccacttctggggaaatagctcagagtgcacgtccttcgtgtggtaggtccaaaatattatctttgtatgttcaaagtagcataagctttagttgctgctgttggtttcaggagaatcacctggatgtcagtgccttggggttattaataatggtaaaaaaccagtatgagggtggagcttagaagtagaccaagacttgtgagtcatgcactgctttttaatttgcaagctaaataggtgctaaaactcacctaccctggctgctgagatagtcactttctcctggtcctcctctattgtaaagagaagaggttggacttaatgcccttcaaggtcttttctctctgactttctgtgaaactccaaggtgagtcctaaattttgttttggtctataaatttaaatgcttcccctgctgagctgctttgggctgagaatagaatggatggaatttacaccttctctctctctctgtcccatgtgatgctttgattggctgctaacagaagggaaggtggtcagaaggcaaggaagccttggcaaagaggaagaggagtgaaagtactaaagaataggaacaactgggggtcagccctggaataaaaaagacttcacagggcagttactaggcttgcctcactctttggaatcatgagaggtttgctaggtatgtactgtaaggcccgtgtggccagagactgagtcttggatttactctttttgccctgacattgccttgtgtagcactggatatcatgtaggtactaattatttcttctttacttaacttcctggaaaccgctgcaattgtcaagtgaatagaagtgaataggactgttatattaaacattatagagaagggtccatgctcacagcatcttcatcattccaaatattgtgcttgttgaagcagagaaccttgtcaggacagtcattgtaccaacatttacgaaatgaaagcaagagctattaaccactgtataagatttgaggatattgtgctttcaaaggaagcaaagagggtttaaaattactccagtgggatatctctttagcctcacttaaggattgtttaaaaggaaatagaaataaagattgtttcaaaagaaaaagaaataaagttagaggtgaatagatggtatatgtaagagctttatgttttggtcatactaagtttattgttaagttacaacaaaaaaattgttaactatcatgtctccagttttgcaggataattttcttttaatgtattccaaaaactgacctcagaatttgatgaagtgttagacaagatgacaaacagagagactgttagtaacgggcagaagtcattagtctcagactcatattcatttgtttgtggttattgattctagtcactcctattcttatctccatccaaaaataggcattaaaccctaatctcttgtggatgtttgctttgtagatttaggagaataagaacatgtgaccatacctggttagccatctcaagatttgttatgagctagttgacttcaagagccagtgagctgggttgtgcaggatacttgttactggataattctacttcagatagatgctctagttgctctgctaaaatcctctgttctgtcaagcctgtcagagccagagtgaaaaaacaaaacaaacaaaaacaacaacaacaaaaccctagtagagtacctgaactctaaattacagagtttaaggactgaaaatgaccttgaggatccagagtaggactctcaaactcacatgttcctggggtagacaggtagcagagtgaatgaattggacaactataagcaatgggggagactgaagagacattcaaatttagaaaattttaaggacattatacctgcctgacaaagaggtgtttttttttgttgttgttgttttttgttttattttctgtctctgatgcttgaatcaggaggacaaagagctctgatgctgattcagctgcaattttgaggacccttgaccctaactatcaggttatctatttctggtttaaggatgatgacctgagttacaggtaggaaaaggcatttaaccaaggagagacagctagtgagggctggagcctggggctctgaggtgtagtctgaggttctttctctacaccatggtgatatctgaaggggaaggcaggaacacctggatttcaatcagggatttaaaaaaaactttctatttttttagagaggtataattaacatacaatcaaatgtactcatcttaagggataacttgatatattcttatgtgtgtgtcctttcatgtcaccaccacccagatcatcccaagattctccttgtgctcttttccaacatcccccacacccctgcaccggaatcacaatttaccagggaaccatggcacttttccttccacttgcagagctggtccgtctgtcactggcccagttcctcccctcacctccctctcctcagattcaattgtaaagagctatagcaaacacaagggcacatgttgcttaatttttttttcccacataacccaacagaatcttgggtttctttaaagtaagctctctaattatgccaatgccattgactcaccaagtaggatgccaggtcccacagggtgtgtccttcacagggttctgagggtactgcttcttgcaatgtcaactgctttatacaaaagcatatttaaggtcacatgatatttgccaagttattaattattcggaggctacttttcctctgaaagaacttcagatgtccgatgtcatgattttattaaatcaaagacccatatttcattgtaatggacatggcactcaaaacctgggaatcgactcattgaaaatgtagccaacacaacactgaaaacaaagcccacctcacaggcaatgcagcttccttaaaaaaaatagctgattcccaggctgaagctgttaagcagatttttatgcagggcttcaagttactaaaaaagcaggattcaatatgcctttctctttgatttgtaggagggggtgggaagtaatgctgctgctctccccttacccccttcagaagggcttttaccatattctgaaagcaatgcttgaaggacccataaatggattttggctgtctcctagtgcagggattaacatagaattatagaagtgtgctgcatggtggttgggaaaatagggaggatgccattctctttttggagggacatggtgctcccgtctcttgcctgtggatgttccctataaagcagcctgtcactgtgaaaaatgcacacactgtaccatctcacagttataaaggttaagtaagcatcttgagcagtgccccactgcttttgtactttccataatgtcagccgataaaggattattgaaaaaggcttgcaaggagataaaaggcttgcaggttgaggttaaacaattgaaattttctgttcccagtgtagtaaattaccaatggcagatttaacgtttgttaattattagagcaaagtactaaggattgttttcttttgcctaattaattacctcatctggagtggaatgttaattcagataaatgattatttcttaatacctctgaagctttccttggaatctcctagaattgccagtcctgaagtgtggtttcctcacattctggggaagataggggataggtgaccaacgtgactactctcttggcctttttcccgtctcagaagatggcaggataacttgtttagacttttggtgatggagttggtttgctgttctagttagtagaacatgagtgtgcttcctggaatcctgtgcctcataaccaagtttttgagttagtctctcgtgtggttttgaatttaacattgaacattctttttacctttggtaattctcaatttggggcacctgccgtgaacattaaagatggtatcctttggaaaggacactctagtttcttaacttgctttttacctttaagttattttacctcctgatgtctgttcagaatgctagaggcaggtttttattctttcttggatctaaactatatcacctctaatagttgtgaatagataatattcaaaaaaggtaaaatcatgactcatgcagatataaaatatccacatgtcaaaaattttacttattttaaatgagggaaccagatagatgttacaacaggtaccaaggagaaatgaaagaaccacaaatttatatggaataaaggaaatgaaaacgaacccacaaatgaacacaaaacttttgggggagggttgttcctctaggggacagaatgtatttgcatagctatagacacttttcagagttgtaaaatcgcccagtcagacacaaaggtaagtgtccctgtaggatgagaccattttctgaaaggagggccattaatctcttttgcttttttttagggtcagaaacttccccttagacagttgtgtatgaggttttaatccagttacttaggatgacattgtatcttcaaagtagattagagatgaattatgtgacttatttttctttttagaaggaagcttaaaggtgacttggggagatgggctggtagatctgggccattggaggcgagctacaacccatgtgaccagttaccctgcacagtctctactcctgataaggcacttattttatgagcacttttcataatgatatgaaaaggcagcgggattctgtctaagattatctggagtgaaagctggaggctgatattaaatggatagtcctgttttcttttggtgctgccaagctgagctgtttaaaatgatgcttggaaaaatgcctcctgagccaggaagttgtctgattagtgaagagatttccgagacgtttggctcagagactaccccatcataccacacatgttcttttccacattcacctgagtcttccaaagatacgaggactcggggtggtgatagggtgtacattcttacatacacatatgtgtatatttgtatatacagtctgtctatccatgggttctgtattagttgattcagctaaccatgcatggaaagtatttgaagaagaaaaaaaggatgtttgattctgtactgaacatgtacagacttttgtccttctcattattccctaaacaatatagtataacaaccatttacataccatttaaattatattaggtattatgtaagtaatgtacagatgatttaaaacatatgggaggatgtgagtaggttatatgcaaattttacaaagggacttgagcattcgtggattttaggatcttgggggatgctggaaccaatcccccacagatacagcgggacaactgtattcatataaatatataggccagagattggctttaggggagtctgcaaagttccataattatatgcatttttcttaggcagtattgtgtctgtcagattctcatagtctccaaaagttttatgattcttcaaaagtttaagaactgcttacagaaaccatgcccccagtaattattctgaatctatgtgttaccacgtgtatgacttagaagaagtctagatgaaggttccacctaattacagaatccactgctgtagccacagctggattgagttatgtggcagccctgccccagagctggggaggctgcgtgtgtgcccctccacacctgagtacatcctgggtgtgctgaaatgaagcccagggagatacaaagcaccataatgccattaaggccagcacccgttgggtaggggagaggctgaccatacagacttctgacttctgcgtttcattccctgctctgaaacctgtccgtctctcaggcttgcaatctgccttcctgtctctctgacagacctgtgacttgggctatggttctgataccaggaaataatgcaggggtgggagtcttagtcccaagcaaaataaatcactgctcccattagacattacaatgtttaaacccaagtacatctgtctgccttcaaaaccaagatttagagcatgtcaagcaggtgccatgcctccaataacacatactttgttccaacatttagtagattactgtgagattttaaattcaaattctcagacattcactttgtttaggaaataactgcaataaagcaaattgtctcctgttctttttttccccctacggtgcagccaagtgagagcaaatcaattcctagtcaattttttgttgctgttttcctccatgctagagaagagatgatgcagctctctcctgttgcagccctgtgctgggtgtggttccctctccttaatttgtcatctgaaagcaattttgttcaattagagattagaattaaatttcagttgtagggcttctgtgcagaggaaatgatgcattaatgaacacacagatgtcatcttgcagccatgatgcttgcagaacagtttcttcaggattcaaataataaaaggggccacagcagcaggagcattgtttactggttggcatactaagtggaggctcacatttatttgcaaaccatttatcattctgtatactgagagggagaacatactttatttaaaatatttgaaataatgactcttaaaatcggataacagaagcattaatgccaggtgccatgcagtaaattgcataatgctgttgggttggcactgacactgtgatttgtgttgctaatgatctatccaaatagatgggagttgagaataaaaagagaatattcctggaaagagacaaggcaactagtgaattaaaagtgtagtgagaaagggaaaaaatgtgtaggatcgtattttacttattggaagacccatctgctcttctgtacacacattatgtaagtttcactctctgtattacaaataacctgcagggtggataggaagttcatatatctgccttcagctgtttttttcactcacagacgtgaatgaacagaaagatttatgtcttgtgtgttggatattataggatggtaggttttttttttttttttaagggcgttgtgtatttagactgtgatattctgtgcactgctttgcttgaagtgagtgatggctgcgactaagaaggcagcaagtggggagtgggagtttggggaggtggaaaagggtttctgtgagacaatattggtttgtctggtctttgggcctgggctacacacatgccctttgacacttatggttaaagtgtttatttccgaatggtgcccagagctatgttcagtgtgtcctgagtcactgttgaatttttaaaatttggtagtctctgtgctgtccagaatttcttagatgtgttttgaatacagagggctctcagtatcaggtggcatccacgctggtcattgatgttgacagggatgaaatctcacttaaaaccctctaatttcctagttcaaggactcttccttattcctcttcccctgttgcaaaaggaccctctgatgttggttaagggttaatagttctgtccttgaaatgttttctttctgcgacatcacatttttcttttgctttatccatatcttgtgccaaggccattctctttcattctcatttcctttttaacccctgtgtgtactgcatcaagtcctattttgctgtctcttcgaatttagagacatcatcagtgcatatcatccattatacaaaaaagccagtaatagcccaatttttatttcctgtccaaatttttctcctcaacttcatatccatatctctcttccagaaattttattagaagcacaatgtatctaggataaaatgtaccctctccctaactcttccttaccttttataatggtgcttacgttttccatgtcttcctacttaaaattgtattcatgtttgtagtcttctccctgacttcactgctcatgagttctacctttttcttgtctgttataagtcctttccttttcatttcttttgctacctgccttgtccagatcttccttacacatcacctgcaagtagctgatcatcctcttaactgatctggtagttaatggtgtcttttgctcccaagcctgcctagtcctctgctcatctacttatttctgcctactactccaaagccttcattggctccccattgcccaaaaatgaattccaaacctcccagtcctggtgattaagtagttccctcccatacccaaacaacccagccctgtcttttactaacttttccttataggtgtgtgttttgttctccctgttctcccctgtatgcctttcaaaaccctgtccttgctaaagcccagcttggatgccttttcttggaaaccttccatgattgcccccctggagtgtactttgttgctctaggtataaatgactactgcacttatgttaaggcacctgtcacatactgtaggtatttaaggacctcctctctctgctggatgatcatcattttgatagcatattccttttgttttcaacagagctttttctattaattttaaatgcaatatactgttgcaagtagtagttggaaaaaatcacagagcaagcaaagttctggaatacaatttttaggtcttcctcaacattcctgtcacagtagatgatgtacacttacagcagaagacgatggttagaaaggtaagagcctagggtctgagtcagcttcaactagaatgtgagaactgagatagaaggaattatttccaccttcccggggattttctagcatagcctatgggttgtggtttgcccagcaacaccttaatctagttgcttatgtttagtaagcatttacagcctgggttagccggctggggttcaagactcttggcctttaggccagtgcttgatgcttctgtcagcctggaaaaaggacccatgtatcactcagtggttctttagccaacttgagcaagtaaagaagtctaggaggcagaggtcttctgccagcttcagcctttaggattgttagggtgatgtggggcctgctctggtgtgtctcgtaaagaggatgaaggagcagtgagaattgtgtagactagcagtatcctttcatctgctttgttgtgagccagcttaggtggtcttttctctgctattaaaggggaattctgactccttgagttgatgagatggagtttgggaggcagataggccttgaggacttggtgggagtttgtaatctgggcggcctggctgaattcatcacaagggtggatttttaaattgccttttttgctcacctactcaaattgagtcactgagcagtatacttgtagatgctttaacaagtagattatattgaatcacatttaataggaagatgactaacacaagggagttgttttatgttttaaaaactgctcacgttcctgaactgcagaagcacctgttctgttactttttaaaatatggtcgtgaatatttttccctttttggtttccccagggcagtgatgttctggttctgaggtctagtacagcatttcctttttggccttttgtccttgcttaaattctcttccaattcttcccttccaatccactgacccaggattagagtactaaaacctcacttgtttttccttatttttgttcatctaacttaagagtgcgtggcaaaaatcttcctttgtttttaactaagctcgttaccttcaccctggtttcataatgtgtcaccctccctctctccccctattttttcctcctaaattaaaccaacaggagtcatttgaaataggcgcagtgccagaattagcaaataaaaatacaggacacatagataaatttgaatctagataaacaaataattattttttagtataagtatgtctcatgcaatatttgagaatacttactctaaaaaatcatataggaaattcagatttagctgggcatcctgtattttatctagtaaccctacataggcatatatttgaaataaaaataaaattttacattaaagaaaacattataaagaagaaaaatttaagtttattgtgtgttaaatattcccaatgctttccttactgaaaaatgtaagactgtggacaaattatgaaacagtttgtgcataagatttataagttagctacctaatgaaaagcttctgttggctattggaatcagccatttatcctaggattcagctttatctctttgctaagaagatgctcctgattttgaggtgagaatatttagtgcaagcggtagaccattgttacatatgatatatcacaagcacctgtgtcaaaaacaaatgttgaagtattcaacaattttttcctcatttaaattgtgcccagctctcttagctcaatttcttctggcataaagattcttaacacaaacaattggatgatgaagacagtaaattcttgattgagcgaagtttttatccaagactagcttccctctgtcacccaggttatatgtggagtacaaactaattatgaagctaaatcttcctcagaccacataagtaagtctactccaaagcttaataaaatgattctgcaatatttgttccatgctttgctttttaccaagcctgtgcatacgttctgatttgattctcctgacagtctatgagagaacagtgatgatttgtctcctcattttataagagataaatttgaaattttgataggtgaaatggcttgcttaagatcaagcaagacttaaatcttgatcttaggccttttgggccattgctctttccactacctgtattgacttttgaatgtaagtgatttgggaattaggcagtttaggagtaattgtaccagtgttcccctctgctagcttggaagatgaagagctgttttcatacctgtgcattgtgctggaagaggtatttgcctttggttcagtgcatacctataatacacattgggtcttcttttgaggaacagctgcctcccctgtacaaacagcctttctgaatgaaggggatcagccaccgttgacctgtgagtttgaagtattgcactgttaatgtttgggcaggatttttttgaacatgtggttgtaccacagagttacgcaagcgaaatattcttggaaatgacattctgcacaaccgtagggagaaatattgggaagctggcaagagagtcaattctatcagtgtttattgagcacctataatgtgcattttgtgaatactggatgatgtggatgagaaaagatgtaagtcctactcaggagcccttcctgccacagtaccttcattagcatctcctgcctatcagtgcttgaaattcctggctcatttttgatatattttatttctgatttgaggcatcgtgtcctttattttgataaaatattatctaaatattttatatcacataaattattaaaataaaatattattttttgtttgttatgtatagtcccctaacaaagtttgaactttttgaggtcaaggatcatatatatatatatatacacacacacactcatgtacagaagaagttcttgaaaaatattggataagcaaataaatttgtggtattcttggggaatcttggattaataaatggatagcatccctcggttgttgtatacctatattcaaaggatccatgactcaatgatggggtaaggaggctaaaagaggcaaagtcaatgactgaattgaacatggcatatcatctcaaattatactgggaaacaacattattgtctacttgttaaccaaatatatgcagttgatatcattcaggccttgcacaagttccttagtgtataatcttggtccttagaatgaagtgagcagcaggtacatattcagagactcatagtttgatggcatgggaactgtatctttggagatataatagaaaaaactgtgccttatctgattaaaaatgatttcctaaaaagtacttggataattcctaattgtcccagttttcataaatgatttggaaaatgctgtttgagactgtgattgttaatatactgtggaagcctattaacttctttttagaattcaaaagcctttaatatatggggcaagagaacatggattgacaaatggataagagtaactaactttattgtaaatcactgttgatatttggtccctgcctttgttcttttgttttactttctttcctcataggactcattaccttttaacatattagtaagaccgggggaatttgttcacttttttccttgatgtataacaaatcatattgcttaagttaaagctaaagtagatatttaggttaaaaattatgtagatatttaagttaaaaatgtgaattgacttaaggaataatattaagagaacaatgtagcaaaaattgtcatatatatacatatctgtgcgtatgtgtgtgtaatatatatatatatatatgtattcacgttatatacagacatacacacagacatatgtaagtaccagggatgaaacaaaaaaaaaaaataaaacaacatgtgttaagtactgtgttagtactaaagatgacagaaaaaagtacaaccctagatccttggccagagatgcttacttgtcttacacttcttacagtcccctctttactacacgacaggttaacttaatcaggacagactgtataagttacagggcccagtgcagaatgaaagcatggagcctgttgtatagaaagtaggacaaaggtgccattaaaggtggtaaaatataaaatatttttcttctaggggatctctctcaactttttatggtgttttaaattagctgtttaatgttgctttaagtgaggaaaaattcaaattttaaattgctagcatgaattttaccattcatggttctgttgtgcaatgccagttttaaatgcagatatgagagcattcaacttgtatgtagaatcactgaatttatacagtttatgttatgcctcataggcacataatgtattttgtttttaccgcacagtggaaacactgcatgaaatgaactcagaggtttttatttcacttgttgatatgcacacatttaaccaacactctctaccttcagattacaatgagtaaggaaggactgaaagggactgtctttccctttcctcctgtgtcattttcagtgtgattggctaatacagggaagtaatatgtgtaagaaaaggtatgttaggatttcttgccattcatgtttgttttagaacactatttccagctttctgcctttaaattgaagttttgatttgaagggaaagtataggctcccaaggttgtctgtctttcctctggcttcgtcgtaaccataacacacttatagggtagtcccccctttatccatggggaatacattccaagacccctagtggatgccggaaaccacagatagtactggcccctgtatatactatgctttttcctatacgtacgtggctgtgataagtttaattagggacagtaagagagctaacaacaataacagagatttaacaacaataactaaaacaacagttattaaccacagtactaaaagctatgtgaatgtggtctctctctcaaaatatcttactgtactctactcaccctttttgtgatctgttgatctgataactgatctgagacggctactaagtgactaatggatgagtagcatctatagcgtggacatgctggacaaagggatgattcatgtttgggtgagacagagcaggacagcacagggcctcatgctattcataatgcctcaaaatttaaaactatgagttgcttatttctggaatttttcatttaatattttcagattgtagttgactatgggtgactgaaattgtgaaactggagataagggggactgctgtactctgatttttactgaactgtcacatattgcaggctcactggagttctatgttactgggacatacaaacactatgtgaatggggcagccaggaattcgctcgcgcctgttgcgtgtattttttctactcatggacatgttccactgtgttatccgacttaacttacaaaacaaagttcaaagataagattatagagcattaaaccaagtgccgagcccttctgagtgcagggccctgagcgattgcacaggtcacacacccatgaagctggctctgaccttaatagataaggaagcacagcagagacataagctgggcctgatgccctgtgttttcacactgaggaaagcatgaattatctcttacgttccttgtttgaaactcaggcttcaaaagtaggaaaggttagaacatcaatccattgtgcctttccaccttttatctgtaacttgctgaaatgttttcttcctcctcctccttttcttgtcatgttggatatgtccttaatatatcagtgtcaagtgttgtgtctgaatgtgaacctgaattctattctaagtgctgaaattaaaacagtgtttctctgtttagtttctaatgtattcggggtactagagtatctaaaacagcattttaagaggctttaacattttttgcctttttttctcccgaattatacaagtcatttttctttttctgatttgttgtctcctgagaaagtaggcctccctttttttttcttgcatgtggcagattagtatcctgtggtccattgcaaccactacagtggttggtaggaagtagaacttgtagaaggtgcagttaaaactactattaaagtagcagggaaccttctttgccctctcagatgaggaccaggaagttgactttcacatttgaggtggcacttgatgtagcctatattcttttttttttttttttttttttttttgagacagagtctcactttgtcaccctggctggagtgcagtggtgtgatcttagctcactgcaaccttagcctgccaggttcaagcgattctcctgcctcagcctcccgagtagctgggattacaggcacgcaccatcacacccagataatttttgtatttttagtagagacagggttttaccatgttggccaggctggtctcgaactcctgacctcagctgatccgcccgcctcagcctcccagagatatagtctatattctaaagagactctcttctaatcaagtggttatcatctgctaatactttgaggaaaaaagattaatgttccaggatttataagttcagagaactagcttaacagagtgcagtgcttcacagatctgtctggctgtggaatcagattgactttaggttgctgtggtagctctgcagcataggagctgggaaatttagtaaccttacttggtggttctcagcccttattggtatggttaaggaactttgaataaacacctgtagagatttgaatttagttgccgttgggtggggctcaggctttttttttttttttttgcatcccagagttagcagtcagggttgagaacactagcttatctcagaacatcaatattctcatttataagatgagagaattagactgtatgagatcgtcgtgagatctaggcagatgaacacagcacttggccagtcaatgtgagtgactgttatcgttaaccacccttactgattctttgctgagattggaagctagattggcattcatttcttaagctggaaacctgtgctgatttgttagaaatgctgcaaggaacagaaatgattatctatcctaagggaatgactcagatcttgttagaataccatgcccaacttctcacctcccagaagagtgtgtcacagaatagctggaattacacctactttatgtatgaagattatccctggaatagatacatctttgaggaagaagttgatttattcatttgtgtaatgtttattgatacttaatacctatcagcacttctagactgtggcctggaggaatccatagattggtaattggttggaaaagtgaatgtaaattataacacagaagaacaagtgttttgttaaggataatggaaactttaaagctaagtagaagatagccaagctgagaggcctgggtgggctagggaagaaggttattactggcagaggaagttgcagttttaaagagacttagaggctggacacagtgggctcatgcctgtaatctcagcaatttgggagaccagggcaggaggatcacatgagcccaggagtttaagagcagccttggcaacatagtgagaccgtgtgtcaaaaaaaaagaacaagagacgtgaagacacacttggcatgactgggaaacttaaagtagtttagcatgtctggagtatacttactccagaggtgggagtccagaagatggtgataagaaagaggttagaaccataagcagggtcccagtcatggaaggctttatttggagattgaaattgattattggatagccattgaacattgtaagcaaggaagtggcatgcttaaacttgcactttggagatgtcacaatcctacaacaggctgaaaggctggagacatggaggccacttgggatgttgttaatggaagtccagatgaggaggtctgaattaaggtagtagcagtgtagtcacagtgaggtggacaacagatggcggagattaagaaggtggaatttgtaggtgtcagccccaggcattgcatctattttttttttccaagttgtggagacggagtttatctctgtcacccaggctggagtgcagtgacgcgatctcggcttactgcaacctttgcctccctggttcaagagattctcatgcctcagcctcccaagtacctgggatcataggcatgcaccaccatgcccagctatttttgtttgtttgttttgtatttttagtacagacggggtttcaccatgtcggccaggctggtcgcgaactcttgacctcaggtgtgagccattacgtccagttgcattgcatctgtttgatgttgggtatctaggatgtacatctgtcaactcgtgatgcctccctgaaccttcgatgattatctattgactataatctacccccaaccctttttttttttccattttcatctttcactgaattcctctgtggatccattgatcacgctttgcatatttattccttctcccccaaccccattcttcctggatgagctttttgctctcttttaaaccattgcacttgactgtctaggcatttgccagtatatcaaataagtatgtatttgaaagtctaggtgagcctttcttaaatactggatgctcagtctaaggtatccattgtgtttatggaattactttctctcctgtgtatctaaatggtactagtttgatacttttctgaagataattgagaaaaagtaactttgatctttttttcttctgtggttcagaagagaaattatttgtttcttgctcctatctgagccagattgcaaatttagtgctaagatttctggcattaagaggattattattattattgttaaattgattgtctcattagattaccaacatgaggctcatgggacttaaaagatttatgcccatatcctggttccatttttgtgtagagcctgtgggatgaaaatggctcacaggtctgtttgtgacacaagtagcttgatagatggcctatggttcatgtgtagaaaatgttggcgactatagatttattttagtatcattttaggaagcacaaaagtggtgtcccaattgaaccttatggagagagcatcattactttccatcacaggttcagactttgggaccccagggctctggaaatggaactctttgaagaggtcagagcctctatgcaccctctcagtcaactcaactgcatgtagaggagggaaagaatgttgttattattcttaatattcttatagtagcgtctaatagtacattagtaaatagttattcacaaatggttgttcctattgcttagcaatttctgatttcagatttgtgttttggatatatgtgcatactgaccttctgccttttaataaatctagaattcatttgatagtacaaattaacaaaaccagttgtaataaaaatattgaattttaactttaaaaaatatgcagtgtggccaggtgtggtggctcatatctgtaatcccagcactttgggaggccgaggtgggcagttcacgcggtcaggagatcgagaccatcctaacgaacacggtgaaaccccgtctctactaaaaatacaaaaaaattagctgggtgtggtggcgtgcgcctgtacctcgggaggcagaggttgcagtgagctgagactgtgccgctgcactccagcctgggtgatggagcgagactctgtctcaaaaaaaaaaaaaaaaaaaaaaaaatatatatatatatatatatatatatatatatatgtatatataatatgtattatatatacataatgtattttatatttatatatattttgagatatatataaaatacattatatatatacataaaatattttgtgtatatatatatatatatatatatatatatatatatatatatatatatatatatatatatattttcagtgttcatataacaaatttcttttgagagctaccaaggaccagacttggtgctgtgggatatttgataggtgtgagacagtcttttcctcagagggtttgtatcctaggagtagggataatgataactgcataagccacctgattgatctggaattggatgcaacttttactacaggaattgacataaggatttagacccttttccagtacattgacctagtagtattaacaggactgtggcaactttgaacttccctaatgagaaaaacatgtgttggtgagcaggtattatcacatcttcccttgcttttctgtttaaatacagtatcctattcagataggcaaatctctgatgttttgttgagtgaagtctatgggccagatcacataatagatgatgtgtttgttggttgcccactgattagcttgggacttgttacctagaggtccatggcccttctgaagtcttcattatgttgttagtttcccaaaatgatccgctgacacttgttctaaatatggtttattttttgcagcttaatgatttacttatttgccaaatactgggatttggtttcagagagcatccttttctacctccttgggtatataggccttgatttataatgtctagttactctgtcaatgaatcagttagtgaccattttgagtgttaagagctttgagtaaagaagtgtgtgaaaagccttctgccaccaggaagcttgcttccctgtgcctagtctaaaccaaaagtcttcaaacttttttgattgtgaaccccagttggacaaatcacttagagtaagcacctcattttaaagttttatatttatactactgtactaatatatagatcagaaacataccgaattagaaagtaataaagaatgagatgcatatttatttatttacttaaacttttattttagattcaagggatacacatgcaggggtgttacctgagtatactgggtgatgctgaggcttggggtatgaatgaccccgtcacccaggtactaagcatagtacctggcagtttttcaactcttgcctcctccctcccacttctgatagtccccagtgtcttttgttgccgtctttatttctatgagtacctagtgtttagttcccacttacgggtgagaacatgcagtatttggttttcctgttactgtggtaattcgcttaggagaaaaacacatttaaatagacattataatgcagtcttacccctcagtggaacatcctacagaccactggtgtagacagaaagtgctagaggggtgcttgggagagagaaatcatccctgaggcacgtagtgaagaatgagttgtgtgcaggacatcaccagagtcatggcaggccgtggagaagatatagttggtaccatcttttggtgtaagcagcagggagccatggatcttcctaggaggagccacaaggtagaagtggccatgccatagatgcctgcatagcatagtgggctggggtagacggtggggggcatgtgtgtaaagagagaatgtgagggagacaggttggtatcctaatcctaatcccacagcagaatagaaaggcaaagaggatggtggtggcaggtagggtgaggaggtagtgaatatgtggacatttcctgcatgaccagaactgctaaggaggaagtgagtcttgaagtctgctggacaaacaatggtttgtagtaggagaaccctaaggtggagggagcggggaggggaaggactggccacatcccaaaaccttattatgtccaattttactgcagctgttttatgactgcaacatttttgttcaggaaatcgtttatttacccccacaccttttcttttagactaaatgacaagaaccagtgctcacatccagggtcaaagctaatctttgaggaggtggaaaacgcctccttgtttcattgtctctcttgaaagtggtgtctccctttcactctcctgcaggagagagatgtccaggtactgcctaagcagccccagtgaaaacggatggttcttgaggcttccagaggtcaatctggcataagaagtaaagaagaagccacatgactcggagaggcagaatttctttccttggacaggatagagcttttaattgaatccaaatcacatctctcatcctgtgaatgctggagagcagtacatttttaactaggaagagcatcaattatgtattagccacgatactaatttaccctgagtgtgtgtcttagagctggctttcatctctgcatagccactgatgtaatgccattgtgtttctatactcaaccagtcgctcttaagatagggtgtcctgctattgaaaagagtagaaagtagggattgctattgctgaggctctttctgtgttcttacagctgagggccctttgggataccaccttagggtgggagagctgttcactcaccgttgtgctttgagatgcagactggggcttgtccttttactctgatgctgctgctttatcagttatttggtattattgtgttccaggataaatctctggaaccctcagttatagatatttgagactttctgtgtgtgtgtgtgtgtgtgtgtgtgtgtgtgtgtgtttgagacagggtcttgctctgtcgcccaggctggagtgcggtggcacgatctcagctcactgcagcttccctccatcctgggctcaagtcatcctcccacttcatcatcccaagtagctgggactacaggcatgtgccaccatgcccggctattttttttttcttttttttttgtagagacgggattttgccatgttgcccaggctgatcctgacctcctgggctcaagtcatccactcacctcagcctcccaaagtggtgggattgcaggcgcgagccactgtgcccagcctgagattttgaacatttgcctccagaaaatgtaggcagtttctgtggctgcttatttcctcgccagtaatatattttgcttgttcctagagtactaaatgtaatgatgaccaaagtggactgagcatttcctagatcttgacactcttctaagcacattatatatattaacttattaaattctcacaaaaatcctatgaggtaaatactattatcatccctatgttacagatgaggaaaatgttaaataacttacctagtgagtgtagcataggctctggtgtaaaaagctgattcaaacacctgccttgccactgtgaatcacggccctcagtcctttcctgtgaaaaattgatttttattttttttgagacaaggtcttaccctgtcactcaggctggagtgcagtggtgtgatcataggttgctgcagccttgacttcccaggcttagacaattctaccatgtcagcatcctgagtaccttttaattttttagagagatgggatttccctatgttgcccagtgtattagtccattcttgcactgctacaaagaactaactgagactgggtaacttataaagaaaagaggtttaattgtctcatggttctgcaggctgtacaagaagcatggttggggaggcttcaggaaatcttcattcatggtggaaggtgaaggggaagcaggcacatcttacgtggcctgggcaggaggaagaaagtgggggtgggggtgccacacacttttaaacaactagatctcgtgagagctcactcagtatcatgagaacagcaagggggaaatccgtccccatcatccagtcacctctcaccaggccttacttccaatactggggattacaattcaacatgagattttgatggggacacaaagccaaaccatatcacccagctgggaaaatggattgttaatagtacctgcatacagaattgtggtgggcatgtgattttggcaggtgataagctcttcattagcattcactaccacagtgaacaccaccatcctcctcctcatcatcataattatctatccagaggatcatgtgagatgcttcaaacccctgactaaggcaatctcaaaggataatttgcctcaggtgtcagaattgtttagctgtacttgcctttccttgcaaatataatggcagaaaaagaggaaaatttagacattttgagccttttcgaagcgggaaatcaggtaagatattttcagatagataatttgttttctccttgtgctcttatcacttccttcctctttctctcccacctctgagaaccctggatgagggtagatgaagtagaggagagggtggtgacaatggtggtaaaagaaaaagtaaccaccaaacatgtacagaaccactccagcatttaattaaagcctgcagccctttgtcagccagaagctcctctcatggtgagagaggcagagagccttgtcactgtctctagaattatttgtataattcagcagctgtttccctcagatgcctaccacacgaggttggattataaagacgtatgagtagaatcgccaaggttcagacacttgtgttcactgttgagctgagagccacttaggctgttcttgtacaaatgcattagattatggttaagcagcttatggacataaaaacacattagaactttacagcactctataaattatagtttttgcagcattcacagccacaatgctaggtaattacattcattaatctactagtaagagcacataaagttgcctcccaaaccttactgtatgtgtcagtactcagctgggaaggagagtttttttcctctcctttttccccgtctttccctgttccattaagccttgtgtgggaagatttttgatgttacattgaggtgttccctaaaagaatccaataaacccattttttttttttaatggttaggctctggcaggaggccttgtaggtaatattttcatgttgagctgcacctagtaactatttttgtatgcatttattttctttttggaaatggacagatgtctcatttggaaagccagcaagttaaagcagttgaaaagagattaatgatagaatcagtggtaaatgctttttcaggacttctttttgcctctctctggtagcagttaacatgatggtccttttaattttggatctatcaggagtacaaagtattgctctcttcccatgccaaactttcctaaagtttccatctttccatatggtgataggaaatgcctccccccacagccctgtctcagaactttctcttatttgcatgtctcataaattacagaaggcagatttaggaagaaatgctggaactttatatggtgctagtatttcaaggagcaaattgtactttcttcgcattatttctcaggttaaatagaccaagtggaccaggcgtggtggctcacacctgtaatcccaacactttgggaggccgaggtgggtggatcacatgaggtcaggaatttgagaccagcctgccaacatggtgaaacctcatctctactaaaaatacaaaattagctgggagtggtggtgcacgcctgtaaccccagctactcaggaggctgaggcaggagaatcgcttgaaactgggagacggaagttgtagtgagctgaaatcaggccactgcactccagcctgggcaacaagagcgaaactctgtctcaaaaaaaaaaaaaaaaaaaaaaaaaaagaccaagtgataggctgggcgtgctggctcatgcctgtaatcccagcactttgggaggctgaggtgaaagaattgattgcttgctcaggagtttgagaccagcctgggcaacataatgagaccccatctcaatgtaataaataagtaaataatttttttaaaaagtgaaaagaaaaaataggccaagtaatacagccatcttaaaaataaaaacaaaaatggaatagagaagtatgttaacctgcaaccccaaggcaacactataagtcctgggtcatgctcagaccacattctaggcttctgctttcagttctgttcacatgaatgagaacatgaatgctagagccacgcaggtctgtgttgagtcctggtattgtcttttcatagctatgtgaccttgggaatattaattaatagtaataaaaataattaatttggactgaactcctaatacatcctaggcattacattaactaatttaatcctaatagctgcttcataagttaggtgatattattcgctccattttatatatgagaaaactgaagcttcacagggtattgtagtaattaaatgaggtattataaataaaatatccagtatgttgcttggcacattcaatgacactcattaaacacaatcttgaggatatatggagaatagatcccaccattgttcctccaatgccaaatgtaaccttttagaatgacagtttccctttttaatgacttaccagtcattaattgtatcagtcaggaagaggaattcctcacatttatttgtaatttatttactgcctgtaccaggaagtatcccaagcactttccacaaatttcattaaactttctattcctgtattccaggagaagaaatggaggctcataagggccaaggcatttgttcatgttcgtaaagccagaaggtgggaaagccagttctcggactcagatgtaaccgccaccaataaagagtagggatagcagtgaagtggtctattttcctggaatgaagcttctatggtgggaagtaatctaagcaactgattaaggagccagctttgtgcacttcaaagcagcctcagcttcggggtggagcatagagttccttttttttttttttttctttagcaggcaggaagatattcttattcccaaagaactgagaaatatttgagactatccatagtactcattggtgctgtaaggttagataactgctgagaagaaaactgattgctctgtgtaaatcagtatgctgatgagggaatgataaaactgcagggtagtaccagcgtcagcatcttgtttccaacccagctcttctctctcttgacaaaacagctgtcattttggattaatgttgaaatcaccagaatctgctggtcatcagagcagggccgatgccatctttgggatgaagtgtgctggcaacaagatagaaactggacatgggaaaaaggaaagtctccctcaaacatgctgccatccaaggcccagtttaaaccacaggctcaatttttgctcccaaactgatttcccgactaacccatctgctcatgcacacaccctcccaacctcacacagcaggcctggcctttatcatttcaggtcctgcagagctgttctctctcactgtggtactgatgccagttttaacagccgccatgtgtattgactcctctaccgattacaaatatatacgcgtttgccagtttgtttagtgagtggttttcataggctgtgatggggatttcactttcatgaatataatttgctgagcctgtggtgacatcaataaatccttctgggatggggaatggttgatttccctacatccagatgacatcctccagcccacttccttatgggaccaacagccaatgtcataacacatgcttctttgtgagagcatggaaggaaattgtttaaagtgtgtcatctgtgggcacagtttctaaggtagatacctgtgaggatgtataggcatgctttagacatggacagaatgagttatgtacttagtaactcaaaactctgctgagctcattgtggacagctcttacagataaactaaaatgcagcttcttaaaaaatgagaggacatttgcagaaagcattcttactgctttcagcaaatctatgtgccttatgtttttatatagcagtcattttctcaaatcagacatccctattgcctattagataaacacagaaagcatagattatgagtttaaaagtatcgacagcatttcaagtgctatcagagaacatttaattcagtttaattttgtgataaatctcacgtttaatcctctggttaccctgtaatcatgtctctattgatcttttctgaatgactgcctgcagtttaataaactttgccattaacccagagcttctaaaaggagagattgattccattatcaaatctgatagaaccaataagtacctaaacatcactaaatctatctataggaagctttggcctagagacaagcctgtggcttgtttaagaaactaggtaaaaatctggatatctttgcatgacctaattgcctcacagcatctgattcccttgtgcaaactgacactgcctttcatctttcaagtcaatgtagtagccaactgaaaggacagtctcttttcttgcctcaaccgtaattgtagggtctaatttattctcactgcagatatagcttgaggagtttatttggtctatgtctcaggtcagtgggtatatcttaagcacttttctgtgtctctgaaaacctgcaggatagtttgttttatttttacctatatgatgccaagggaaagaaaattctgtctggataaatcctgaaatagaagactgggggtgaagattgagagagagggaaggcaagtacagagtcatagctgtgtgaacaagctctaagacttggaaaactttccatgaaacccatatatgtttctcatgtagtgataggttatttgcaatatgtgttgaacaggaatttctactttttgtgccgcgagtatttatagctttcatcattattcattaatatttattgagtcacataggcagaacatatggaattcagggtctagagtatatttacagcttcttatttttttaaggtcagaaaggtgtcattccctgccacttttcacctcttaaataaatcggtgaaggttgtcaattttacagaaaagccaaagcttttattttctgtctagatttttattgacaatgtgaatttttcagaaggagttcggctatttgacttaggaggcatagcctttccctaattacacttcggtggggaagtggaggtgcacagaaggatttttataatgagacaatactaaactgtaatttaaaatttccttccaacaaaagaccctaatcttggcacttagaaataaatctgtaatgacgtggtgttaggcagtggaagcaggattagagccaagggactctgggtgtgttgccagttgctgattttctcactttggaaagtcacttgtttacccagccttagtttcctcatgtataaaataaaactgatggtgcctgcttagagagctattagagaattcaatgaggtgattattttaaaagatactgtaaactttttccaatgctgagttgttgtgcagacattaatggttatgaaaaagataaattagtcctcgctttatattcagaaatggtctgacctttcagtaaattatgtttagttcttaaatcaaaacccagttaggacaagagagcttgaagagtacgtatacataagagaagtctcacagagatatttgaaaggctggaaaatgtgctctggaggcaaaccctccactgaattgatgaattctaagttacatctgttgatattttttgtgtgctaaatagcctcccagtatggtaacattagagaggctgaaggaacctaagaggaggaccctacatttataggtattgaggtagattggtctctgcccttgagaagccaatcaaaattaggttgagaaaggatgtagcaattgttcgtggaatactaataggcatatatgcacttgttcatgttgattctctatgtcactgctctgtaagagaaggaatgcctgcacatcttcaataggaagttgacaacagtttctggaaagttggaagaaagttacagaattattcctttagtagtaattattccatagttctctagaaacatgacaaaacctcttgaaaaacttgagtcataaaaggactgcctcacatatatacacacacttcctgatatgctgtgtaaaactgcgtttatattcagagccacataacacaaattttgccagaagttgctttttataccactgaatagctctaaactttaaattgtctttcataaaattgtttcttgtctgctgagtggacagaatgtctctctcttccccacccttcatatcattttgttttcctaaatgggccactctgtgaagtagttctttacttctagccaccacccctgcctctagaacaatgcaaccaaccttaaccaaagtcacatatcaagagttctctgctgcctgttaatgcagatttgacttctttgtgtgtgtgtgtgtgtgtgtgtgtgtgtgtgtgtgtgtgtgtgtgtcagggtctcattctgtcaccgaggctagaatgcattggtgtgatcatggctcactgcaggctcagtcagtcctcctgcctcagcctcctgagtagctgggactacaggcatacgccaccacacccagctaatttaaaaaatatttttctggagactgggtctcactctgttgcccaggctggtcttgaactcctgggcttaagccagtccacctgccttggcctcccaaagtgttggcattaaaggcatgagccaccgtgcatagccagatttgacatcttaaaagccagagctagacatacttattgattgtcttcctggggccaggtgcagtggctcacgcctgtaatcccagcactttgggaagccgaggcgggtgggtcacttgaggtcaggagttggagaccagcctggccaacatggtgaaaccccgtctctactaaaaaatacaaaaaattagccgggcatggtgatgtatgcctgtaatcccagctacatgggaggctgagacaggagaatcatgtgaacccgggaggtggaggttgcagtgagctgagattgtgccattgcactccagcctgggtaatagagcaagacttcatcaaaaaaaaaaaaaaaaaaaaagtaatggaaactcagagaaggttgctgaagggaagctagaaggcctcctccaggacagagaagtaatcattttacacttatcacttacggtaactacaatagaatcagtgagctagttgctgaatacttctagagacattgttcacttaaagtgaaggtgtgatagtatgtgaatacctggggaagagaagaaagcgaaacatttttaggaaagaaaaggaaagtatgtgacttattactaatcaggatcaatttgaagatctgaatagattttcactggctaatcagagttattctgtggaatatctgcaacctctgcaaccacttttgatttttctgtgaatagtgaggtactgagatccagtaaattataatttggccttgatatcaagccatgaaaaagatgtttagaactaacattcattggcctctttcatttttttttctcttggggttaataaggcgatttatgttatttctaggcatctgttcatcccctctttagcatataggggaatagaaatggtttatccgggatatggatgtggtaatgtgtcttagtctgtttttgtgttgctacaaaggaatacctgaggctaggtgcagtggctcatgcctctaatcccaacacttggggaggccaaggcgggaggatcgcttgaggccagagttagagaccaacctgagaaacatagcaagaccttgtctctacaaaaaagtaaaaataaaaacaagaaaaaggaatactagatgctagtaatttataaggaaaggaggtttatttcactcatggttctgcagactgtacaagaagaatggtgctggcatctgcttggcttatggtggagttctcatgtggcttccactcatgatggacggcaaaggggagtcagtgtgtgcagaggtcgcatgatgagagaggaaacaagaggatggggggaggtaccagtctctttttaacaaccagctcgtgtgggaactaacagagtaagaacctctcttagttctattagagttcgacatgagggagggcattaatctatttatgaaggatccaatcccatgacccaaatagctcctcttaggccccacctccaacattggggatatatatatatatatatatatatatatatatgtatggttttttaaattattatttttttggagacagtctcactctgtcacccaggctggagtgcagtggtgcgatctcggctcactgcaacttctacctcctgggttcaagcgattctcctgcctcagcctcccgagtagctgggactacacctccacgcctggctaattttttgtattttagtagagacggggttttaccatattgcccaggctggtctcgaactcctgagctcaggcaatccacctgccttggcctcccaaagtgctaggattacaggcatgagccaccaggcccacccattggggatatttcaacatgagttttggaggggacaaataaactataacagaaataattagataatgtgtttgaaagtcttggatggaagtccgagaggggaagagtgatggagtagtacaattcatagcatggcccaacagcttcagaatgagaggacattcagggcatcctaatttcacaagttcattctcctttaagtttttgtttttagaaatgggctcttgctttgttgcctagggttctcaaactcctgggctcaagcagttgtctagcctcagtctcccaagtagctgggactgcagccatgcactaccaggtccagttctaattcattcttttataaacaggttactgtgtgtcctctactctgttctctgctaggaattctggcatgatgaagtcatagccattgtccttatggaggtaattctgagtattaccaggaagatccagttaccaatattttgatacactgtaataagtacattaattcttttcctatcttttgcatacagtgcttaatcaaaaaatgaataatggttgtttcaacttactttaccatcagcagtgtgcagtggttcccatttttccacaccctcactgacaagtacctcttgtctttttgataatacccgtcctaacaggtgcaagatgacatctcattgtggttttgatttgcatattccagatgactaatgagcacattttcatgtacttgttggctatttgtatgtcttcttcggaaaaatgtctagtcagattttttttaaaaagaacatattacatgtaaaaagaataatggttaattaaagcaagtatcattagaattacacatcctctcaaatgtgtgcgtgtgttactttagtggattagatttaagtgggagaaaaagcaatcgaaatttgagtgttctgcttgtctttcttcagttagcataccaggcttctgcccttggagaggcctgagaattgtgtggtgctagtttctcttctggctgccattacactatcttctgttgtatggttctttttgcctttttggactcgtcctttgtgtacgttattgccctaagccctcactgatgagattttctgcctcagtcatgctgtgctcagctttcagaatgttgttgttacggaggagttaattttttttttaaggtttccttttcgtcatgctgtatttctcagattatctggagggactgtaatccaattttaggaatccttcagggctgagagcctaaactgttttaagcaatagcatctggttgccagggactcaactactttgagcgtgttaaggtctaacggcagccaactctcaattatctgtgggaatgggagactcctgggatgttttcaattcacagagtgtgcaaaaatctcacttaaacggatagtcgtgacctcatcccacagctgagtttaggagagcttctcagtgtgtggttttgttttctttttgttttgttctcttctcacctttgacagtggcactgcagcattgacaggtgccttttatatgttgaatttatctgtacctgatctatttttttaaaccttgtccctctcatctttatttagattccatatgtgtatcattatatacattaagtatgttttaataaactgcctcaattcttttacattttaggagcagtaaaatttatttatattttctttctttgcttattggctaacgtgctcatgggaggggatgtagccaaacagtaatcaggctaccagatagaaagataagaaaactttacaaaaggttagcctctgaataataattgagaactggctgttaaaaatgaaaaaaaaaaaaaaatacgaactctaccttgtcactgaaaatgaggtgaaggccaggcagtgctcctcagtcaagacattcgtgttcacaactgagttgtctccagtggaaatttcatggctactttatggcctaaagccagtgctcccagacgtggtcatcccttggttttaggattctaaaagatgagtttcttttaatgaaaactgaatgtaatctagttgttagggataattatatgccagttgtgcatgacggcaagggcccctggtttttaaaaaccagctttatggaggtataatttacattccagtaaactgcacaaactaacaatatacaatttgatgagttttgacatgtgtatatacccatgaaaccactgccacaatcaagacagcgaacatgttcaccccaaaagtttccttatgtccctttataatcccttcttcctatctctcccaggaagccactagcctgcttgctgttgctatcaattagttcatatttcctaggattttatataaatgggatcatacataatataatcttttccgtctgatttctttcacttggcatacttattttgagacgtattcatgccacctgtatcaggaggttatttctttttattgctgagtagtattccattgattggttacaaccacagtttgtttatccattcatctattgatgtacatttgggttgtttgcagttttagaagcattgcacatctgctaggagcattcatgtgtagctcttcatgtagacatgtactttaatttctcttagggaaatacctaggagtagaacggttggatcatatggtcggtgtacttagaacttttaaagaaactactaaactttcttccaaagtggttgtgctgtttcatattctcaccagtagtgtatgtatgagcatcctctgcatccttgcccactctcggtagggtcattctttcttatttcagccattttatatgtatgtagtggtatctcattgtggttttaagttgtatttccctaatgactactgatgttaactattgttttatgtattcattcactttccagacagatatctttttttttttttttttttttttttttttttttttttgagatggagtatctctctgtcatccaggctggagtgcagtgacacaatctcggctcactgcaacctttgccctctgggttcaagcgattctcctgcctcagcctccgagtagctgggattacaggtgcatgccaccatgcccagctaatttttttgtatttttagtagagacagggtttcacccgttagtcaggatggtctcgatctcctgccttgtgatccatctgccctggcctcccaaagtgctgggattacaggcatgagctgccacacctggccccagatatcttctttagcaaagtatctgaatcttttgcttatttaaaaaattgggttgtttccttttttagttttgagaattttttttttttttttttttaagatggaatcttgctctgtcgcccaggctggagtgcagtggtgcaatctcggctcactgcaacctccacctcctgggttaaagcgattctcctgctcagcctcctgagtagctgggactataggcgcgtaccaccacacctagctaatttttgtattgaccaggctggtctcgaactcccgacctcaggcaatttgcctgccttggcctcctaaagtgctgggattacaggtgtgagccatcacacctggcccaagaatttattaaattaatatattctgtatacaaaacttatcagatacacattttaaaaaatatttttccattctgtggcttatctatttatgtatcttttactctcctggtaactcacagaacagtcactttattttcttgacagtatcttttgaagagcaaaattttaattcttgaagtgtaatttatcaatttattcttttatggattatgcctttggtgtcatagtaagaaatcttagcttaacccaagattacaagagttttctcttagaaattttatggttttaggttttacattcaggtttataatatagtttgtgttagttttttctatttagattgaagtgtggattaaaattttgcatatgattacctattctatcaccatttgtttaaaaaacttatttctctgtagaatagcttttgcctgaaaatcagttgttgatatatgtgtgggtctctttctggactattctgttcctttgatctgtttttctatctttatgccaatatagtgatgcaattttaatgtggtgtgaaagatggcactacagagcacctgacttgctcctcctctaacctactttactataatagttcactgattagcctgtttccctggataagcagcctgagtttaggaattctttcttagatatttccaacagatggcaatgtgtatgcacatagtaggtgttttgatatttgtttttaaaagatgtgaatcttagggattaatgtttgaatgccatcctggatgccttgtacattcctacagatagtagtcttctctactttctaaaaagtttaggctctgaaaatctgttcataaagtccatttgctcaaaagtccaaagttggggactgttgtgaacatatctatctagttactagttttctaatttttcatttcttatcactggagactcattattggtagaatcagtgtttgtaaaaccattcaaaaacaagtacaaatggtatacaataaaccagcaagggacttgacagaccaaaatgacaggacacagccattatgtcattgtgtcattggggacaggcaaagcacttttttctttttctcctggcttgttattttctttaaggtctctaagatcagataactaacagaagaggctcagtttaaattgcaagcccctcacatacatatacatgcatttgggtgcatgcagacacatataccacaaatactttgtaagtgatggactgccctcaggttagtttgcttggaaaaatcaggcggagactttctataacccacttcatgcaaggcagacaaattgtgccctcattttctattgtctctggcttcatctgtaatcagcaaatggagccctgcagcttacatagtgtttcatctgctatttgttactctcccttagtttgcacaacactgaaccatctcattttgaaattcaagagtggcgaggaggcctttggtggaagattgtaatttgggagaagggaaagtcaagagcaagatcgcctattttgaagaaggcggggtgttgaaggaaattgcctttgtcagtctctgagcctctccatatatgtgctactgtgaccctgccctccatcaccagtgacctaaaaatcacataatttcaactattctccaaacctattcacatctgttgtgcatggcttgtacacttaccccctctattgacagccaatatgtctaaatctttttgcctctcagccagcctcttgttggtggctccctggctttcttgccttctttcctgcttcttctatgactgtcaaatgaatgccttaaagcgttttttttttttttttttttttttttaacagatttctttcttatccttctgccctcctgcctttctctcctagtgcttgtgtaagggaggcagttttttttatctttaccctgttagggtctctagctgaggctgagtattaaattgatgtaaaatagattaacagaagaaaagcatatggattttgacacatatataggagcccccacaggaaagtgaagacccaaaaagtggcaaatcttgaatccttatttagtaggttgaacagagtggccgttgtggaaaagtaactaaaataaatgatgtggctaaaggaagataagagttagtaagatctgttggtacaaatttttctggactccccatgtctagaaacgagaaaatttcttctttcctactatagggagatcatctttcacatgagagttttttcccatctcaggtgtttctggtgataatgtttcttttctcctatctcttttgtttctatttttcaagtgcctttagctttaaaataatccttaggcctaaatagcatgttttggggtggcgtgttctgccactcttcatttgctcatgctttccttgcagaatatggactacaatcatcttattttcaaaaaattcttcaggtaattctgatggacagtttctcttgtgaaccactatcctagatcatggtagacgaatgaatcaacaggcctttgaaaattgccattcattgatcccaaaaagtttttttatataccagataatttccctccccatattatagcaatactagagactgcccaggtttccttaaggaagttcttaaattagtgctactggttggttggtggtggaggaaagcattggtgggtgtatatttacaaacaattacacaggcatgtagtcatgtacacaactcttgtgactgttgataagatgattagtttatgatcagtctttgtctttgattcttaatgcttataatggatagtttttgtcatttttctccaagacagtctgaaaaaattaaatagttattttactttataaatggtaagcagtcagtacctgtttatagagggaatgaacaaagagtggtctggtttattcaggatttgtaccaaaaaatctatatagtaatttataaataaaggtagatctttgaaaaaaataaagataatctctagtctctgaaaatataaacctgttacataataaaaagttgttatagactcttcatttcttcttacctcttaagccaccacctctagacacactttgatcctctctctctcttcttccccccccccgagtggaaaatctcaatattaattggagctaagatgattgtactactgctgctaagacttcagcaggtctcttacaagctaatgtcacggcatggggtccatttgctctgtgtagctattctgcagtgcagtgagaattccttgattaatatgctacatgaaaataaaatggatttggaaaaaattatagcatactctcataaatattaattcacatttgtatggaattacacataattttcaatatactttggaagcaccttcagtatgaaagatttggtctccaaagagaatggcataatttttttaaaagcacagtggatacattattaagcatcatttgtttattaatctgatcctctacatgcatatgatgcagggcagtaggtgggttgtgtgacaaagaaaggagctttataccctgtggggagtttttatattacacttagaagtggtacaatttaatcacattatatagaagcagcccatgatggaactcacctggctccctctgctagtgttgccattattcctgagtgtctctttatggcagctattttggttaaatgtgagactaaacacagaacatttttgagctgagcagatgcctggcatagctgactgaggttgtggacactggacaaaggaattcaattcagcagccattcattgaacatttactatgtgttaggcatagcatgcaaggctgtgaaatcaatggccatgtgcgcttgctttgatctcgacttgtcccctgaaacacttttcaccacatcctcattgcctcaggagagctacctctccgatggcagagggttaatcgtctgcagtggtagcagctggaagttaggccagaagctgcttatttgccttgtggactgttatctttgatatcttcttactcttaaggataaggcctttccccttttctggggtttcttgctgtttgctgtgatccttcgtgtataccagcagtgcacactagattccttggtttcctgcttctatcaccctttctggcttgctacactgtatgttagagacagcttagactattttaaagtcagtattgtgctttataggtttggatgttttaactagttgactcctttatttatgtatttattgactaatacattggccacctactatttgcctggtttatgtgaagtacttatgtgaagcactgggattactgagatgaactacttagtccctcccctctttcacattctttcaagagattatgcacccagctgcctcaaggcctttgcacaagctgttctctctgttcagcctttcagatctaggtcaaatagcagtcattttctcagctctaaccctctcctctggactatatcatttcccttagttttagcacccataacctatcctttagcgttgttaactcagtttgcaatgatatatttgtgtgatttgattagtatttgtcctgtaaattctaggctctatgagggtggtgacttttccccacaccattatcatcctaaacataggtcagtgctacattggtacttggcatgtactgggcacacaaaacataattgttgaatgagtgaagacctgagaatagagtactttgtattacaagaaaggtctccctgagtgggcaacactgctaagagtcactgaactagaaaagggaggagtgtgtaagagaggccttttgaggccaaggcaaatcagtgtaaaggcctgcgttagtttgtccaggctgcattagcaaaatgtcataaactgagtagcttataaacaagaaacatttatttctcacagttctggaggctgggaagtccaaggtggaggcaccagcagattctgtgtctggtgagagcttgtttctcatggatggtacctgttctcacatggtagaggggcaaatagactcccttaggccctttataagggcactaatccccttcatgagggttccaccctcatgatccagtcaactcccaaagtcccccatctcctggccaacatggtgaaaccccgtctctactaaaaatacaaaaaaaaaaaaaaacaaaaaaaatggctgggtatggtggcaggcatctgtaaccccagctactcgggaggctgaggcagggaatcgcttgaactggggaggcggaggttacagtgagccaaggtcgtgctgttgcactccaacctgggcaacaagagcgaactctgtctcagaaaaaaaatatattctggggagacacaaacattcagatcataacaaggctcaaggtctcagactaataggaatggctgatttggggagagatgtcagggagtaccatgcatgtaaagttgggagtgctgggatattgcagcagaacagtgagaaaattggatgtgaaagggaggaaagagagcggtattttaaggagaaatgagtaaaaggaaatttctattttggttttgttttatttttaaatgtacatttagatagtaaaaaatttaattgttcatttaaaaataactaaaataatataattggattgtttgaaatacaaaggatacatgtttgaggtaatggataccccatttaccctgatgtgattattacacattgcatgcttgtatcaaaacatcttatgtaagtcataaatatatatgccgactatgtaccccagaaatgaaaaaatttttaaaaagttcatttaggactgcagaaactgaggaagtgtggtaaggcttcatgagggggattttctgtgtaagaggattagatccactagtttccaaataactgagtgccaaaacattttcattttattgcttagtgtgtgcatcatttctcacagggcagaggatatttgcatgtatgtggtttgtttgatgttctgagagcccattttgcacgtggtctcagagttgtagtgacttactccacttctgataatgaataatgtcagtgtccggacactaaaagcccagtctgttggaaccttggtgtgtactgagctgcctggaggcacagaactcttatcaggtcatgtggcctgaaatgcttacctgtagtttctacagatgcagttccccattcaaggacattgatttcccatttcctacccacctcccctcatccccaaccacacacaggaataaattaaaagttgctgttgatcttggtgataatattgttgttacattttgcaaagaaaatggaaataaaggatgcttagaggaacatgtaaaaaaatataatgcattaaggaaacattttaatcatatgaatagacagttctttcttgctggctcacatccacctggacctgataaattcagttgggtgctatttcttttgaattgagcatgcacttagtgctcattttctgaaacataattgatgtaccaacttgggaaatgagtgtattgcacttccttggggaaggtcattgtgtgctggacccagcaccaaatcgaacagaaagctgctatcccagggagcagtgaaatcacttttgatgcatatacttgtgttttgtttagttttctgcccagtaataatagaaaggatatatatatttgtgatggcattaaggattcaggaaaattgagaagccatgtttcttagttttgggtcttctcatatcccactttcctatccctctcccacttagtagtaacaccctttagtatttagcctatattttgggtgtgaccctagatacctttgtaaccaccacttccctttccttctcttcttttctacagaaagatgtagcacttaagcctcaggaacgtgtggagaaacgccagacgcccctgaccaagaagaaacgagaagcacttaccaatggcttgtcctttcattcaaagaagagcagactcagccacccacaccactacagctcagatcgagaaaatgaccgcaatctctgccagcaccttgggaagagaaagaaaatgccgaaggcactcagacaggtgaggaagcttgggttcgctctttcctgtggcggcaaaatcccttccttaggtgcttcctccactgtggtttttcgtaacaggtggagaagatatccttggtgggatgctgaagtggttgtccaacaaagctgtgtgcgtgcctttaaaagaatctaaaacccaatctcagctctttctatgaggatttgaaacttcagcatggtgccctttcagtcagatgtgctttatgcaacaaagcttgatgctaagtggtactggtatttagggcagacctgtcttaacagttgtcaagatggactggcttgcaggggagagatctttgcaattaggataaatggaacaggtggatttcatcacatacattgtgcatctcatggttctaaggtgctaaaatgattgcctgtgtgtgagaaatgccttgctaagatttatattttccggggaagctcagatattgtggcatctgggagggcaatggcaaaaaatgaatttgccttttggtgtcttagttgttctccataggctataattcaagactatctttgtgatctgttgattgtatgaacgtctgataatgaggcttactggcctgttaataattaggtttcaatgatccacaagaaagtatggctcttggcatttgggaagcctttctgcctgtggaaatccccacatgagatggattaataatgagatatgaagctgtttatagcagtttttctgcacaaatccagaggcttcagtgcctgtcaagttagttacctgtgtcctgggtgtgttttatttatttttggcaggaccattgggtaggattgactatcactgaagaaagcagaggaaggaattgtggtgtacagagcaggtgctgctaattagaggtggaataggtaatttttggtttgcagatgtttctctgcagaggcagggagatctgggatcaaacaaaacaatggttcccaaaccacacagatcttgagaatcatataatgagagctactaaacctaaatttctggcccctctttaggacctaatgacatttgtagttttagaaagtttcctatttgaaaacagtcagcctggttggaagtcactcttacaaagaatcaagagtgtatttgggtgatggtttttagttaaaagattggaaagatcaaaagcctcaatatgatgtagtgggcagtttggtgtcagaattctgccttatacgtagtgaagcatataatcctggtaaaacatctggggtgatgggtttcagatggacccagaaggcttccaaggtaatgcctaaatctgacaaccagcacagtgtttccaaaggtacacttgtgtcctgaaacgccagactggagttataatagtaattattaacatttacctaatgcatactatgctacattcagtgagggagtttttatagtataacctataatttgtacaacaaccctgcctagtaggtaatatcatggttacttaacagctatggaaacgagggctcaaagagataaagtgacttgtctgaggccttgtcaatgagggaaggagccagggtttagacccagatatctctagttccgtggtttgttctgttttccatatttagatgaagttttatttatttttttcttgatagggagttggggagagggaggaaagcctaagttctataaaaggtgatgttcctgtggtatttgtgactcctaactcatgcctctgtgtgagatatgtgagaaaagtaattaatctcagtggagagagattgcaatgtaaccacccccctctccctcaggcccccgccccagcagggtaagaaggaagccttcttactctgagttaacaccaagctgcggatcctcatccttgaatctttttcttctagacgtgatctgacttttctattctgtgtcctcagaattattctttgtatttctttctacttcttcgagactttcaaggtcctctggtgacagagttttatgatcggaaaagaagactaagacgtaacacatcttaaatttgagtagcttttggtcttaatggccaactctcttgtactaatggtatttgaaatcaaagctatctttgttttaggtaacatatttgaaaagcaagtattttgactctttatgaatcatggagaaggaaagcatgaattgtatctttggccctatgtaaaacttttaaaaacaaggagtattttcttaccttcagtgttgatgccaaaatatgttatccaatcaagtgttatatttctagtaagaaggaatgcagaaggtgataattgagataaggccataatacttctcatttttaatattcttagaatcacttgtgctattatgaaatcccaaacaagtcaccatctggtaacagcccatctggaaaatgaagggcttggacttgaatgtttcttaggctcctccctctgggtcccatagttttttaaatttatgaataacacaaatacagtgttgtaaaggtctgtaaaggagtctgtaggtctgaaggtaatgccgttttggagtcagtctgtaactgataggctctgtgaagacatttatttatttttaatgtttttttttctttaaaattttgttttcatgtaatatgaagacatttaaaggagaagggtaagatgcatttatagtaggagggaggggagtggtccattgtgtgtcagtccagacaactgccatctgttatgtgatcattggtaaaaggtgacacatgagtgtttaatgaccatagtagatgttcaaaaagcttgtctgaagaatactcgtgattgctttcctatcatcctagatgcctgtaaatatcacaattactttatcgcctgcgtttgcctcttatcaggtaaagaaactgaatctgaccatcttagctgggaggggaccttgagatgagagtgagctttgaggagcatttctacattaatggattgtcatttagtgcctgttattgagaactacagatgaaatagggaagaggcgagaacttagtctttatttctgacttggttagaatgaattaggtttgcatcttattaggaaatggtacttcctgagcagacaacttaatgcacagctttcctgtaattatgggaagatgttactccttagtagagaggaaagaataggatttttttttctgagactccgttgaaggcaactgatctttttactcggagggtgcaattataatacttttataggaaagatgtatagttctaaaaccaaactgcttattctttcacttgcctggttgtaaaacccaagttcttgtgatgtttttccatactaccaaaagaaagcttttaaactgacacttatttgttggattatgtttttaagtataaatacatactgccttagaagatgctgaggtggcacctgtcttggcaaatggttgcactttttgatatgagaaatttgaatacttttcttacttcccaaaggggttaaaattatgaagaaatcaataaattacctcttatacaactcttatacaaaatagcgcatgtctttctgacctctgtaaatgaactatttgttcatgatgtaagcacttagacatgatataaaaaaagttttatcatttacttacaaggacatggtactttttttttctcaatggagatttgggggtgggaaaagcaaaagaggttgcacatggcctctccttaaggagctttattctctaattgggagaccaagtcacaatgaaaccactcaggaacacaaggaagtcaggtgtcgctaaaccgataagccaaattataacttcctgagaagcactttgggaaaacttaacccttcccagggcattgagtttaatttcagtatatctgacttctagaccatggagaattcttaaaaaatttaggactttgtagtttaaaacacacagagagcaaaagggttttaaaaatagagtaccaatgatgaaaagttgatgagcattcagagaactctcagatttggctctgactggatttctaaatctccatttagtccattagtctgtcctttctctgtagtatcaactgagccagaggaaataggcttaagtgagctagaaggcatttttaggttatatgaactcttctaacagacaccaagatgaatcatcaaaataaatcctgtggtctccctccttaactgaattttaggtgccaaaaagccattcatcttagggcagaatttcctaaagaaagaggcaacctgttgagattgctttagtcacaggagaacatcattttagaggaaaatggaggaatttgtgaatatttcaggagcctgttagtagactctaaccttgctggtaaggatggcttatgtgggaatgtcttatgtggtttaaaaatctttatacaagttgatctgggtaggtatttctttttaggaataaaaatttgctcttctctctctgaaaatccagtatggtgggagatttgtagttgacattgtaaactgtagacaccaaaagtgtctactgctttctaggaagaagaggaatccatcccagtgccaggcatttaaaattagagtgattactagaactctgcatggttgcatctgcttcatgtattgacattgtaccttggtcttccttggagtaagtgatagtggtgctatagacttaagagcccaggtgactgagccaccctctcttcccacctgtcctgatggaacagtctatcccagcccatgctctttcctgttgagagtgtttgctaccagaggctggtcccttatttcagcacgacttagacttactgcttttgtctgaagagctttctctaaatttgttactagtagaaattaacttgcaaaggaggatttataatggaaaactttgattaaacggatccagttcaagtctcgtttctgaagatctgctaattagttttggatggaaatctaggccaaaaatcacacaggtatttatccagcttgactctagagcctacaggtttctggaaatcagagcatttgagacacgaatgtaatttgggattttactgtcataatgaaaagacatgaactttgctatgtgctctttcatacatacttttgttataatatttagatgtctgctggtaccttgaactagtattaagaatgtcagttaaaccgtttctacctcatacttcaaaatttcaagtttaccatgttaattgggatttcatttgctttcgaaaaattttgtagtcatgtgaaggttacaagctaaggtatcaaataaaattctttatatttttttcctttttatgaatttaagttgcatactactttttccccttgcctaaagtatagaaataagaaaaactgtaaggaaagatggagggaataaaagattggcttatgatctctctttggaatattgattgacttgaataagagtgagatgctagttttaacatcaggtaattgaagaaccccaatctaggcttgtctgtgttcaggaattactcacgtattgtattggaagtattggtttgtaactgggattggtaaacctgacactaatataataatgagttatatgaaaggtgttttgcttttgttttatcttgagcatttggaaacaggtttattcgtgtttttcattttgtgtcttttgactctatactttgttgctgtgagccctgaatgttgggaatagtgagcataaacatcacttaacttcagtgagatacatctttggaatgttatgaccagtaataattttatcctaaatgacatttgtaattttaaataaaaatttagtaaaaattgactatgaaaaggacatagcatatgtattaggattctctggagagcaagtaccagtagaatatatatgtgggtagataagaggggattcattcggggaatttgttcacatgattatgggggctgagaggtcccataacaagccatctgcaagatggagaccctgggattcacagtatggctcagaccaagtctgaaggcctgagactggggtagtcctcaagtccaaagcctagagagcctagagtttagatgatcaagggcaggaaattatatcccagctctaggagagagagagagaccatttcgcctttcctctgtttttgttttatctggacacccggctgattgcatggtgcctgcccacatggagggcagatccttccctacttagttcactgagactcacatgccaatctcctctggaaacaccctcacaaacacacccaaaggtaatgctgtaccagttctctaggtattctttaatccagtcaagttgataccctaaattaaccaacacagcacattaactaccacctcataaaataaaacctgcagagagaaaataagctgaatgggaaaaggaactgcaatgaaaagaatgggccataattcagcttgggtgatcctgatacctacaggagttgttccataaaacagtgaccttttatatttcccaaagtaagaaaattttatatgtgtatttgtgcatgcagaactttattaagggccatttaaatcccatatattgatagaggagttaagaaagataaagtgacaggagtgattctcaactctggctcccataaatttctacaatgtcagtgattgaagaatgagggagcacatctttcctttaataaggcctagccagtacacttttggtagttgatgagggtaggacagaactccctttctttatttgaaactgtgtatttttgtgctgattaaattttacatttttccctcttgtgatgatataaagttatctgcatgtggccagatctcagctaaagaacatgaaataagcctctgtacattctgcattctaatctctgttcacagcaatcttgtatccacacaagtctgtacatgacaggtaatgagtgggaagtgggaggagatgggtgtctgtgtggtttgcactggtggtggtggggaactgagcagatggttgtgatagccacatgctgcgtgattcccgtgggagttgatggtggtgacaggcgactcacaatgtgctatttacagtttgggtttgcagtctttcggtgacatctgaatgctctttagcaactgctttcattactgcctttcgaggagctgttaattgaaaatgaaattgtgggtgggctttaagacaggcagacgcaggcaattctgtgtggtaaatgttgcttgagaactgttggatgtcttcatgcccaatttgtaattcattttctaagactgtaaaagccaaaggtgcatttggagattcagttatgtatatacataggcagagttgaatgtcacaccttgcccaaagggtcaaacatacagttattggtatgggtgctgtggttcacgcctgtaatctcagcactttgggaggctaaggtgggaggattgctttgagcacaggaattcaagaccagcctgggcaatatgatgagaccttgtctctagagaaataaaaaaattagctgggcatggtgacgcatgcctgttgtcccagtttcttgggatgctgaagtgggaggattgcaagggcccaggaagttaaggctgcagtgagccatgttcacgcaactgcaccccagcctgggcaacagagcgaggtcctgtctccaaaaaagaaaaccacacaaaacacctatttgtctggaaaccaacctaggggaatgcttggcaatcccagctgcctgctcatgtcttacctttgtgtagttctctttaaatgtatacaactgtgtgaggttcttatgtaaaatctgctgacatcttgtagtgttctctgtgagtttatcgtaggacttcatcctcctttcttcctttagctcttcataaagttactatgcaggagtaaatggttatttgttctcttgaactttgggatacatttttccttccgtatccaaggaggattctttccaggactccccatggatactaaaagctgtggatgttcaagttccttaaataaaatgttatagtatttttatgtaaccaacacacatcctctcacaaactttaaatcatctctaaattatttataatacctagtacagtgtaaaagctatgcaatttgttattatattgcattgtttaggcaataattacaagacaaagagcctgtgcatgttcagtatataagcaaccattgtaggccacatttttggtctgccattggttggatccatggatacagagggccaactgtatcatattcaagttcttacatataactttgtttcttgtaaacattttcatatgatacaactctgttaaaggcagttggagcccagaggcaaacaagagaagaaggaagagagagggtggattttattggactttgacagtggttgatgatcttgattctcttatggctgcccccagctgcaggattgtgatttgtttcttatcttcagagttgtttgctaaagcattagtagcattactgaaatggtagcttttgtaaatgtttatatgttgaattgttttattgcccatagctttgcacagaaatcttgtgctgaacaaggaatgacctccctcttggaagtgctgttaactctctttttaattaaatatgaatatagatacaatataactgcatttttttagttttcccttgaacatttcagtgaatactatctgggacaaaaccgtgctgaattatacgctttcactactatcactctttgctcttagagagcccccgaggcttggggtgaggagacacaccccttgctgtacttaaccctcagtcccattagacctgctttgccacaggaacccagctgttttaatgcatttgagttgctgttgggtcctaatgatgtttaaaagaacctgtcttggtattctaaatgaactctggagcattgcctattgatgcaagtgttgatgattttatatcaggcagatataactttgttatttactctggggctttttacacctaggggtgtgcatcctcacaccagtgctcacaaagacacacacaggagcagaaaccaaaatagctcacaaatgtgggcaagtcctgtgggggaccaccttatgtctctcaggaggcctgatgagctgtgccatgtggccttctggaacattatacctgcattcattgatcacagctctgcagaagctgccacttctcctatgtgcctgcctgcagtgacgctgatgtagcaggtcattctgtaatcactgtttgcacctgcatttgctcaggaagtgtttgctcatacatcttgaaatcatgtattacaaacctggacaggtcctaattgctggtgatggttctgagaggttgagattggctataattagatggagaagcaattagctacatattctgagtagggaacatacagaataatgtttctcaaagggtggtctttgaacccctatgtcagagcaactgtggatcttttgttaaaatgcagattcccaggtaatcaccttggcatagtccattgggtgggggtcagggtgtggcaacaaggaactggagttccttcagtgactccagtacaggtgctgcaggagccatatttttaaataaactgtacttattttttattttcaattaaaaattgcaatattgttagcaaaacttgggaagaatcataaaattgtaacaacatatcttgcggaaattaattttatcaataattggatcatatttttgttctgtacatttactaattgagttatcttccaaaatgtattggcaagaaagaaatgtttctgccagatgatgtagacattatataacaaaaaatgatgttttcaaaatagctactttttctaggtgtttactagaatggacctgatagaataattgtattctagtattctctccttaggcccactggctcactcaaataatagctgtttataaagatgctaaccggagttttttatttttcatttttttaaagttctaatttcttgttttttcccatctgtagacaatgatgatgagctcttaaggtttatacattttttgaacccttcaaattacaaaagttggtgatatttggtactgggggtcaagtgtgaaagaaatctgaaaatattgcccatatcagtggagactaaaggccatttgttattttcttcattaccagcaaagcttcagtttaataaaaatattataattgaatttacgattttgattccacaaattcaaaaagaaatattttcctttctaaagccaaacagaataaaaattctcataagaatttttgtttaaatagcaaaacctattcttaggatttaacaattgcctgaggtttgtcaacagtaggtagcattctttttttatatattgctatgaggccaaaaatgctattttcctggagattagtgcaaaataatctaccgaatagttgctaatgaaattatcatatgagaaagattattaataatgacttttgattttaaaaaatactatcatcaaattttcctaagaaatgatgatgagaaaagcagttttgaaatacaaagctgggtggtagtgggcctggtgtgcactgctggaaggttgcatggtactttgtgaaacttcagcagcccacttgcataatttatcattacctgtcccctacctctctctacttaattctgaatctgtatttctcagataaacatggcagtaggaaggatagggaaaggtgttgaggggatgtgattatatggatgtttttgaaggggagtatattggtgtcatgggatccttgggatgtcatcttgccagctggaatcctctgtggcaggggtaccttctctctgagtattgctcatgctcactgggcactgggcttgttctgcccagttggcccagcaggctgcacttggctcatgctactggcccagatcccacacctgccaagggcgagccaggcgtagagtggcaaggggtgtgtgggtgagtatattagttcttttccacgctgccaatagacacatacccaagactgggcaatttataaaaaaagaggtttaatggacttacacttccacatggctggggaggcctcacaatcatggcagaaggcaatgagtagcaggtcacatcttacgtggatggtggcaggcaaatagagcatttgtgcagggaaacacctgtttttattttattattttattttttatttctttgagacggagtcttgctatgtcacccaggctggagtgtagtggtgtgatctcagctcactgcaacctctgcctcctggtttaagcgatcctcctgcctcagcctaccaagtagctgggactacaggcacctgccaccacgcccagcgaatttttgtatttttagtagaggcagggtttcactttgttgaccaggctagtcttgaactcctgacctcgtgatccgcccgcctcggcctctcaaagtgctgggattacaggcgtgagccactgcacctggcctgaaactcctgtttttaaaaccatcagatctcttgagagttactcattatcacgagaacagcatgggaaagacccccatgattcatttgcctcccactgggttcttcccatgacatgtgggaattctgggagttacaattcaagatcagatttgggtggggctacagccaagccatatcagtgagtgagcctggggtatggccactgctcacagccaggcatgcctgctgctgcggcagggtgggcagccccaggcaccagaacaggtgctggctccatgcaaggctgtggctggacaagatgtactgcatgtggcttccactgtgggcacccctgtctggatgagggcaacaaggtggcacccagaagcttggagataccaggaaccacagagccccaaagagggtgtcacagccctgcctcagggagcccctaggtctgggctccctaaagggccgcagctcttctctccttctcattaactgcaacgtggcgagcaggggggaaagtgtgtttcagccctgtttgtgttacagctcatcagtgctgccattcaacaggtctcgagttcatgtcccatgcctaggaagaatgaggtacagcagacaactggagtgtgagcaaggcagagaggagctttatttgatccacagaacagctcccaggagacctcaagtgggtaactcctttccacaggcaggtcatccctatgagtgtccagctctcagtggagaggcgagccgcagtggtagctcctttctgcagctggtagtccgatgtctgtttgagcctggctgagtctcgggtttttatgtgcttagaagggaagaagtacatgttgattggtccatgggcaggcctggaaaaagcaccatccgattggccaaatggtcatcaatgaagtcttcactctgggcggcagactccaccgggaactggcaccctggccgctaggcttcaggttgtccctggcttgaaggtggaatttcactggggacctgtccctttctgccctgaaacctgtctgcctcccaccatcaatgtgccatccatggcactcaggctgttgatgccaagggacacctgtaggcccacgctgagccaccttcagtcctaccttggcctccctcttgtgctcatgggtgcccaaaatctggagggggtgctgaggtggcagggggctggcgtgtcaatgccacccgagtgcatgcatgcctggccaggttgtgacagcactcaggcttagcctcaattttcctctgaaatcagagtgggctccaggtatggggagaagccaggtatggggagaggccaggtagcgagagtaggcacttccaagactgctcgggcaggggcacttccccaggcgcctgagagctcagggatgcctgggtctggagccacagctgggcagctgcatgtgtgcccaggagcatgaatctccctctctgccaactcagtggagggtggggctcctgcctgttcctggccccagccggctcctcagagcatacagccccggctgcagccagcatcttggcagcggctgctccagacaggctgccactgccatcactgggaccatgtagggagtatattagggctgccccatggttctccagatagactaaggagacaaattgacatagtacagtattagaaggaaagaatatggagtttaaaaaccgttttcatggtcattctgcccctgctcttctcttccccctttcaaactgagcagacccatatttctcctttcatctctgtccttgagcctaccttcagctctttggctttcattttactccctccttccacccagtgtcttttgctagcttcttgacccagccaggattgcatgggacatcacttagatctgctctcagagtcacaaaatgcctttgcttcctgtttccttgttccttttactgtgctggttcttttcggtaaacttttagatttatcatctctagattagtgcagcattatttagctcattgctattgtactctggtttaaaaaatttcagtgaccatccacagccatctaaataagattgaagcctcttagtataggacattttaggccctgactaatcctgctgcaatgtaccttcccagttgcctttcccactctctgtaaacaccaagctgcaactacaactgctatttggatgaaccctgtgttttctccacattcctgtgcctgtgctttggctattttctttgtttagaatattcttttttgacatatttgtcttccattgactagttcagacccacttcttccttgaagtttttatgatctttttccttgtaagtaattgcattgtcttcccaactcttatgatcctttgtttataacaagggtcaccccagaatttatcagctaatttaggacattactgggaatgaaagggggaaccattaataattaccttggaacaataagcattaatcaggacttcctgaaaaactgggatatatagtcactctgtaattcacttttggcctttttcataccatactctgttttgagttggaggtatacattttcttctttccactgaaatgttgagctcctcgaggacctcactgtgtgacacagcaaggggcctaggcttatgtcacatattgggaaacaacacccttaaaaccactgctatcctttactcgaggatacccttctcatatttatagtttccattcatgtctctttccagtcttttctccatatgctagccagagtgatcttttaaaaatatacatatgatcatattattcccacaagtaaatcctctcaactgcttctcagggtattcagattgaaaatcagactcccatcatctgcagtgcccagttatccagtgctgtttcttcagcttcatgtcatgcttcccttgcttactggctccagctcccgaccttccattccctcccacatgccaagttccttcgtaccctggacaccttatgctatcctctttggaagaaatggttccccctctgttttttgaatgatgagatccttctagtcctttaggcttgaactgaaatgtcatctttcataggggcttttctcgaccatatggtttatttaactcaggatctgccatttgtcttctgtgttttgcactcacctttttaacttcctaacaccacatttataattatagatttttctttctatgtccttccttatgtctgcaccttctgctgcactccaagctctactgaggagagatatcacctccaccacagtgtttgtagcacattgcctggcacacagaaggtggcactcaataattaaagttgagtggtttgaataatttttgcaatggatgacattgctaattccacactcctgttacattccaactttaattggctacaaaaaaaagcacacacacagacacagacacacacacacagacacacacacacacacacacacacacacacacacacacaaacaatccagaccccaatacagtatgactgttgtcttctctctctggggatatgcaatgtaaaataagatactgatgagcgcatgctgcacaccaagcaaaaatttatcccaagcaacccctgcgccctgcgtggaccgtgtctgctgttctcccatggaatctatcagcagtttgtcttcccagggttgtagcctgtcaggatggtagaattgctagtgcagccaggaaaagctgacctaggaaaaccatagccttccatctttttagaggtaatccaaaagagactagacaagcagaaagacggagaggaaagttggtgggagtgaggtgaaattcactgagtactcttttatatgcaaatatttgtgtggggctctacttttttaccatgagtacaaactctttttagtatcaatgcatgaatagcgtgtcttttcactgaaaaattattgtcccacgtgccctcggtttaaaatgttttgatcttagaaaacagtttatttccttttaaagtggcccaattaattcattttccacatatttgctcattgagcaaacatcaactgaacatcgtttgtgtgcaaaccttatacaagaaactctgacataacagggaggatatgtttaatgataactctgcccatgatgtgtttatggcttgctagatccattctgacccacctattgtgaagagttcatggagagctcttaacaacaagtgaggctgaggctggcagattaaatgcagttcaaagggagacaaggttgaacatctcctagagagggaataccttcagagatacatattaaagttctttaaaattgtttctttcttattgtgccatttttgttgacctcccttctgtccttttaagaaacttttgagaaaaatgcattattctaccgaaagcatcggcaaatgttggaaatagtattttgtgtatcagttttcttggctgcttatttttaaaaataaaggcttaaataaggttcgcacatttttcactcaggtgcaatttactgggaattacctggcgcattggttttatgcttaatatttacagattattaaaatctcagtggctttcaaactgcatggaccaagaaaataggtgtattttctagaaatggttttgcttatggacactgacccactttgaaacgacttactcttggaactcttagtacaggaaagtcttatgtttctgtctagaggtggaactgtttatgataaatagaaatagctttccttttctatcatttctgttttcttggaagtagattatttttgatgcaagtagaccttcagaatttgaatagaaatttttatttatttatttatttattgagacggagtctcactctatcaccaaggctggtgtgcagtggtgtgatcttggctcactgtaccctctgccccccgggcttaagtgatccttccacctcagcctcctgagtagctgggactacaggcgcacaccaccacacctagctaattttttgaagagatggggttttgccgtggtgcccaggctggtctcgagctcttgagctcaagcaattctcttgccttggcctcccaaagtgctgggattacaggcgtgagccaccgtgcctggccttttgaataaaaatttagacttcagatttatatagtgagtatactgatgggagattgaacaattacgtgatctcaggagtagattatagagctgtttctaatttactatcaagttatttttttcccaaaagataatttataaactgcttttttgtttgtggaaatcctgtttgttaggaagtgttacaaatggtagtttcccagtgaatttatcaaaatgctgtttattcaataacattcactcctccaaggatactactcactgtcccttgacattcattcattaaatatttattgttcatgtactgctatggacagacataattttgggtgcttatattagtgaacaaaataatgaatacatctgccctagtggaagttacattctcttcatatattaaattctcttagtagtatacagcttccatttaaatgtttaacccagacctttcttctcaacttctagattcataaactcagctccttatcagagttttgctgcctagatcattcacaaacatttcaaactcagcatatctcactttgaaatctataatggtggtccccaaattgctcttcctcctcaatttccttccttactgtgtgcaccatctgctaagcatccaagccataaatctgttcatactagaaacctgcaagtcaaactcctcttcccctcttccccccattcttacatcctatagatttttatcctatgtatttcttatctgaccctctctcttcaatgttttctatccttcctgcgagtgcagtagttcaggttctctttctcttggaggtgtgatgactagcttctcatctgacttctcagcctctaatcttgccactgttaaattctgctcctcaaattcctccattattgtgttcttgacagcatgcaaattgaatcgtgtcatttgtttcaagagttttcattgactttacttataggttaatttcaactttctttatatggtatagaagcccacacatttttttgttttgttttgttttagagaggatctcactctcttgcccaggctggagtgtagtggtgtgatcatagctcactgcagcctccacctcatgggttcaaaatgtccttctgcctcagcctcccaagtagctgggactaaaggcatgtgccaccacacctggctaattgtgtgggtttttttttctttctttctttagagatggaggactcactgtgttttctaggctggtgcccacacattttaatgcctttcagagcattccctttttttttctttttttttttttttggtgcttcctaatcccatgcccctatcacatcagacttaatctattttctataatgtcttccttcacccactcctacaaatctgaattttttttttccttcagtgagtctgatcttagttacatgtgagaaatgtagtcctactaaatcagaaatggactatactacctcttagaataacatctcttgaaagggatcccctatagctttaaggggcctgctggttttttgttaacatgggtgaattgtatagtggtaaaatctgagattttagtgcacccatcacctagtaatgtaggttataactacatattgtagtagttacaatatattgttttttgtccctcactcccctctcactctgccctcttctgagtctccagtgtctgttatactactctgtatgcctttgcatacccatagcttagctcccacttataagtgagaacatagggtatttggttttacattcctgagtcacttcacttagaataatggtcttcatttccaaggacacctttgttgttgttgttgttgttgttgttgttgttgttgttgcgacggagtctcgctctgtcgcccaggctggagtgcagtggcgcgatctcggctcactgcaacctccacctcctgggttcaaacgattcttctgcctcagcctccctagtagctgggactacaggtgcccgccaccacacctggctaatttttgtatttttagtagagacagggtttcaccatgttggccaggatggtcttgatttcctgacctcgtgatccacctgcctcggcctcccaaagtgctgggattacaggcttgagccaccatgcccagccccaaggacacatttttaaactaagaaaatgttcagtttgttagaatttaatgtggcatagggaaaggaaaatgaattttagaggaccagtcttttacaaaagattactgcaaattttggtggtttcgttcaaaaacgtaaaaaagatcaatttcttttttcataatggtagttgctggacccttgtattggtgtggccattggagattacagaagccttttgttactggaaataattttcaggcctcagagttgtaagtcaagaattgcctatactgaaccctttggagtcttttcattgttacgaggtaactttgcttatgtgtgaattaatgcttaggctttcaaagcaagaaaaactagacatgatatgaactttgtcattctgctaagttaatactgaaatgaaaacttttactgatacaaagacatttctgttaccagtaaattgtgtagactttgtgaggattttgagatgtgatttatattggcttattttttaaaaagctggcttaaaaagtgaccacaagtgtgctaaaaggtttatttgaggtaaccacagtattatagttcccctggcataattattccgtattttgtttccatgagtcaaggcacaaagcaaggataatcataatgattgtaggaaacagcgcttagagctgggatcctaggattttaatactaggatcttttacttgttgcagcttccacattcctttttgaaaagctttttttaaacaatattttttagggcacaggcgaactattttagcagaatgaagcagtaatttaagaaaaatctttatattcctgtccatttccacattctttctgaaaggctactcttgggggtagaaatacagctgtggatgaaaagattgaggtaaggaatacttttctcttaaattcttgtagcttgggtcattaactattgtcatatatgtcgacctagttcatggcagccagaggagacaaggtataaaattgactgggttgtgattcagagggggaaacaatggaaaatatattgaacacttttacattactgagaccccttctacacttttttcctctttggttttagactgtataaagtattgtgttggtactgtagatacagcgtgtggctattgatattgatataagaaaatctgttaaggttcctctttcagcagttatggggatcttcattcagagcaataagatcatttctcctaggtgttacatgttggcagactgaagaagacaaagacgtcttgtcttcacattgttttatggccacgactttgaattcatttgatcacttaagaggtatcgcagacactgtagctaattagaaggaagggggcagttttattgtgaatatgttcagtgaagaagatagcagtgtttgtattgcacaggctgtatgaacgtgtattttgttggggagagagagactgagaatctggattcttgggttaaagtttctaccttgctgctggcactttgtccttaaccaagttattgctgctctttgaccctcagtttctgtgattgtaccagaatgcagatgttgtattcttctaacactgtgaagatgttatacatgctggagtacttaaaattccctcttccttaaaattgagaaaaaaaagtagattaaaaaaactaggaactacctggactttgataatattaatattttagataaaccagcactgaagtatgtgatacctacaaagaacaacacctcaagagtttctgctttgtggtaatgactcactttggtaaaattatgctgtgcacatggttattagactactgtagataccagtgggtacattagattgaaaaacgtaaatgaagtggtcttatgtatacaattttttgcagttgccttttgttgggaagagattaatatgagatagtgtaacttttttgtttggggtgggcgggggtgggcatgcctattggtggtgatctgaggattgtaactttagatcttttacattgaaattatagaaatttgattgttatggataattcatggtgaaggaatgtaatgaaattattattattattatttttaatgactaacccatgttcctagatgtattcatttttggcttagctctcctctcctctcctctcctgtcctctctctttctttcttttatttttttttagagagggggtcttgctttgtcactcaggttgaagtgcagtggtacaatctcactgcagtctgaacctcctggctcaagcaatcctcccgtttcagtcccctaagcagctggtactacaggtatgcaccaccatgcccggctgtttttgtattttcgggggaggcagggtttttccatgtttcccaggcttgtctcaaactcctgagctcagagaatctacctgccatggcctcccaaagtgcttggattacaggtgtaagccactgtacctggcctgcttttcagtttttcagtaagtaaattgtgaggcatatatgttgattcttctggctttggaaaatccttccctataccctatttatgtagactgaatgaaattgataagatacagtattttcttcctagactgttcaacactggcgtgaaatggttcttgtgtaggactccttgccctcttccaggtagctctctttattcagtacatgttttacatgcattctctgtgtttcaaacctgagagatgtcagaggaatataagagatggtccctattttccagggcttcacctctgggttaattactttgggacagtttaaagtaaataaactgtaaaaaaatactcttggaaaagttggtgaatgatacgtgcttaatttttcactaatctccctcgtggtttttataatgccatgtgtttttcttgggagggtttccttacagctgtatttgtgatcttgggctagaatttatgagctgccaccatgaaggtctgcctctggctttggcatcagagatggcgagttgtgtggtttgttttcttattgttaatgtgagaatttttcctaatcaaaataaatgcctatgtgtttttcctgactttcttgttggattgactaaggaagttgtgtgaattataaaaatttcttcctgaaatgaaggacaaaatttccaaagcaggatgcattgagattgtctgaagaaatgtatgtcttctggttttagtatttagacttgaagtttttttttttttttttttttttttaaccgtaataactaggaaaagtagaaaagttaaaagaaacaaaaaacatcacggtgggaaatagaaggagaaaaccagacatttatgaaaaccattctggatctcacagatgctattaagattagtaaacgttggccgagcatggtggctcacgcctgtaattccagcactttgagaggcagaggcaggcagatcacctgaggtcagaagtttgagaccagcctggccaacatggtaaaactccccatctctactaaaaaatacaaaaattagccaggcttggtggtgtgtgcctataatcccagctacttgggaggcctaggcaggagaattgcttgaacccaggaggcagtgagccgagatcacaccactgcactgtagcctgtgcaacagagcgagactctgtctttaaaaaaaaaaaaaaaaaaaaaggccgggcatggtaggtcatgcctgtaatcccagcattttgggaggctgaggcaggcagatcacctgagggcaggagtttgagaccagcctgaccattatggagaaaccccgtctctactaaaaatacaaaattagtgggcatggtggcacatgcctgtaatcccagctgcttgggaggctgaggcaggagaatctcttgaacctgggaggcagaggttgcagtgagccgagatcacgccattgcactccagcctgggcaacaagagtgaaactctgtctcaaaaaaagaaaaaagaaaaaaaaattagtaaatgttgactagtctcagggatatttgagctgcactcagtaggctactttgcatttgtaaaattctcacacatcaaattgcatcatctttggctttttgatttcatgcacgcagtctgtgaaaggctaagccaggtatgtggttacatataaacttactaccaactagcgctgtcctttttctactccttaagaggtttattggggcaataaactgttggcattattactcacctagcataagctgatcctttctttgactgtttttaaggaagatgttgttttatctgctaaaacaggtagcacgagattgacttcaccaaagcctcttctaagactttagaaatggcttaagcttcgctgctttcttagcacttttactgtataggccctggtatgtggtattgatacatacagtaagtataaatgtgagaagagaaaccacattttcatgctcttaagtgatccatgctgttttcacttctcagggtgatttttggttgtagccaactcagaaactctcaatttaatttgagattgtgtgaattgctttcctagtctgtacaccagaaagaatgcttctctccttacacatttcgacacttcttagtgaagatcatttacttatagagtgtatgcattatattagcatatggcctgggtaacttcagacttgttaacatagcgtgggaaaggttactgaaagcatgaggaggcagtatattatctctcagttgattttgtacaccattttgaatattttctgtacattccctttcctctagtgttggtttcttatacttatagtaaagggaaactgatgttgatattgttcaaaaaagaaatgaagtgaatttttgtatttttaaagaataaattaacatgctttaaagtgcttaaccagttgttacaatatcagttatcacagattggtatgcgttggtccatgttatgtatttgcctgaatcaaccctaagactggttggcttatttctgccttttcttttccaaaaggtatacttgacatgaagtagactgtgcctgtttgattttaagttttgaatatggtgggaggtatagattaaagttaatttcttttgcatatggatattcaatttttctgaaggcatttttgaaaaagctgtccattctccacctttgcattgcctttgtacttttgtaaacaatcagttgtccatgtatgtgtgagtttatttctatactctctattctgttcctttgatctatttgtctatctttatgcctatactatactgtctttattactgtagcttgctttgtagtaagttttgaagtgagataatgttacatagttttggctttttaagattcttttcactagcgtatgacttttagaatcagcttgtcaggttctataaagaatctggccaagatgttggttgagattatattgatcgtgtgatcaatttggggagaattgacagtttaaaatattgagttttcaactctcgaacaaggtctatctctctatttagatcttacttatttccttcagcaatattttgtacttttcagtatataagcctttcatatattttgtcagatttattcctatgtgtttcatatttttgatgcagtattaaatggtggtgttttttaactttagtttccagttcactatcaatatgtagaaattcactgatttttgtatattcacttgcattctgcaaccttgctaaactcacttattagttctagtagttttttttgtaggtcttactggattttctacatggatgatcatatttttagtgaatagaagcagcttatttctttcctcctaatctgggtatcttctctgtctttttcttgtctgatttctctgtcaggaacttacaggatcatgtttaatagaagagacaagactggacactcctgcccttttcctgattttagggggaaagacagaatcttttgccattaattctgagcttagctatacgtttttcatagtgccctttattaggttgagaatgttccattctaagtttgtcagaattttaatcaagaatgcatgttatattttgtcaaacaccttttttttgtctatcaagatgatcatatgatttttctttttttgtttattaatatagtaatacattgattggtttttaaatgtgaaaccaaaatgctttccttggtaaactctatttagtcatgatatattaacttctaaatagattgttggatttgatttgttaaaaatgttttaaagaatttttacacctgtgttcatgaataaaaattggtctgtagttttcttttgatctatttgtctggttttattatcagagtgatgctggcctcataggaaaggtagggaaatattcccttttcctcagtttcttagaagagtttgtgtagaattgttattatttcttttgtcttttcttttctttctttctttcttttcttttttttttttctttttttgagacagagttttgctcttgttgcccaggctgaagtgcaatggcgcaaactcagctcactgcaacctctgcttcctgggttcaagcgattctcctacctcagcctcctgagtagctgggattataggcatgcgccaccacgcccagctaattttgtatttttagtagagatgaggtttctccctgttggtcaggctggtctcaaactcctgacctcaggtgatccgtctgcctctgcctcccaaagtgctgggattacaggcatgagccaccaggcccggcctgttatttctttcttaaatgataggtagaatttgtcagtgaatccatctgggcctagagttttctttctgtggaaaggttttaaatgaaatattcatgttctttactaaatattgaactatttatgttatccatttcttcttgagtcagctttggtaatttatgtcttttcaaggaattttttcattttatcaaagttgttgaatttattggcataaaattcatataatattccttcattatccttttatatctatagaatctatggcaattctatatctgttgatagcctcctttcctcccctcttctctctctgtcatatcagtatgactgggagtttattaattttattgatcttcttgaagaacaagctttattttcattgatttttctctgttgttttatatttcattgatttccttctttctgcttactttagttttactttgcttatttttctggcttttaaaagtaggagctgagtttgttgatttaagatctttcttctcttctaatatagccttttgatgctataaatttacccccaaatattactttagcagcaccccaaatattctgatctgtggtattttcattttcattcagtttagagtactttctgatttcccttgtgacttctaattgaaacactccaaatattttaggggttttccagggatctttctagtattggtttattacattaaatcagtcaattaattaattaagagacaggatctcaccctgtcatccaggctggagtgcagtggcgtgatcatagctcattgcacccttgaattcctggtttcaagtgatcctctcatatcagcctggcttttaaaaatcttttgtagagatagtgtcttactatgttgcccagcatggtcttgaatccttgctctcaagcagttttccctccttggcctcccaaagtgttgggataacaggtatgagctactgaacctggcctggaattggtttcttatttaactccattgtgatttaagacagacaaacactttaactgggtatggtggtgcgcctatagtcccagctgcttaggagatggaggtaggaggatcacttgagctagtagctgagtttagcctgggcaacatagtgagaccttgtctctctaaaaacaaaaaacaaaacacacctagaaacaacattgcttgtatgacttgtatccttttaaatttattggcacaattttatggcccagaatatggtctttctttgtagatgttccctgagcacttgagaggaacgtaattttcttctgtagttggtaggaatgttctataaatgccagtcagcccaagttggtttatagtgttgctcagttttattatatccttacggattttttgcctgcttgttctatcaagagaggtatattgatgtctctggctataattgtggttttgtttctttgttcctattgtcctgtgctattttgaggctttgttatttggtacataaacatttagggttatgtggtattgattgattgatccctttattattatgagatgaccacctctatccctggtaatagtctttgctctgaaatctatctgtctgtctgtctgtctatctatctatctatctatctatctatctatctatctatctatctgcctgcctacctacctacctatatctgtcagtcatgtatctcactttattatctcttttaattggagtattttccattcaaatgttaggtttgagactttcatgttgccatttgttttttgttagtcgcattttttttccttaccctctttccctgcagccttgagaatgaataaagtatttaagatttcattttatgtcttttgttcccatattagctacaattattttcctcttttttttgtggttgcattagggaaatactatatatacactatatataataaagatatataaatatatataaaatatatataaagatatataagatatatagtatatataagatatatcatgtatatatagtatatacatataaagatatatataaagatatgtaagatatatagcatatataatatatagtatatatctatcatatctttatatatataaagatatataacatatatattatatatatacagtattttccctaaagcaccacgaaaaacaaggaaataaaaaattgtagctaataagggagcaaaagagataaaatgatatgttaaatactttattcgtccacaaggccgcaagaaagagggtaaggaaaaaaatgcaactaatgaaaaacaaatggcaacatgaaagtctcaaacttaacatttgaatggaaaatactccaatatatttatatatatatatatatatacatactatatatatctttaatttacagtggtctaccttcacatgatgttatatcacttcatgaataatacaagaatattatatttactcttctatttacttacatttacgcctttatagcctttatactgtcgatgacatgagttttacttttgtatttgttaaaaaggctacaaaacattgttactatttctgcttaaacagtgaattatcttttaaggatattttaaataattaaaaaaaaaatcttgtatatatccccatgttttcacaggatccttagggtgtcacttcgtcagccagaaacctctgtggccagcgttgcctctgcttcagtttttctcattcctgctgggctcattccacccactctgcccgacaggctgcgctcagcttgtgctaccaacctcggtcctacgccaagggtgagccacatgcagagtggcaaggattgtgtgagcaagtgagcgcagggtctggccactgcacacagccaggcttaacggctgctgcagtggggagggcagctccaggtgcccgcacaggtaccggccccatgtgaggctgtggctggaccagatgtaccacaagtggcttccactgtgggcaccaatgtctctggatgaggggaatgcagtggcacctgaaagtgcagagaccgccaggaaccacagagccccaaagaggggtattaccgggctacctgaagggctgcaggtcttctctccttttcattgcctgtggtggtggggtgttatcccatttgtgttacagctgtcttagtcttgccatctggcaggtcccaagttcttgtctcacatccaggaagaatgggttatgtggacaattgtagggtgatcaaggcagaaaggaactttattgagtgacagaccagctctcagtggagacctgaagtgagtagctcctatctgcaggcaggtagtcccagtgagtccctgagtctggctgagtccagggtttttatgggctcagaatttaggaagtgtgtgctgattggtccatgggcagccatgggtgggcctggaaaaagcaccattctagtggccaaaaggcatcaaggaacttctcactcggggttatggactccactcagaactggcagcccagcccacagacttcatgccatccctgccttgaaggtgggatttcactgcggacccaccctttcctgccttgggacctgtctgcctcctgccgtgatcaacatgctgtccacagtaaggctgtctgtgccaggaggcacctgcaggcctatactgagctgccctcagcagctccagcctccctcctgtgcttacacccaatgtctggaggggcctgaggtagcagggggctggtataccagcatgaccctgagtgtgcacatatgccgctaagtcataacagtgcccagattggccacaactttgctccatgctgcattaggcaccgagagagcagggagaggccagagaagcaggagcaggcacttctgagcctgcagggcttcccgagcccccaagaacacatggatgcttgggtctgtagccacatctaggcagctgcagctgcagctgcacctgggagtgtgggttcctgtcccgccaactctgtaaggtgcagggctcctgctaggatcacctgttcctggcccttgctggttctaagtgaacaggccttccccactgcagcgggtgtcctcgcagtggccaatccagacgggccaccattgccaccatcaatgtggttaccatttcttatgcccttcatttctctgggtagatcctatttacatctgagcgtttttcttttgcctgaaggccttcttttaacatttcttactgagagaatttactgatgatgaaatcattcagcttttgtatgcctgaaaacatcttcactttgcctttgttttcaaaatttttttctgggaatataattttagttggacagttactttttcttttagtaatttaaaagtgttgctctactgttttctcttagtgtttgccatgacaaaatttgtgtcactcttagtttctggtaatgtaacttgtctttttttttgactgcttttaagtgttttctctctagtgctgcttttgagcatttggttacattgtgccttaccctagtttccttcatgtttcttgtgctttaggtttgttgagcttctttgatctaggattcatcatttttatgaagtttggaaattttgggttattatttctttaaggttttttccccttctcttctgctttaccttttcagggactccaattaaccagatactagatagtttgaactcttcctagagtttcctgtgctactttgatttttcttcattcttttttctctttgcatttcagtttggatagttgctgtgtctcaggttcaccagtcttttcttctgctatgtcaaatctgttgttagtcctattcaatgtgtttttcatctccgacagcagtttcatttctaaagatttggttacagtgtttttaaaaatacttacaagtctctatttaactgtttgaacttttggaatacaggtacaatgattgtttcagtgtccttgtttgcaattaacctcagtgccacttctgggttgttttcactttattgattattctactcattatgggtcatgcttttctgcctcattgtgtaactggtgatctttggatgccagacattgtgaattttaccttgttggatgctaggtattttggtatttctataagtcgccttgagctttgttctgggatgcagtaaagttacttagaaaaactttgatcacctggagttttgttattggcatttgttaagggaaatctggaaaagagcttagtctaggccttggttattcctcattacttttgcaagacctttttgagtattcaatctaatcatctgtgaagtatgagttttttagtctctctcatgggaacaggcactgttcagagtcctgtgcgagtcccaagaaatgttctctataattcttttgggtgtttctttccccagccttgagtagcgtccccctgctttcgagccagtctgtactgtgttgcaggtgaaccctctgtagatctccagggctctctctctgtgtaattctcttctctctagtcctctatcctatgaaccccagctgccttgatgtcctcagactcaactctgtctcctcaattcatcgagttggcctggttctgccccagtttcatctcctggtattgcaccctggaaactctccagacaataaggtgggtcagttatagggctctcatttgtttcctgcatctcagagattactgtcattagttacttcatgtctggtatcttgaaaaccattgttcatatatttttctgagtattttttgttgtttcaggcaggagactgtatctagtcactgtttctccatcttgaccagaagtggttctcccatatttcatttaacaacatcatgaaatctctttcagccaagctcaagaccataatttgtccttctctgccttctcttttgacccaatgccttgttctttcagtcttgtcagttcttacttcctagtatatttgacattcttttgtacttaatggtaaaaatctttaggtaaacatcatcattattaacttacactaaaaaatagtaaaatcattggaatggagggaatattgtcagaatagttataagttttggtgccctatcccagtgccatctttaaggtgagtattcagggaatatttcttatacatcttaattcagtgtaaaatttgcatgttttatatgttgatagagcagaattatttcaggatgagtatatttgtttagatcttttaaaaaatgtatctttagggaggtttgtgcttttccagactgagccagaatgctcgtactgcattttggatttacacacacacacacacacacacacacacacacacactacttttttactttccagtttcccctgttacttggtgtgctgcttgaaaccagacttgccattcttacatctccagaacctcataccatgcctggcatagtggcactcaattaaggtctgatgatttgtactgagtaagctatagttttaggcttggagcattgttaaggctttgcatagaatctctgcattatacagaatcttaactgtctctacattacagtataatccacatctgcatctttgcagcttgctattatacatctttggtttgctgtgaaagagctgtcagagaatgagctctttattgcttagaattactagttaactattgttttgccattgatcagaatgtctcctttttctgttctgctgtattcattgtggtattttgttgtaatcagagatagtcttggaggtgcaagacttattggatctccgtttgtgccattgtcgcaacatcactgacttggtgaggatcagtcaggggtttcttccttctgtttttgtcatggcagtcttactttttgaaacatttgtcaccttctctgatcctgcctcctgcttttccccatctgcactctgacctatactgttttagaaggaaaagataataaaggtcagattttataaaactctgttcaagaaatactgcataaagggctcttcaagataaaagactaccccgcttgtcaggcagcctgctaatttgagagtgctgacgacttaccttgatgaggcaatcttcgaattgatgactctttttaattaattgtcttttcattgataaaacagaattgctttgttttccttttactgcccatctcttcctcacaaaatatgtttcctctccgaacacacaaactgtgttttcagaatctcccctgagtctggaggtctggacagtagtgtgtttgtgtgcttgtgtgtgtatatgtgtgcacacacatgcacagcttgtgtgcatggtatctgtgatttctgtgtgtgcttatatttttcactattttggattcatccagttctataaagacatacttgcttgctttgcatggttctggctccctctgcagccccaaatggaaaagtgctttgttgtcttttgttgctgaaaaatccagctctcggccttctttctttgagtagagcatcccagctggtatacaagtatagattggatttcagatttagcaatgcattgtgttttgacaaagcttattgaagatggaagtcatttttcaggagcgctctaagaggtgagaaaatggcaagggagggtggggaggaaagggagaaaatgcagaagaggcagacacaattgcaacattgatttggtaaatagaaagttaatgtagctacaggtattgacagtaaactttggctaagatattggagaattgcagattggaaggctagagctatttcagaatttccagggccattttattggattatacaccttagaaccttaacacacagcttctgttgattagtacagtttggcctccagtgtgagtttggctttgaacactcagtgtgactttggctagggcttggcacctgtggacttcagcttctactttagtaaaatgaatgagttagaacaaataattgttacattcaaatccagatttatgagtgtacgatagtggcttcacattatttgttttaagttaccgttgagaatttggttctcagtaatctagagctactattttagcagaattatacatgggatgcagaatagaagcttttaagcaacagtcaaccagattggtctataataactccaggataaatacaagaagaatttctggacacattttgccccagtgaagtaaaattatttacattcaaggatggatttggaaatgcaggtatttttctgttgatctgcacgttggttacactggtgtgttcagtgtgtaattacacttccatgcagttatttttgtttttgtgttagatttcaataaactattattttttctaacagatcttaaactttaatgcttctttagagtactaatcaaagtactgttacataagtaatggctcatgtgtgcgcacaggtgtctgctctgtgaagtagtccatttcaaattataccacattaaattgtgtctgctttaaagggttaaaataagtacatgtatatatttagatatataagatgacttctatttaatagataattagaatgtttatgtaatagatttatgctttcagagatttcatattcacaaagtaagttttggaaccttgaaacatggataggtcagtgtcatttggtttcttttttcttcgtttaatccttttcaggacttcggctccctgtgagttgttaatgtatagtgtttatgaatccaaataacattcattaactttcttggaaggtcacagttatgttggttctgttcgaaataagtactataaattttttagaataaaaaaggaaagtattacagtgagttttgctatccacttgccactttcctttcccttcctttttttgttttttgttttttgttttttggtagggagggaggtctccctgtgttgtttaggttggtctcaaactcttggcctcaagcagtcctcccacctcagcctcccaaaatgttgggattacaggtgtgagccattgcacttggccctttcccatttttgtgcttgactagtataagtgtcatttttgttttcttgaaacctttgttctttcccatgtgaatacacataggatgacaatagtcacaaaactctttccgtacttagaagactaaaaccagaaattgttgcttgaacatgtaatggataattgttaaaattctgcactggtttgtactgttctcgaatttttatgtaaaggtctagtttagagatttattatttttattgtttagacttaaaaggaaaacagttagctgcggaatctagtttttatcctggagcgaaactcatataaccttgttgattttagtgggaattagaaagttcagactctttttttagaggtctcccaaaattgtttccactctatgttgaaaggaactctaatctacagaagtggaggtgacagtaaggagggcaggggatgctcttcccaaaggagtttctacaatgcagctgagttagagtgcagtagaaagagcgagatctcatagtggcatgttcctgtcacagcatgtgtatagcagtcacagactctgaacccaaagactgtatttctagttggagcagacattgactcctttttctgggctgaaaacagtgaagtgtattggttttggtagcttgggttataagaaacctaaattagtttgaagtggaattatcctgatgaaagggcagttgaaagcccttgacactggacagaggattgtctagtgtctaatcttggctcaaaatgcaccagacataatgagagtcattatgaactgctgatctcctacccctcccctcagcagaccctattagacttgcaaaaatagcaaacactgtgtgtgtttggcatggtgcctgctgtgtagtagaggaagaaagcgtaccttgtttgcaccacaaccagatactggtgcatcatgttacagctctgcttggttctgagctcctctgttcaatctcgtcttgacagatgctgtcgttgccaccccttagcaagacaaatgcagccactctgcaggagttggcttttgcccagctgtgcttgccagggccccaaactgatgtgcgtgtgtacctgtggaaaggtaacaggctgtgggtgtgttatcctctgccattatgtgcattaccttttgagtttttgccattcccgaaggaaaagttacggttttgtttgttcagataaatctgaaccctcaatttctcttactgcttttttcacaacagatgttgttaggcacccactaaagatccccaggaagggtccctgccccatataagctcactttctctgtaggtagaaagaaatgcaaacagtcacataatcacaaccttaatagctatgtgtataaaggactctgggaaaaaaggacggaggggatctttggaggtgcatgccaggagagagttgtctcatacgagctatgaaggttaagtattgcttaggaggtgtagatatatgtgttgccagggtccaaggtgaaaaaggagaagtggtttgaaatgagcttggtgaacctaggtttgggcctggttttgaaggctactggcaatagggaatcatcatagaattttaaactaggtgagtagccttttcaaaatttttttaggaagcattattctggtttcagtctggagaataagattatataaaaagtgctgagagttggaaaagtgccagcctattatgttgggagaaggaagcatggagaggttttagatgtgaccattagttcagatagagtagtgaagggagataggacttaaccaacaggaagagaaattaaagagagtaagaaaggaaggtctaaggttttcagctaatactccccaggcatagtatttatagggaaacagggaaggtagatttcagtttggggcagactggatttaaaatacctgcggaatatgtaggtattaatgagtaaatttcagtgtgaagtttgtacccagagttgagaatagagcaggctgggcacatagggttctgggataattgatgttacaaattagagtctggtttagcggttagagccatgagaccctctaatccaagtttgatgtcccatggcagtttgatgcaggatgggaccaacattatagacctactgttacctgctaaaaaaggcatttagtatatttcactcctgagtccagaaagccatttaccaagagcatatctgaatttgtgcggcagggaataatataacaatgagttctgtgtattcacaatttaggaattaatttcacaagaccacaggttggaaattcttgtcctctaatgggattgagcctttgtggaaagagtgtcacctgtattttcctcatctcagtagatgaagtagttactgtttctttcccacattcagccaatagcatacattttgtagaaagcaactaaagtttttcctccaaagctttaggcctcttctctttcagttcctcttggtaagacctggcctgtattggtcagtctgcctgttctttctacttggcttacaccatctgcccattgggacctacagattttttttgttttgttttgttttgtttttgagacagagtctctctctgtcgcccaggctggagtgcagtggcgtgatctcggctcattgcaagctccacctcctgggttcacgccattctcctgcctcagcctcccgagtagctgggactacaggtgcccgccaccacacccggctaattttttgtatttttggtagagatggggtttcaccctgttagccaggatggtctcgatctcctgacctcgtaatccaccagcctaggcctcccaaagtgctgggattacaggcgtgagccactgtgcctggctgggacatacagatattttttggctgcttataagtttttgttctcctaggggatttctgggacacttaaatatgattatatccatcagtgaatgaacaatccatagagttgacatcagtggtaaatacagtaatgtgagagtctaaaacgtgagccaaagttccatttaaaagatctaaatgcaaattatctcactaaacttgagaattattgatcatctctgtccctttctcctttttctctcccttttctttccgtcgttcctccctctcttttccctttaccctcttctcttcctttccccgctccctgttctctcttctctttcccccttttttcttcccctccatcttactttcccttctctctcttctcatttgatataactgacagatttgagcagaactgtgaggctcttaggagctgtgtgtgatgtggagtggccagatgactttatgtgagtatgcacgagggactgtaaagaggctgtccagaggccagcctccctccaggttgttcctaaccctggagagtcatcatatgttatttctcatctcagactgccacagaattgaggagggagattgaaggcagctcattaaaccactttggccacagataagagtgttaagagattaagaagtagatttatctgggggaggggtttggtcccggatgaagccttttcctgccgtcggaaaccaaagatttccttgtctcttttgttctgatccatggaatggtgtggcttagctgcctctaaatctgttttggcaaggttgtttgtaaggagacatggcagggtctgtctggagggaacagaaaagagagtacatattgaatgtagatgcttgaaactagatcatagtttacctaattgcagaccttgaagaaactcttggggccacttggatgggggtgcttctggaagtttgtctctgggggtatgtgagtatggacctcttccacactgagaagagggcagagcccagtcatcagttttcatgtccctgagtacaatattaggcttctttttattattatcattatttcaactggtaacaatgtttcccctcaggaaatgtctttacctctctgaagagaagaccgtgatgccagctgttagtttgagaaatgctgcagggtcctctcctacctgctgtttctgtgctctttccatgtgttgtggtgaagcccctacctctccagccatggggccttgttcttcatcatttgttcctatcttcagtttgggatgtggcaaggagaggcagagtgcactagagaaatctgatactgtaatgtgctaggagacagcatgatgagaggttttgggtgggaagtccatgctaaacatcttaaatgcttcagaaacttctttacagaattctctgcctttaggattctcctgttcaataaatatatttttcaccactttagaaataatcttcttaaagcccttccttgaactcatgcatctgtaatgactgcccatgaccagcagtactacattgtggaatgcaagacctaattagtctaagcatgaaagaccttttagtttcatcagctaagcccccttgtcctcccaggcattcctctttccaggtgctgtctccttctgcagcttcccgtaggcctcttcccactgctctttctgctcttctataaaactccacatttaatgcctacaccttaccaaactccaggaaacttccttgactcttgcgggctatatggatctctacttattttagtttttgctgttgcaggaggaaagtatgatttttaaaatacaataatccttttgtatgtctacagaagaatgtggtttggtgagttttacatttgatgcatgattgtatccaccattgtgagattataaataaatctcaagacatgaccttgccctgaacccaaaactaaacatgaatgaaactatagaaataactggataacctctggtacatagagggtcggtgttacagggagataagcagtacaccctaacctagggaagtgcaatgagcagagaggggatggagtatgtaggtggagaagtggctaagtgtcttagatagacaaggtggaaccaaagtacatagagcctggaagctgcagaaaagaacgtaggctaagaaacaagatcaattataggtggttgagtaggtgagtaagacagaaatgtgtgaggtgattggaagggactgctacgataagccagctgtgcttacaatggtgaagataaggaatggtgacttgggaagatgtattggagaaaaatgatagggcctgctgactgagcagctcaagctttatgggaactgctgatcatgtttttaactgctatagatatatttgatttaagtaaatcaatttgtaaagatttagatttcataatgatatcttagaccatatttgcacagcaagtgaaacttaaatactcttgtatccctatcacatcatgttatctttaacatgtgtatcaactttcttacctataaatgctggtgacacctcccagttttctaggcttaatttgtagagggctcaacatgtgaacaatgaatttggtgcaccattcaagaagtaaaattcaatcatttttttctcctattcatttctaaggataggaatctttgccttatagaaatattttaaaggagcccccttaaatgtcacactctctttaggcttaaactattcttatttccaaaatgtaacatcagaagttcagaaattctttctacttaggttctctgtgccccacacaacctcacatttttgcctgagtctccccagtcttgctgcaggagctggggtagcttcagcccacttacatcctgccaggggataaacttgataccttttgctttcatgaaacactatctgtgtgaagtgagctctttgatccacagtcttttatgctgaagctaagggaggattaaggaacacctctgagttgatgaatatttgatgaggtttatataatttaaaattacactcttgttaaccctttcactcaatggagagagaagagaaacttgtataatcgtggttcctacttaggcataaggtactgtgtcttctctgggtgcatcctccttatctatgtagagcagagcatgggaacttagtaaatgtcaattgatgattggcattttttacagcttcatagagagaaatatctctttgcttcattataaccatactgagtgagatgctgaagtggaattgggatcacacagtatctgtgtatttgacattgcatgtataatggtgaacaaggcagatattccactcatcataacaacaacagtagtaatcataccaccaggaagcattctttcagtgcttactgtatgcaaggctctattctaaactcttttcatccattttaattcttagaacaaacttataaggtagatgctattattatcatttctattttataggtaacacaacccaggcacaaagagactaactcccacaaggtttcacaacttacaaatagcagagtcaggatttgaacctgggcaggcagttctcagagcctgcgttcctaacttctggctggacccctcatggtgagaagggcagagagttgacaaatcctctgaagtatggtgagttctgtaggagtctgcaacagggcgaattaacctagggaagaggaaggctgggaaggctttcctgagaaaatgtcttttgggatgaaacatgaaggatgagtaggtgctctctaggtgagggctcatggacaaaactattccaacatgtgtagtggccacaggctggacagaataaaataggtgatttggaggaacaacagagagaagcccattaggggtagagaaagtgagagagtgtgtgtcatggagtgatgccacaggggccaaatcatgaagtcctccgtaggtcccacttccaggatgtgggtcatggaaatataaagggctaaggacaaacggagcattcaaggggtagaaccatgggtataacatgatgagatgtaagctttaacgtgtttctcactagtgatgtgtctaagtcatagagggagacagtagaggacaagagtgcagtcaggcagctgatgctgtaatccaggtgaaggaggatggcagcctggaccaaggtagtagaggtaaggatggatagaagcttaggagcttattaggatgcagataataggagttctggatgtgggagatgagggtgagggaggaaccagtaacaatgcctatgttaacagtcagaagaaggttacaatgtaaccagactggaacatgaacaaattatctgcagtggagcttatttgctcaaaagaaggatcctgcaagagaacatggatggcttgtgtcatccaaatatggatggctttgcccagttagagaataattcctgctgagagaatacacatgcacgcaagcatgtacacacgcacacacatttgttgtagagggttataccctcccaagttaaggtaatttcataattgaggtcgaccctctcgatgtggtaccattgataagccccagcactacagttcagctaccaacactgagtttctcattgagtcaaagcgtgggatgatctgacagcgtcagcagcactgcacaacagtgggagggacggatgaatgccacatctataaggaattgccacttggattcaagaggaaaaggggtaattatccacatgggtaacaatttcagtttcatttctcccttgagctaactctattcacctcaaacgtctttcctgtctagagaaccaccaaaagtgtcattctgattaccatttgtaactaggtgttttctgcttaacatttggaactgggtggggtgagataaattccaagaagatgggaagtttttatattgcagtttatactacagcagcagctccagtctgccctacagaccttctagattttttttttttttttggctgtgtgacaggtgcctgtggagtttatattttgatatttgatcaaactttttaaacctgagcttgtagtaaccattatagtcgtcatgcttgagaatgtgtatttgctagtagtatagagttaacctcagtttatgggggcagggattactttgtgaggaattaaatgtggtgtttgaaaaactgggaagtgaagatcttctgcaacacaggagtttctaaaggaaaaacaattgggccagactggatgaactggttagattaaatgctatcttcctgactcagggttattatttttggttgcttattttatttttaattgttgaagatttattgtaccatgctttgctcaggacagtgtgtaaggtatttagggaaagacctgaaagagacaggaagcatgagcccttccatcaggcacctgaataactgatggtggacatattgagaatacgtagaaaatttgtatcttatggtcatattgcacttcagacttttcacaatgcccttgtatctctgttacttgattctagttttcttggctcagcatgcacagttgttttctttacttgtttatggtctgtctctcccacttaaatatcaggtccttgagagcagatacttgttctcagctacagcccagcacctagatcaatacctgacatattgtgggcactcagtaaatcttaggaggataaatgaacaaaaaacctatcttctgaatatcagtgataatcatataaaacaggcttggtatgctaccatttatgtacttctgattttgtgttttgacaggttttcacctaaggtttgtagtagttggttttcctcagagaagtttttgggctatttttctttttaagaaagggtgagtgatgtcattatgaagttgaagctataggactaatcatatacttgccctgcatctatggtgacttttttttctactggaaagaaagcccgctattaaataattattacttccaggtctgagggagactgtccagcatctgcaagagttttgctaggatgcagggctttgttcccccactgggctgtgattccatccatggagtaagctgcattgtggtagcaagtcatcttgacagtggcaagtatagcatatttcaactggtgatttctgcatgatttgcatgaatttctgtatgacaggagtcacaacaaaactgttacgtgacttgtgtctaaagctatcagtcagctggagctgtgaaaatcagtttgcatgtgtcaacaatttaatcttctaatatgcttgccaatagaaaactgacactagaattatttttctgtatttactgactagaaagatatggttatcaagtgcactgattgaaaaatctttaaattccagtctttaaatcgggaccatatgtgtgttctttccctagccaaatctatttgtgcattcacccacacatgtgtatacatatacacacacagtacagttacattgatatgtgtttgcgttatatatgtatgtattcacacagagcatgcatatgcctcatgcatattcatgagctttaaatgtgcttatagattaagatataaggatgttggggaagtttccctatctgttaactgagaataatactactgcctaccttccaagcaccttgtaagaattaaattagttaatataagtaaagttcttagaacaaggcctggaacatagtatgtttcctataaatattagcttttattattttagagtatgtcttcattctgtcagcttcaaatgggcttcaaaatttagcttcagaggcagtatggcaaagcctcagaattattgcataattcatttgatgaatttactgttattctaaaatgcctgcaaacaatttatatgtcatgcaggaaatattggtatttgtatttctaaatcaaagccatttattaaataccttagtcatattgattcctgttatagtaaattacttctctttctatgtcatcattatctcctagggtctatcagggagatattttcagtgaatttgtctttcattatcagactaaaactaacttcactgaaaacatcttcatttgggatttgaaagagaacaaattttccatttactaagaaaaaaataggtgtttgtgtattggtataaaaataggtatgtatgtaagtgatcaaatagaaaataatgcaaagggacatagaagaatttgggaatggaggtaacatacacctagaaaaacagtgacaagggcacatactattttgaagcaggttttagcaggtaatgatggtactcactgtgggaggaaggtgtgaatcatcagtcaaaacgagtgtacaaactggtgatatgaaatgctgcttaacagttgttttaaataattagatttttgttggggataaatagttcattccagacaaaagtactagggactctatagctcatctaacttcatagattaaaatgaaggcccagataattaaagtgaagacctcagagttagttaatggaagtgcaagtttcaaaaccaggctgcgatgtgggggagacagtgtcctccatgacagctctttaacagatggcatagaaactcgacttgtgaccttgaggggctcacttcagctctctaagaataattccagcccagagctacaccatatatagagtctgtagactattcctaataaaatggttttcttgtcttagagaagagaaactcagcacatacctactttgagtcaggtttgggcatgctcgaaaagggggcagcgtttttagatggagactgctggagtagactcagggtctctttcagcatggctgcctgtgtgatttgattcatgtgcactttaaaaacctgttttatctaagtgtaagactgtagaagacatatatatttagggtattgcattgatttttggaaaccatttgtgtagggtacagtatctttgaatttcactatagtaaccgagttacaaaatgggccactgggtctgctgggctgagaaccatcaaactgaatggtcagcaactttgttcatgcttcatctactttttcttttcaatcatttggggacagataatcttttggtcgctttttagactaactttgagattcagaggggcagtgtattcttggctaaaactttttgtacgaggcacactttcttttaaggtttgtgattttacccttacgtatcagatttcatggtatccaaatgcaaacatgtatttaacagttggtagggatgggagagtttgaggacagcaaagcagcctactttgatgaaagggtcagatagattttaggatctgcaccctttcttagcatcctaagcattttgagaagcagttgtatgtaggtaaaaacaaacaaacaaacaacttggtagttggtgtcagctgaactgctttttactgaatctctgctgtactagctgtgtggctctgaggcttacttccctagtctgcaaagtaaaggtaatgatacctgtttcacaatttaaaaaatagatttattgaaatatatttcacataccataaaattccactaatttaaaatatatagttcagtgattttagtatattcacagagatgcagccatcaccacaagcaattttagaacattttatcacccatgaaagaaatcctgaacccaaaagggccatttcctccctaacttccctaactctaggcaaccactgatctactttctgtctgtgtggattcacctgttttggacatttcatataaatggaattatataatatgttgtgttttatgactgccttcattcacttagcataatgttttcaatattcatgttgtagcatgtatcagtacttcattctcctcaccccccagctttatattaaagtataattggcaaaaaagtacatatttaagatgtataatgtgatgatttgatatatgtatatattgtgaaataattagcataatcaggttaattaaacaccttaatccaaatccattgccttgcatagttaccattttttgttgttgttgtttgtttttttgggtttttttttggtgatgggaacactaagaatctactcttctagtaaatatcaggaatacaatacaacattattaacagtaatcaccgtgactgtacattagatcttgagaaagtacttattttcacaaagtttgtaccctttgatcacatcttcccatttcccttgtccttgcccttggcaaccaccattctactctctgtttttatgagttggatttttttgttttgttttgttttcaagatgggctcttactctgtcacccaggctggagtgctgtggctcacggcagccttgacttcctgggctcaagcaatcttcccacctcagcctcctgagtagctgggattataggctcgtgcccaccatgtctggctggctgattttttattcttatttttattagtgacagggtcacactatattggttaggctggtctcaaactccaggcctcaagtgatcctctcatctctgcctcccaaagtgctgggattataggcgtgagctaccacacacagccgaatttgatttttttgaattctacatgtaaatgagatcatacagtgtttgtatttttatgtctgacttctttcacttagcatatgtcttccaggttcacccaagttgttacaaactgcagggtttccaatggtgtgtagtaaaggggatccttgtatcgtgttgataggaatataaattgggacagcattatggagaaccgtgtagaagttcctcaaaaaattaaatatagaactgccgtaggctttatcaaatctgcttctcagtatatatctaaaggaaatgtagtccatgtctcaaatagctatctgcactaccatgttcattatggcattattcataatagtcaagacgtggaaacaaccttaagtgtccattgatggatgaatggataaagaaaatgtgatgtgatacacacacacacacacacacacacacacacacacacacacacacacacacgcacgcacacagagacaccctctgttatatgtgtgtattgtattatggaatattatttagccataaataatgaagttcactaatttttattgccaaatcatactccattttatgaatatatcacattttgtttatccattcatcagttgatgggcatcatatttttgtgacagtgaaataagacgaagtatataaagtgctttatgatgtcttgaatatagaagcaacgtgtgttttgttgtttcttttcgtctggttggtagatttctggtgaattatcagccgcccctcttgccttgtgaggcaaggaaagcagtcttattgagtagaccatctgtctgccagttctctcatgttagtcctcaactcatggaaaatcctggtgggcactcgtttgatactagaattcacactgcttttttcagcagccagaagtgtttgagtgttaccagcagtgcttgttgtcgttacagatgctccgtacaaaactgtaaatgctgggtttaaagggattgagggagggagccattgcggcttacacagatgtcaactaatctagtgttgatcctcattctgaacctgagcattgacaccaatatcaagctgtggggtagttatgttgtgtgcaaggcttggagggaaatagtgctttggcagttcagtgcttgccgacttcacaaaacacagaaaattgctgagggcttatgtgacagaaagttcatgttacacatatgggcatcttggcgagaaaagccactgatcgtctcagtgtaaggatttggaatttcaaaatcctaaatgattactaaatgacaagtaaaatcttgattgagatagatcgttgctaacgtccaaagagattatctaaaagcattgatttttattttgttggctgtggaaataccgtggaattcatttattaaaagtagtatgtctaagtttctacttattttagatactgtaatataaaattataaacaaggcccaattgttgttacccactaggcagatttttttattatccaagtttctgtttcgggccatgaaacaagttaaaatcaaaactttcgctggttgccattttaaagataaatttgttatataggctttctaagcttggttgccttgctccacaaagacaaaacattaataatagcttacatgtattgagcagtgaatctgtgctaggctttgtgttaaccactgtatatttggattatctcattgatctaaggtaggtacggttgttattcccttcttataggttaggaaactgaggctcagagagattaagtaacttgcccaatgttacacagcttgtaagtggcatttctgtttaaagcttcccattttataaagttttgtgtttttaaatatgctttagaattttaagtttttactctgttattatttcgcgaagtcctatgtctacatacacatcaaagcaattctgtggttcttagggaattatttaataaatgaaatagccatagactgtaattacattatgagtggcatcttttagctgtgcccagcggtagcccagttgctaatctttatcccttgagtagtcaagtagataagaagtggataagcaagtggagtggtggccactcaagcaggcctccaccagaataattccaaataacttcacacagtgaattgcaacccactcaatccacttcactggatagcattgctcaaaagatattcttttactcttttatctaccttgttggcaagcatccccaagaggtcttatgcctgtggcctacagatcaaagatattttctcaaatactgggaactttgctgctagttagaattaagcaaataaaaacatacacctccagaatgtaagcaaactagtttaaaacactccagccattgtattacttatgctttaaaagtttccccacaaaacctcattaatcatataaatattttgacaaacagaaaggggacagagcagacttattattttccatcttgtatgaatggctagacttttcatctgtgctcttatcctaacatgtctttaactcttctgtgctaagatttttatttaaaaacaaggaaattgagactcagtgagatgaactgctttatatcactgtggtaagatgtgttaatagcatttgaaaaggaaaagccaaaattttctttcatttatttatttatttatttatttatttatttatttatttatttattttgagacagagtttcactcttgtcacccaggctggagtgcaatggcatgatcttggctcactgcaacctccacctcccgggttcaagtgattctcttgcctcagcctcccaagtagctgggactacaggcatgtgccaccacacctggctaatttttgtaatttttagtagagattgggtttcaccatgttggccaggctggtctcgagctcctgaccttaagtaatccgcctgccttggcctcccaaaatgctagaattacagacatgagccaccacgcccagcctatttcttgatttttattagtcacctagccttattgtaatttgcacttatctaccattagaacatcataaacccaagtgatgaacagaatggatgtaacttagtgcgtgtatgtaatgcatatgatgtaacatacataaagacaaatggaaaatgcctgcaagatagtttccctgttgtctcatgcctcagcagtaatgaaacatatactgagtgcttattgtgggtcagttactgtgttaaatgtttgtcacgaatcatcccatccagttctcacaatcaacctgtcatgtaggtgctatttttgtccacatttttatagataaggtggctgagacttagaaaaagctaacaccacttgcctgtggtcatagagctagcaattagcaaagccattgcttctaaccagtgtgcattttgccttgcacaataaactacattaaaagatttactttagtttttctacctcccaattgaagccactatcagatatatagtctaaacttagatttgattctgtttagaaacacttaatgttcctaatgttatcaggaaatttgctgttcattttttcaagatctgagtagaatgtcacattctccatgaactttccatgatgctcttcttccaaatgtttctgtagcacctggttgtagcctggctcttaggattcccctgtctgtgctctggacttctttagaagcaccttgtctggttcagttactgcctttgtttgtattgctggcacattcctttgtgcttggtgcatagtagataattaatagatatttgttaaattgaactggatgcttaataaatgtttggatctaattatgatcttaactctggtgtgtacttcaggtacttcaggaaggtcattgcagcattagatgactatggagaccctcagtgttttagactgagatgacttgccattcctacaagagatcaattgaatgaataattggggctgatttttccctaagtattgcttagaacatatactgttttttttctcctcaaaaattgccagttatattgccatactggacaaaataaaactgttagctatatatctatatctatacctatataaattttaaaaacgtagcacaaagtttctgcaccatactttgtgagcagctctgtgtattccaaggctcagaaaatcagactttcaaagctaaattttaccaatatatatcccattgaaatttgcatgagcaagcagaaataatgtggatgttggagttaggtaaatgaatcaaatcctggttcagccactttctaggtatgtgattttgggcaagatatttaatttttttcaacatagtttttttatttttaaaatggaaaagttatgcactggcagatttggaggatgaaataatatgttgggagacagtgtgttaagttacttctcaaaaagttctattataattataggttgctaatttttggcatattttcattttaaaacttttattctaatttcattcttaaacagtgtaagcatattcacagtagcttttctgatcaccttatacccaagcactgccacatgacttctggtccagtgttccaagtgaaggccaagtaatgtcaaggtatgctgtatacggattttctaggagtgtgaataaagaagaggaatggagccatccatggatggcaaagtcatgccgttgcaataagtactacatttacatatttagtacagatcccatcttagaaagggtggatttggtcgggtgcggtggcttacgtctgtgtgatttcagcactttgggaggctgaggtgagcagatcgcttgagcccaggagtttgagaccagccaggacaacatagcaagacctgtctctctctttctctctttttttttaaaggctccctgctcatgaggaatggggagagggaagaaagggtggatttggagaaggttatagcagtgagtatggctgtaaatttgcaaggaataactttttttatttccaacagtgattgctttagataaatattttattgtagatttcaatattgttgcaattgtatttgactcagcaaaaatagtttttataatttgtcaacagaacttctttaaaatggcttcctaagttgtttcagctaattatgaggtatggtgatctcaacctccttccaaccactggtccactcttgagtcttcaggcttttttttttgcttcaagagtagcattgtaagtttttagtcttcagagaacaggaagaattctagtttctcagttcttgttctgatcaggattgtattttcttttcgtcagtttgtgctctgaaactgcagggccaggcagagtccatgctacctgataaagcatctggaaccatggaaaactgagggtggatatgatgagcctctctaataccagagatagtggacagaagccatccgttttgcatttggcttttttgaggactcagtaaatccacacagagaattagctaaggctgtttgagaaacagcctgtgggataatgaacacttttatgctttttaaaatgaccacggggagcctcatcagaagaggcgattccaggattccaagatggcagctgggtttttcattgttcctgtgggacttgcactgtgaagtgtgattgtagctgatttttcctttcaacaggaattcattaggggtatccattagctaatgaactattgatataagaaaaaaggtcagttattttagagaggaaaaatgtggctttaactctcgattatttgtgtgttgggtccatttgaaggcttcttcccctggctcaaaatctggaaaactgatttgaaagaccttcagttttatttagaaagaaggaaaaacagattatttcagttactttatgttttgtgatttttactcgatttacctaaagagaaagtgctcagatttaaattctaggtaccttcgttgctaattattttttactgcacttttatggccattttttatttctaaggattgaacccttttttttgtagttttctctcaagggctaatatttatatttttttgcttccaaaaactgttaaagtctgaaagtgtaaatttatatttgtggtgtttactttgtcctttaaatgtttttgtgtacccatactttttgtcataaagatggaaaaatgatattaaattaaccaaatgaaagtaattaatgctgaacattcactaaattattaagatgttaatgtgattccaaatgcagatagttcatgggcagcagcatgtgtcctgggactccccctcaaaggttggcaaggtttgggcaattttgagggagggagttaattcttaagtagtaagctttttcgtttacctctactatttataagctaatatgcaggatcattgtaaattagtgaaaagtgcattccattgaactagtagttgtaatactgggttaaatatctaagttgtgtgactttgggcatgagtttctgcctctgtgggtcttatttttccctgttatcagaactgtagcattggactagatcatgtttccttgtgtgttttttggaaaatgtgacaatatactaggacctacatgaagtcacagtataaacacccaagggacacaacaggcatatcttcctgcctttcatatctattcacttgaggcttttggtaagacattaattttatacttaagcaaacatattaaagactgaaaggaactcatatatcttcatatagtgttaaagatattaacacaaaaatgaaagaaatattgtccatacagcaggccacagatagatatcccttgttttgtgatcagtcttttctgctatggagggcactttggacacatttgaggatcactgcattagatgacaggaaatgtgtttcttcctatgctcaagttgtgtagccatgacatttgaggatatttacattttgaatttccctcctccctcccctaaattagtggcatgttctagagaagggttcatgtgctttatttacataaaacctatctcaatgttgtttgataagaatctgttaagagatcttgtcctaaaaggatggcacttagtgttggaactggagaatggtggggtgtgaggagttaaagtaattccctaagcacactagacacgcctgatgcccctttcaagccagtctgcttccacgtggtgattctttctgattcccattatcactgtgtccccctcacccctgccatttagcctagattctggcagaatggaaatccacgtttctgaatttagtatgatttttttttctttccttctattctcagcaacaataagtactcttgatggcagctgctgtattaagcccaagagcttaaaagattaaagaaaccactaacagcagtaaggaggaagtttaagggcctgtttttctgaaggtttgtgttttcattctgatggttgagtagaaaattacaaacaggttgtgttcggcagctggaatgctctccaacatctggggagacccagccttctgtttatttcccattcattggaagggtggccagccagtagcagaaactgcaggcagagatactagaactctttgggtacataagccgttagaaattctttttttgtagaaatttcttcatagaaataccttgttctctattttttcataagcttgactgagcacttaacttcaggtcagttgctgaggaagaggtctgaaggtaatattagtacccccccaactactttcagctggaaacaagagttgtttgggcccttactgagttcctactttagagtcaagggctggccttcccctgcatctgtctgcatatacctcacagctgagcagataacatatttgtgcagctattcccttatgatttcctctctattagagagaggtggagcctatgacagactgcagagtgtttgctccattcttccccaccccgtagctttactgaggtatagttgataattaaagtatttacatatatttaaggtatatagcttgattatgagatatataagtatacattgtgaatattcaaaatcaaactaatcaatcactccacatagttaccgcttttctttttatagtgagaatacttagtatctaccttcttagcaaattttatttatgccacatagtgactatagttaacaatattatatactcaaacccagttattttaatttttaatttttttagagctaggatctcgctctgttgctcaggttagagtgcagtggtgctatcatagctcactgcaacctcaaactcctgggctcaagcagtcccgccatctcagcctcccaagtagttaggactacaggtatataccgccatgcctggcctaatttttatttttagagatgaagtctagctttgttgcccagactggaatgcagtggcatgatcatagctcactgtaggctcgaactcctgggcttaagtgattctcctgccttggccccccagttgctgcgagaatggtgccttgttctcaaaaccattttgtaaaaagtaatgtgctggccaaataaaacagaacgccagtttgttatttttggacagcttcattattttgtacatgggaaaagagaagttcgaagttttgccttatgcaaggtcataaagctggtcagtggcccaaccaggtttagaacctttatctttggggctatttgagaaattcaagtgatcccagttcaatcattagtggcatttgtggtcttcagtctgcactgagcaagggtttcatgtttggtgtctaatattttaggattattagagctaatctagcctttggagaagccaaatggattttgggggttgtctgtaagaacccatcatgatggctggaacagctcttaagtggaacttctacataaatcaacttgcatttgttctgtaacaccatgtgaattttcctgaatttccaagtaaatatattttgcatattgcttacaaattgcttaggctgtcttcatgaataatgaaagctgtgctgtaggaagctggatattaagaaggggtgtttttaaaaacagtatttcatttcttttgcttatattttctgtagcctcaagggtgtgttcagaggtggtagggagggagggtgctgttaaggtttctcaacacctgtgttcctttacagaccattatctcttctgctatcaaagaggacttgccagttaggtcaggatgcataaacctctggacagtgccttctcctatgcttatctttgctatatgtcttgttgtgtgtttagcttccataacaaggttctctacttctccagtttaagaagaaatcatctgttgtgctgaacctctattcatctcagtagggaaggcaccagcttcaagaggctgagaagagacccagagccagcaaatgagacatggggttttattaggggcttacatacaggggagagagtccagtggtggcagactggacaacatactggcaccgctcagtggcagagggctgggcaggaaaactgcagccgctttgcaaacagcatgcagtttatatagcattttcaattaacaccctccccttaacaactttcacctggcaacttgcatgccaacccaaagtttagggcctcaattccctgtatggcccatgttccgtggcatgggcagggggctcagatgttcctcctagacaaggaatgaatctctggattggccactgtgggactccctagctcgacacacacattcaggtgcatctgccatacagtgtcattttaagggtatgctcaagttattgctctcagaggtgtttaccctactattatcatttgacaataatacctatatgtgacgtacattgtctagtgacagtcctgatttccagtagctcccacaacaacttcataagtatcatagccccactttttaggtaaagaaagcagaggtttggggattgtgtcttccctagtcgacacaccttgacagtgtagaaccagcattcagaggcaaatctcacttaggcctggtgttctttccaacatgcctcagctgctgctttgccttctctttctcccttcacctggcattttgaccacactaattgtgctggcatctcattccagggagtatgggatgagatgccagcactagagtatggctttcaaaacattttttgtcccagctcacagttacaaatacagtttatgtcatcaagtatacatacatatgcacatgctcaaatgcacatacatacctgtgcttacatgtactcatataaaactgaaagtttaattatatatgcagtaaactctaatatttccttttctgttttacactgttaatacatactcacctgtaaccgttattactcactaaattggttttacaatcaagatcacctgcggttgaaacagtgctatagagtggaaatctttacggtgagttatgtgctctctcccctcaaccccttacgagatttttaggataatccatgggagcacgaaaaaaacggttgaaattatattttgatttatttccatcttaaggaagagattaaatgttgctgttacttaatatccgagttgacagtgcagcatcactcgggctgtgaaacagtcagtccagtgctctgtagagtgtggcaggtcctgaaggaagagtgggagttcctaaagtggcacactccttcagcctttcgttgtgtgatgtgctccagtttgtatggctcataaagcatgttagtaggttatattatttacttttggcaaagagaacaagtggttttatttttatttttcttttgagacagggtctcattccattgtccaggctgtaatgcagtggtgtgatcacaactcactgcagcctcaacctcctgggcacaggtgatcctcctacctcagccttccaagtagctggaaatataggtgtggatcaccacgcctgactaagttttttctttttgttctttctttttttttttttttttggagagacggggttttgccaggctggcctcaaactcctgctgaagcaattcgcctgccttggcccccagaagttctggtattacatgtgggagccaccgcaactggcagagagcaagtgatttttaagagtttcatcaaagaaactgtggaatgagagaacataaacacagggcaacagcaggaaaatgacagagttgacttttttgttttaatgagctccttatcaaccgcatcgctgggtacaaacagcgactatatagtcatatctagtagggagtcagacaaaaaattgaagctattttaacaagtgagaacttaggtttatatccatgattgttaatgatttaccttgtcctgaatggatgttgtaccctgagatattagctaatatcattatgttggataaaatattaaaagttgtattcattttatctttgtgtcattccttatgtttatttgtatattttatgatatatgtgatatatctgtgccttatagttacatatatattggggaatatgttagaatttttttgtactgataaagattcctaattaaaaacatttggagaccatttctattctggaggactaagtaattattaatgggtatcttggggtctagatgaagagaaggaaaaggtgaggacacaggaagggagtgaaacagggagggtgtttgtgtacaaattagataacaaccctcccaagtggattcagttccaggggcacatggtttggtgagtggcctgtgccttcgtgcaggttataaaaagtctcccctttctcctggcatagcagctctacactagggcacatggtttggcaaatgggttgtgggctggaattcagcaccctttcagcccttcatccttctgcaagtgtagcctacacaagtaagtatatgtaacagccctggtggtgaggtactgaaaataaataaataaaagggcgaaggacaggcattcatggatgtagtgagcagcaacagctagtcctcactcttttattcattcattcattccttcaccagagtatttatagaacacctgctgtgtgccagccatcttcaacagcaggagttggcaaactatagcccaccggccaatcccgacctggtatctttttttgtaaatcgggttttattggaacatacctgtaccccttggtttatgtatcttctgtggctgcttcttagctataatggcatagttgaataattatgacagagactgtatggcctgcaaaacctaaagtatttactttctggccctttactgaaaacaggcgtgaacctctactctagaatataaatcaggacttgcttctggtgccactgcatgataacttagccatggactgtttggcttctatctcatgttccctacttgcaagaaaatacttccatcagggccaagtggaggtgcagtagagcaggggcagagctaaaagcaacacagctgggcacatttacttcttaggtctctacacaaaccatgtagtgtaaggaggagacaaagggctaggagtccagagactgacactgtgtggccttctctctgggcctgtttcagatagtcactctgcaactacaagatggcactggattagtgattctcagacgtttttctgcaccaaaatcacctaaaaggctggtttaaccgactgctaggctccacctccaaggtgtctgagtcggtaggcctgaggaaggcctgagaatgtacatttttaacaagtcctcaggtaatgcaggtaggcagtatgactggattgtttttgtggttgcctgcctctttttggcattggaaaggggaaagccagagtattccttgaggaatgacatttggagagaaccaaattttagatgcttctgtgatatgtacaccagagctattctggactagattgtaaattctcacatttcacctatgcaaaaggaaatactttctggtctcctattagtaatcagttgtctcaaattttgcccgttacctctggaaattctggaccctcaagtgatcagtcttttaaggcagtgtggaagaacagcacctattatggcagttgatttttcatggtctctaccctgtccttcctaatataactgctattctttaccttcctgtttttcaaaactctcgtattgttcctgttgtgttttttctaaatattttcttggttacaataaagtgctaatatttaaagagcttttgggagcctgctggtgccagaaactattcaagttacttacagaatactctcattcagttctctcaaaaatccttggggaagttttatttttctcattttacaaatgagcagtaattacaaatttggagtcagagaagctaagtaatatgtgatctggacaatttcaatatctatgtatatcaaaaaccaagcttcctaggtctttgacctcctctccagtatccctcaccttcacctgctaagtatccattctcattttggatctcggactttgttatcacctaggattcgcccaggatttcactttctcggatcatgaccttccacatcatactgtcactgcatctcaggagtctgtttcttggaaaagctttacgtctcttatcctttttcttttccaacagaaatacctttctgaactatttctctctcttaaacctcttttaaaatctgcacacttcatactaaattgtattgattatgcttctagttccctagtacataataacctttggaaaaattgttttgtcttactaattgtttctatagaactctgtactgcacctggtgtatagaaggcactccataaataatggtttaactgagctagagaatatatggccagggtctgagtccgagtctgtcttgcttcacagtatggctgctatagtcaggtctgccacagctctaggcctatttttttttaatctgtctggatgaagaaggaattgtttagtaggtgatgtcatttgtgggatgctttgtctatttctgcgtatccagcatgcttttagtgatttttcattttgtcagactgcattttctcttttcaactagagttcaaacaaaataattttagataacatcctaagaacatttggaaacatgacatttcaggtctattttccctctttgccttaaaaaagtatatacagctataattactaattgctgcgctctaagtagagacagatgatacatatgtttgtgacaattttccagagggagagctaagtaaccaggctcatttttccataatgtgaatgttattcacaaactattaccataattgatgcaccaaaccactgtagagtaaataatgtgttgtgtgtgggaagcaagctagtagtcaatgaatattaaagaacaaaacctcattttaaaagagaaactgtaattaaaatcattctgaattcatgctgcacaaccagttaaaataacttggctgccatttatctgtgtaattctgtgtataaagggagtaggtatatgatttgttatatagaagtaagtatttacatgcacatttttatgaaaagacacaatatcgaacttcagaatcagtcgttttccaaaaacatttgttggagagatgaacatgcagagttaatcagtgaaatatatattgacaggaaagatcaccatttccgttatcttatcttttgcttttctaggtgttttatgtctacctggaatgtcgtgtccctttccgtggacctaatcagcttctgtattttctccaaagcttccttttcatcagaagttgttcttgtccacttttaatccctcttactgctttctaggtgctcatcaacttctgtgtgtggtatattgatttgcacttttgggatttgttgttttataagaggaggtcataagtcatttcttgtgtgtatcattagtcttctcaacgagactgcctaggatttcagtctcagattattctatgtgtgtgttgggcgtgtatgtatgtgtatcattccttccggtgtaccttgtggagaatggtttgctgtccatgtgttcgctaactcctcagtatgtattgttggttacctgttttcatgcaccagatactgcattatttttgtaaaatctttacattttgtgtttggctaccagtgtctccacagagtcttgaatgtaactggtaaggatcagatctgttggtgtagagtttttgatggaacactcaatcagcaatctgtagtatggcttatgtaaaatgtataactccctctatctctgataagttctgaagtctaaggggaaagtgcttccctgtctcttgaatttgagtgttttgggtgagtccattttatagatagacaaggtgattgtatcagagcttacttttatattttaaaatggatcatagtgtacctattcttaggaaccttttaggaaaatctctttaacattgatcctgttgttagttgtaatctcagtatattctgataatttcctttgaatatgtaactgttcctttcatactgtgggcatctgttgtcttctctttttatagcaatgaaagtatgaacagattccaatgtgggttcttagctcaaaattctctggctctaatgtcaggccaatttatttagctagtttatacaactggacatatttctataatagaaaaatgactaaatgtttcttaacatattgtttacagagatagagcccatgttgtaaggctatgtaactcttcctctcaaaagaagattattggttttagcatgttttcctccctttaatttaatcttaagcaggtgaacctttttgagggctttttggaaagctctgaggaaaaaaaataagaaaactcatacaacctcaaggaattctaagtatcaaggagcacctctgtgaaggtgattggttcaagcattgaacactattttctatccttccacacatggcagggcattattcatgtatccagctctgtgatagcttgtttttgcttgccctgatgatacgtatggcaagggaggaatattatccaggagtggacactgtagagaggggaaggaaccttggaactgacctttatagaggcggttctcatcctcaactcttcttccttacaagatggcttggtatcccttgagatcattctcccaccttcaaaatcctggatgggcctcttgcctggttcccttaaggactctaaaccacttagcttggagctggtgccatttaattctgttcttggcagtgggccctggcttctttcctgctaggccctgtacctcttaggagcagagaagaggtcagatgcagataatacaggcatgatttctgcctcctgaaatgctcagatgatatgcacttctccgtccccctaaagatttaaggaagtacacatttatcatgggatgtaatgagtaggaaagagcatggggctttctttttctgctgaatagcagattgtaagatagaaacagttttgtttacaattcagctctatctttgtactttgcattgcagttgaagttatttttagctttactgttaagctaaacgtctgagttgtttcatttgcaaattctttctttgagggtcaggggaggcttttgtaaaatgttcaggtctgagagaattttgagttaggtaaaggtgagtgtgtgcatgcatgcatgtatgtgtatgtgtgtgtgtgtgtgtgcacagctcgtgcataaatgcctgtgtgcttgcttgggtagggactaggagggctgaaaaagagagagaaagtcattcttagcagaagaaaagcacgtacaaagggtggaagacgtacggtttttgacagatgaatgaatccttctaaaggttttgtaagagctgtgaccagctctgtttgctgagaaaagggaaagtccttgagcacccatcatacctcttcagactctcttaaaaagcattcagatgttctgccagaggaaatgatgtgttccaactacagctgcagtggagggttctttttgtgcagctgaagcaattcctccacatagattgtcccattttaacagtaaactgtctgtttaaaacaaaacaaaaaaggtgggtgggaaatggaaggagaaggagtttatgccaggaaatgaaaataagttgctgcagaagcctgttttggttgtggtttcagagttaaggataagttattaataataataataagagcccacttgatagtttgttatatctctgtgtgtgtttttatgaacttttaattttccagaaaacattaaagataaattagagaacacactcctgttggaggaggtgaccatcttgcagctaccaaaccatagaatctttcaccacttaacaccttccaaggaaccgggtagacttctggtgtcctctctggtcctcttcccttccttataggatgtcaggctttggacttaatcagaggataattaaggctctatcatagcaggtgaagtttctgagtggaagtctaagaagtgatgtttctataagtgtctttagctgactgagctactaagcagaggttaggaggttgtgatgtaatttaaagtgacattgtggttaccttttatcaagctcaattgtgagcctggagctatgttaactgcttcacagctatgagcctatttaattcttacaggaatcctcattttaagataggtttgattaccctccgtttacagatggggaacttgaggtagagagataagtggttagtttgcaattacacccagcatttggcatggctgggattggaaccaggggccttcagtcttcaaagctcttacatgtaaccactgagtgatgcattgtactctctcctgtaaagtagccttttctccctgctgccactggttcatttccttttccttttttaagatgctttaaaaagaacaaaaaccaataacgtacctcctaaattgaggttgatctccctccttcctatccaataagtaatgttctagactcatgcaaatattagatatttgggagaaaaaatgaatagaacatgtccctcctctctttagctctaagaaaatttgtgtgttcttattaattcctactgttccactatcctaccatattacctgatacatataatacagttacagtcttctcagggagactcttctatgcagtggcatgctggagccaggaaagcttgtaaacccagctcagacatggaccagctgtgagaccttggtgaagtcactttaccctccgggctttacttcttttatcactgtagtgtttgatccaggtcagttcgcagcctggaaggcacagccttttccaggacactaaatagggcacatgtgctacccatttgcgtgcacactatccttaggcatttgttgaagagatggttaataaaatataaactcattaaaaagcattactaaattcttacattttgtgtttctttgatcagtgaatgactgctaaaatttagtacgttatcaatggggaatttgttatctctttttgcataaaaggggtcctcggttttcgtgaagtttaaagtccctccccaggtagaatatccataaagcctatgaatgagtcttaactacttgattacccagattctagctttttggaatctttcattaccttacttttttcccttctcggtgagcttttggacttaggacaaacggggaacgatcacaaggaaatggattgacatctctactctttcacaatctttcctgaagacatgatttttttttgctatcatgtctctaagtacagttggtcagttgtcactctgtcaccttaccttccaaccccataattcctgtgaaaccctggacacctcactctttttgcagaccatgagctcctctggcctcactcctttccttgtccagcttgcagtacttgagtaatcccctcacccctcaccaccttccttattagtacccccagttccctgaagctcttgtcctgcccatttcctcccagcagcatgtcactcatctgccctcatgagcctgtgttccccttacaagaatcacatctctatctgtactgttattatagatcagtgaacttcaacatctgatagctttttcagtgttgcccatcagtgcatttaccgagttgctttttctatccttttggtgatagttccaaatgctccccactgtccccacggctataatgataggaaacattaatacaaaacttggttgtgttggagaaagtgtgctaagaactttacatgcattgtctcatctccgttcttgctaaaggatctaacttttccttccaaccatccagcaactactagcgaggcatcaactgtgtctatgcatggtgccaagccacagactgtagctatgattgatgcagattgggtgcttgctctcaagagacctctaattcagagggagatgcacagaagtaaacaggcagcaataacattgtccgataagtgctaatgaggggagaagttcaatacgctatagatgcccccaacccagacttagggttgaggataaggaaaacttgcaggaagttacagctcagtgccaatctaaaggacgagagactatgagggaggaacataagggcattctggacaaaaagaatacctggctgctggaaagatttcagggaattgagaggggccagtaggaacagagccattcttctcagagaaattagaggtcttatttttggtgtgaattccatagactctcttttctacctcctctgtgatctgtatcctcacttggttactaactggaattagaatcccctgcaatccttcactgtatgcagatctcgtaagacacactttctgtcaatctcagtgtgaagttttactatgcacttgtatagctgctccactgaaatactattagactgttaaggtgagtgtagaggacaatgcttcttcaaaattattacagggaagtttataataatggtgactgacttgaggtaggggtagggtttttcaggagggtctttcagtggtaatcacgcctaaaattttgaatgcttaaatgaagctgctgcttagctcaatgataagtaatagcagcttctttttccatgaggacatttattaaatgatgttttaggtctcagcaaatgttacgccttcagacaccttggctcaggaaagcctgatgtgcctccagtgaaggatttgtaggtccacatcttcgatgcttctgcaacacagagttagggaaatgaaacagtgggtcatacatgctcctgatccattgccaacagcaaagggacttgagcccccacataccttttgacccttctggtcatgataaagccacccactagctataatgctatagtcagcagtagaaataagagggagcacaaagcaactgaatggtaaaatatttcagacctttttggaccactttggaagatggaagctgataacatcatacatccaaattcctctgcattgctgtctctctctttacaggtggggaatagtttacagcaatcagtagaatctacttttgattccaaatgggtcttaattattttgtatttgggaaatattttttacttggcaatagagatgtgccataatattatttaatattttggaaatcactgtttcccatgtgcctgaacatctcgagcacatttaccctgagcgtggcagtgcctgggtgtctcacatccatgtatgctcaaaccatgctccttgatttcacccctttctctctgtttctttcatctcgtaaactgagtgctgatgccatttcacactttttcttggaagtttaatgagttagtagtagtataacaaaaataaaaatattttctttacgtttctgaaaagaaatatgtctataaagcgtcaatcatttttccaagctgttagttcctgctgctgagtactaggagctgttctgtcagcaagaccacgtaagggggaatagtaagagaaagctgtcccaattttctttctctggtacaaaaggttagaagatgttgtttcagctggagaacttaagatggattcttattcactatttgctaaagagactggactgtttttagtgtgataattttctgtaggcgtggagaaaggtcacctcctgatcttgttttggagatcatggggttaaatctgtggcagtgtccttttcctagacacagcctcttgtcaaaataatgtttggccaggtgttaatctgtgtcctgaggggagtgctggaattcattattcatcccgtgggagtaggggtcagaggagaaggttgtccttctgggaggtaccaggggacatagcctgcctcctgcctttactgacatgtgccatttgtgaggagggcagttgaagtccatttgaggaattctcttgtcagccggccaacacagaaacacagagggagtgggagggagggagaggcaggcagcttggcaaggcagtcctggagtgcagtttccggagcaagatcacacacagtgttttaggagctcagggaaggtgtgcaggaacataaaggggaagggggccaggtttgaaagagtggatttttcctattttttccaccttttattcctcctgtctttgaatacttgtcatcctttggaaaactcagcatcggaaagaagcctttgctgacacactgctttttctccagcgctatattgtgggttttttgtttttgctcttttcatttttcttttcctctgagggcaggaggtgagacaatgatcaagtcaagctggttctatgttaagttcaagtatgcagagaaggtaagtcaatatggtttcttttcccaggggaaacctgccacctccctccagtcttgtcatgttgatgggctcctctggccacttggggaagtgaatgaagctgagaagttgtatttgtgaatgtatttcctttggcttaatgatccttggatgaagcacaagctctttgcttgcaatctgacgttgccgctgaccaagtggaagcaatcttcagactctgttccggaggcatgatttagagtttaaagaggggaaataatgaaactacaataacaggaaaggcaggatattctgctttagattgaatagagaattttcaaggtattatttgttacaaaggtagatatatttttggttctgaaacaaattgacagtcacttcctattacctgttggcttagaatttttttcctctttcagttaactaactgcttactcatttgtagtcttacttggttgtagaaagaatccccataaggttgtctgaccatatatgagatgatctctttactgtctgtcaggggattatattttatgaatgaattttggttgtacctaaaattttgatgttaaacagttccactgtattttaacataccatttctggacttttaggggaaaagtgtactttctaatacatcttcacttaccggggctgtttgacatctttttggttccacatccatatgtgtcacttactctgttgggaatttacaggattagaaatgaggtttccaggagaggatatagctcagaggtagagcattggactgcagatcaagaaatgagatttccaggaggatcctaacgtgtgcctcccttttgaaatcttccctccttgatttgattgttgaaaacgttggcatattgattgtagagttaagctgaggctctatagaatggaactgtgatgtggcaagatggaaaattgtgcgactgtctttatactccttatgattatatgcataagcacattaaatatgcctcttccattcacctagtttaaaaaaaaagttagaacattttcaactcctttttactgcattttttttttctgtgtggacttgtttctgctgtgtttttaagacagcaaaattactctttctttacccatgttgaaattacaggatttttatttaaaatatccattttttattttaaactcacttgcattgttaactattaaagctattataagtaaaatattatctattcatgcacaggattgggaaagattgtggtttgggatttttttttctcagtagattactttcctttgagaagccgaccatccattgtttgctgttatgaattttgataactgaaaactgtactctgccttcttatgctttcccttttatcttgaatgttctgtcatgggaacctgaaactcaagagttaaggcacgtaaataaactaatgtgaaaaggggaaaagcatttccagaaatgattgtcataaaaagaaaaagaaggagaacgttaagttaattgcttcatttgaattaccatgctgctattcctttagcaaccaaacaagcagagaatgcttccatatggcaaggcacaagtgtaatgtaaagctaagtaatgtaaggctctatacctaattgaaggatattcgtcttgattttatgaggatagaagaaaaagagaaatctcattcttgttcttggcatggttatggtgctcaagatctcagtgattctctgcagaacttttgttctttcacaatgattcaatttaaaaattttcattggagatttttgttttccaaaactcatcaagatggattgagttttaacctagagagataataagtcttagtgtaaacacagggacagcattgataacaaaacaaactaaaaccatcttttttgtattcctctaaaaagccattcttacaaaggctttttgatttggaatttccctcactatctttaaaaggacaaaaaaagaaattcctctcttgattgtcaactactgaccattttgatttgatataagcttgtaattgttggaaagatatttctgctgtgatgtttgtccaaaactataagaaaatacatcacacaatctcttcaatatccatctcctagtttatcatttaggaagatgatttaatcagtcttcagtagtgagaaagaaaaattaagaatggcaagtaacgcatgaccaaaaacattggcataagagaatactgttcacttgtgatcactggaatcatgatccctttcaaaaattaaaatatataataaaacaaacactgtttttttaaccaccaccacactaacacacatgttcctctgtaagaatttccatctaaattatttatgagttgtctctttcttgaattagattggtgcctagctatctttctttctaaaagagtgcttacttcaattaatttcatcctataccccctttctctttttattctacatattctccctgagcaatttcctttttggtgtgtttttctatgtcctataagtgatgattccaaaagctctatatctagcataatatctttcttgagtttctgaggtatatatttaattggttaggtagatatctgtcctgaagttcaacagattcctcaaatgcagcatttctaaagtatagttaatttcttcttccttaaccaaggattttcttcctcttacatctcctagcacagctaaggcatccctatccagccagtcatctttgttcccaaaggagctgttttagttctgttcttatcatctcccttctggcttattagaggagcctcctaatcgatctccctgccacattcatggtgcttccagtgctccaaaaccctgctagaggtatcttaaaaggtcagtctgagtctgttttgctgcttgttaatggttcccctctcccatctaagcattctcactacatctccctcaacagtgctagcccttgaccttgtatatacataatacaccttattgtaatttcttattcacctgcgtcttctatagtaacatatgatcctagagatacagaattacattgtgtttttgattttgatttttctatccagaatccctgcacgtaatagatatttattccctgttgggtgttgtggctcatccttataatcccagcactttgggaggccaaggcgggagaatcccttgatcccaggagttcaagacaaacctgagcaacatagcaagacctcattatctgcaaaattaaaaattaaaaaattagctggtgtggtagcgtgtgtctgtggtctcagctacttgggaggctgaggtgggaggttcacctgagcctgggaggtcgaggctgcagtgggctatgatcccaccactgcactttagcttgggcgacagagcaagaccctgtctcaaaaaaccatttttcccccctaaatgctactgagtaaatctgtgactttttcccaggagtctggccgacctgagtttgaattctgcttctgccatttactggtagtatatgaccttgggcaatatattgaaactcaattgaattgttttctcatctattaaatgaggagtattatcacctaatgtatttttcagttaaacttcttattttgagataatggtagtacgtaataatagtacaatatgcagttttaagaaataaaatgtaaagatcccatatgccctttacctagtttcctcaatggtaacatattgtaaaaccatagtaaaatatcacaacaaggatattgacatcagtacagtgaaaatacagaacaaccacatcaccaaaagtctctctcctgatggcctttgatagccatgcctctttccttctaccttcacaacccccatcattaactcctgatatgcaatcacttttctccatttttataattttgtcgtctcaagaatgttatataaatggaatcatacaggatgcagctttttggaattttctgtttttactcagcataatgttttagagattcgttcaagttgtatgctattagtttctgagtagtattctatggtatgggtgtaccatagtttatttaatcattcttctgttgatggacatctgagttgttttcctagaagtactatgaacatttgtttataggttttgttgtgaacataagttttcttttctctaggataattgtccaagagtgcagttgctgggtagtatgtatagtatttgcgtggttaatttttaagaagccaccaaactgtcttcctggctgactctactattgcatattctctttagtgcactgtattagcgattccgtttacttgcgcattcaccagcatgcaatgatgttggtggtgtttctggttttttattttagccattctattggtgtgtactgatggtgtccagtgatgggttttaatttgcgtttccctaatggctaataatgttgaacatcttttcatttgcttatttgtcatttgagtatcttcttttgttaaatgtctcttgctctttaaatgtcttttgcccattttctaattggatttaaaaatttttactgttgagtttttcacagttcctaatattttctagacagtaagtctttattgggtatgtggtttgcacatattttcttctaatttatagcttgtctattcatcctctttcagagtcttcctcagagtagaagttttaaactttgatgcagtccagtgtatggatcctttcctttatattcttgcttttattgtcaagtcttaaaactctttgcttatcctttgatcctgaagatttttcttttccttttttcctaaaagctttatatttcatatttaagtccatgatccattttgagataaattttttataagatatgaaacttaggtcaaagtttttctttgtgtgtgtgtgcgtgcatgtgtgtgtgtgtgtgtgtgtgtgtgtgtgcacgttcctgtatatgtccagttgttttagcaccacttatggaaaagactattctttctccattaaattgttcttgtacctttgtccaaaatcagtttactgtacttaaatgggtctgttttgggtttctctattcctcaattgatttaatgtctgttcctctaccaagatcaaaaagtcttgattactgtagctattctttttcaaaattgcttaagataaaatagtacctgtgttttttcatataaattttataataacctcatctgtgtttacagaaaatctttccggtgttttgataagaattgtgttaaaccaggatattggttttgggaattttttttttaagtactttgttgagtctttctcttcatgaagaggtttgtctctccgtttatttagatcttgtttgatctcttttatcattttgtagttttcagcatacaagtcctatatgaattagatttataactatcacttttggggggcacttgaaatggtattgtatttctaatttagattttacatgcatattgttagtatacagaatacaacttattttcaaatgttgttttttgtatcctgtaaccttgataaatggagttattagtttgaggaacttatttgtagttctttgaaattttctgtatagacaattatgtcatttgcaaatgaggacagatttatttcttcctatctgatatctatgctttttaaatttccttttcttggctaattgcactgagtagaacttctcatgcggtgtgaactaagagtggtgagagtgaatatccttgtcttgttcctgatatttggggaaaaatgcattcagtcttttgctgtttagtacaatgttagctgtaggatttttctctatgttctttatcaaattgaagtagttcctttctattcctagttttctgagattttttttatcatgaatggatgtagaattttgccaaatgctttttctgtgttaattgatataattattaggtttttcttttatagcctattaatacggtagagtacattgcttgattttcagatattgaaccattcttgcaagcctggaaaaagttctatttagtcaatgtgtataattctttgtatgtatcgctcaattttatttacttatattttgttaaggacttttgcatctgtacttacgagaaatactggtctgtaattttctttttgtaatggttttattatgaggatattactggctccataaaatgatttaaaagtgttcactccttatttgtttgctggaagagattatgtataattggttttcattcttctttaaacattgtgtggaattctgtagtggaaacccatctgggtctggaaacgtcttttttagatattgttaatttaagaaattaaattttcttaatttaagttattgggctacttaaattactgtttttcatatttggtgggttctggtagtttttctttgtaaggaagtggtccacttcatctaagttgtcaaatttaagtgtgcagaactgttgatagtattctttattgacttcttgatgtctgtatagttatattccttgtttcatccctgatattgataataatgtctgtgtcttttttctgtgtcagtcatactagatgtttgtcaattttattgatttttttcaaagaacaagttttgtgttccattgatttttctctcttgttttcctgttttcaacttatttttttctattctgttatcttaattatttcttccatctgcaagctagaaaaccaggaaagctggagagtgtagttcagtctgactctgaaggcctgagaatgaggggtccagtggcgtaaatctcttttcaagactgaaggcctgagaaccacaagggctgatgttccatctccaagggcaggagatttggatgtcccagctcaaacagagagtaaatttctccttcctctgcctttttgttctgtttgggtctcaatggattgaatgaggtccacgtgcccaaatagggcatcttctttaataagtctaccaattcaaatgctattctcttccagaaacatactcacagacataccaaaaaataatgttttaccagctctttaagttgacacataaatttaacaatcacatgtatctttttttaatttttgctgcctatattgttttatttaaagagagtttcttatggatagcatagagttgattcatttttacaagttactgtatcattgctctttcttctgtcctagtgacttaagatcctttcttttagctatttttttttaaaaatagaacttcctttagccattcttttagggtagttctcccagtaactatttatttatttatttatttttatatgaggttgtcttgattacctgttgcttactgaggaatgtttgcacttgatgtagaattttggttgacagtttcttttgtctttttctttctttcttttctttttctttcaagccattgaaaaatgttgttctctttcttctggccttcagggtttctcatgagacatccactatccttcttttgtctagatgtcatgacttctttctccctggctgcttccagatttttttgctatctttagcaaagtttaactatgatgtgtcttggtgtgggtatctttgagcttattctgttttgtattatcatagctttttgaatctgtaggtgttgtttttgccaaatttgagaattttcacccatcatttcttcatgtacttttaaagccctattttccttttcctctctctctgggactctgaagacacaattgttagatctttggttataatcccacagatacctgatactctgttttttgttgttgttttgtttgtttgttttgtttttcagtctctttttttctcttttgtttagatgagtaattttagttgttctttcagttcactgattctttactctcctccacctggtcttgagcccatccgttgaatttttttaattgttttttttttatttttatttttttgaggtggagtctgctcggtcccccaggctggagtacagtggcatgatctcggctcactgcaacctctgcctcctgggttcaagcaattctcgggtctcagcctcccaagtagctgggattacatgcgtgcgctaccatgcccagctaatttttgtatttttagtagagacagggtttcaccatgttggccaggctggtcttgaactcctgacctcaggtgatccgcccaccaaagtgctctgattacaggcttgaaccatctcgcccagctgatttttaaaaaaaatgcattttactctggtaaagatgtatttaatgaaatttaccatgttaacggttattaagtatacagttcaatactgttaaatatattcacattgctgtgaaacacatatccagaagttttccatcttgcaaatctgaaactctttacccattgaacaactccattttccttgctcctctcagcccctggtagccaccagtctactttctgtttctctgaatttgactactgtggataccttatgaatatggaatatacagtatttatctttttggcactggcttatttcacttcataatatcctcaagtttcatccatgttgtagcatgtgacaagattccttcctttctaaggctatataatattccattgtatgaatatacggcatactgtttgtccattcatccattggacatttgagttgcttccacctcttggctattgtgaatagtgatgctataagaccctgcttttagttctttttggtatgtatgtagaagtgggattgttggatcatatggtagttctgtgttaaattttttgaggaacctccatagtgttttctatagcagttgcaccattttacaatcccaccattagtgcacaagtgttctaatttctccacatcctcttcaatacttgttctctgtttttcttgatagtagcaatctcaatagatctgaggggataatgcatttctctaatgattagtgatgttgagaatctttgttggctacctgtgtattatctttggagaaatttctattcaaactttttttcattttttaatcagttatttgtttttcattgtttggttgcagaagttctttacatattctggattttaaccttttttcgggcatatggtttggaaacattttttcccattccataggtttctttttcactctgttgattgtgtcctttgatgaacaaaagtttttaagtttgatgtagttccatctgtctgtttttgcttttgttacctgtgcttttgttgtcacatccaagaaagattgtcaaatccaatgtcatgaagcttttcctcaatgttttcttctagcagttttgtgattttatacttttatgtcttacatttaggtctttatccatgttgagttaatttttgtatatggtgtaaagggtccagttttattcttttgcatgtgagcgtccagttttcccacaccatttgttgaataaactatctttctccattgaacggctttgacacctttgtcaaagattgtttaaccatgtatgtgaaggtttatttctgggcttgatattatattccattggtctgtttatctgtcttcgtgccagtaccacactgttttggttaccacagttttgtaatatattttgaaatcagaaagtttaagtcctttaactttgttctttttctaaattgtttggtgatttggagtcctttgagattacatatgaattttaggatgcatttttctatttctgctaaaattgccattgggattttgatagagattgtatttatggatcatttgtggtactatggacattttaacaacagtaggtataacaatattaaagcccatggtcaaccacaaacatggaatgcctttccatttatttgtagctcttttatttcagcagtgttttgtattttgggagcagtgttggaagtctggactccagtacttgtctttacagtttccctcttttctgattctttggctaaagacaacaaacttttctaggggcttgttttggtatgtgtcattgacattactgggtttctgttttttcaactccaaatctgatgacatcatatatcatatcggatatatgagacctataaaatgaaaactcctggagaactcaccaccatgtcatttttgggggcccccaggttttaagccagtacgtcatcttcttttcacttttcagagtctgtttatatttattttatgtataatgttgagggattttagttgtacttagtgtggataatagggaaaagtatgtctactccattttcttggaagcagaagttccctaagatgcttttaaaacagtggttaaataacataatgttgagagtatttgcatggtgcaaggcctgagtgctcaatagagggtgataattgccttttattatcttcatctttctcctatttgaagtatcagtcacactttgctatagaggcagctccagtttaagtttaccttgctttagataaattgtattatcactaacacatacatttgcatcttcataccctttattgcaattccatcaagatgtagattccagaaacaacattgtcttttcagtatttttctttttccaggcaattttgacaatgcatttttgtaataagactggaattactaattctggttttattgaaaaactgttagccatttcagccagaagaagatcatggaggaaacaataaattttcttcatgagctattcaatccaacgagatactgaattaagtgcaggaaatcagtacactttttgtttgataagaagtgttcctctgaaaaaccattcttagatcattataaatattattggttggatgcagtggctcatgcctgtaatcccagcactttgggaggccaaggcaggatgattgcttgagctcaggagtttgacaccagcctaggcaacatggtgaaaccctgtctttataaaaaataaaaaaataaaaatttagctgggtgtagtggtatgtgtctatggtcccagctaattgggaggctaaagtgggaggatctcatgagctcaggagattgaggctgcaatgagccatgattgcacctctgtattccagcctggacggacagggcaagaccctgtctgtctcaaagaaacaacacacacacacacacacacacacacacacacacacacacacgcacacacgcacacacacacgcacacacacccattaccagtcttcctgggaattttattctatatctgtctataagtttaaagttatgtactctagcttagcctttaacttcagagttaatttgaaatttatttaaaaactatttttggaaatttacataatcatgatgactgcatgtaaactgttagtaatattttatagagtttccttgggttttctgttagaatgaagtaataaatttgtgtcagaaaactatttgggaaatttagaagaaatttaagctaaggaacataagctgtggagcatggccctaagaatccttttattctcatttgataaacagtagaatccagacagggaagaaccttattttctctgcctttgctagttggtggaggaaaacttgctgtttgagacaagtaggacttgatctttctatcctgtacttttttcatcatcctcaaagagggcttatttcagtggatagaccattcatagttttgacagctcaaataacccttaaggatgagcaacaactgaaaagttccaagggctttatttccaatggaaggatttcaattacagtcattttttcaagttagtacaaggaggtaaatggaatcacagtttcaaatgttaaatttgaagactacaccattaccagtgtattttggaaataaaagatgcagccaatctaaatcaaagacatgattccagattacctcataagagtatgaggaagactacaggcagcaattgagccacttgatatggaagagtatgcagtgcatcaaatgtgactttcattaagccgtgttacccttgtttgctactgagggcaggaggcatccttttcaacagcctgtaatagcttcttgttgaaaggctgcctgctatacagatgcagcagcagagagagaaaagagggatacagattcacatattcgccttgttttttaaatgccatttttgccatttttggagttggtttccagtgcttagaatagctgtaagtatatagtagttatttactgtatgtttttgtgtgagtaagtaagagaaggaattaatgaattaggctttataaactggaagtttttgttgtgcacacattaagctaagcttctatcccttctcttctccacatggtaccaccagacttttccccacttcaccccctcatctaccattttttgttttgtgtttttgtttgtttgttttttgagatggagtctctcactctgtcgcccaggctggaatgcagtgatgccactgggttccagtgatcctccagcctcagcctcctgagcagctgggattacaggcacctgccaccatgcccagctaattacatcaaccttttaaaacttatttttctctctagaatttgtttgtgtgcacttaaagagtaagtgggaggatctcaagacagtacagaaagagttggacatctagttcagttttgcagagggagtgcagagaaacttccttggagttatataattgatttttggaacctcatttgtaggatagttgtgtggagaaaggcattcaaattgcattcactgtacttcttaggccaaggtagatctggttatgtacatacttgttatttggtagaatactgcttatgttggcattatcttttccatactacatttatgaactggaaacagttaaagcttgaaactgttaaaaaaaaaaagtgtacgcttacattgtatgtattagaagtcatatgattacacatcctcatcctctcaccagtcctttcatgtagagcagcggtttgcatctttggctatacattggaactaccttgggaattaaaaaaaaaattgatgtccaagtatcaactctggagattctgattcagttgatctgggatgaagccttggcgtcaatttttttaaaaagatccccaggagtttacaatgtgcagtgagggctcgttttagaatggtatattgatttgtgttccaattgttctttcttgcataaatcacatctgtaattcattgaccacagttgtctatgaggcttattaaaaatggtataacaacttacacatacatgaataattggaatgcagaatcattttaacttccctttcccagtctttctatagtcagtttgtatttaattcaacaattgttttttgagaggcccacatttattaaatgtttatcttgtccagcttaatttctctagaaacaaaatctcaccttcattttgtacttatcactggtttacatgtggtaaataaaattagcagaaacaggtttgggtatggtccactgtggtacacgggtgtcttatagagatgagtattcattggctatgaaatgttcagtaagttttacaaaggaaacgaagatcatcagttgatctagctggtcagttggggtcagttaaaagagcattattgtaaaagatttgtggtttgcctgattttagatcagttaacattcacccatgagaaggtaggatgtatgtcatttttattttataagtgaatatgtaactgtatttttttattttgtatttaaatttttattcaatatttcaaattaattaatttctaatgttaatacctaatatacatagatataatcaatatgatcactgttatctctagagtgaagacagtttcttgccaacaatttttatatcccattataaccatccagatgagttcattatgggctttcagtacacactatcagcgcttaagagtcttgagttcattctggtctttgattatcacatgtcttgaaatacacaccacattagatttgtaaataaattgtagaaaaatcttaagactgaaatttagatattaacaaacattatttcctcttgagatatgctaacagacatcagagcattagtaggtcactaaagagtgaagatgagtcagacccatcaaaatacatatactcgttctaccacttgatatgtacacacttcgagttggtaatttattcccagttgtttgtgacggttgcatttgtgcttatcttctcttagtttcacaagggtagctaatcatgagtttttgtctgtttttgctgaactttacctactgtcttattaatcttgtttatatcagtgtgagtttcttaaggacaaggactcgtaggcaccaacacagaaagcaattttaggaatatactgtctgaattaaatgtattaaatcagtcaacaaataggaaccttttgagaaatggtcctgaaaacatttttgtttgctttttttcctagagaggaaataaacgggtttataagctgctgagtgcaagtatcatggtctgtgccttttcttcttgactgctctgctatattctctttcagaaagctgagtagctcagcacagtgaatactaaagggaatgcattccttctctctcaggggactgaagcagtgtttaacaccactgtaaaatcctcagctgtggctttctctggtgtagaatttgtctaagaaagattaaaagaacaaggaaagctttgtgtgctgtttctctttcttttcttcacccctcctgctccaggctatcctgaggggggaaaaaaaacgtggagtattttccttggacctctggagtatgcatgttatgtatgtgtgagtcttagagaaaaataaaggcaaatgcaaggcatgcctgctagtgggagtcatcacccatgggtgaaatgaagaaaactacatgagtgcgtttgcgtttatacggccactttttccattgaatgacccaaacaagatgccagtgacaaagcattggtcctacatgtgataaaacagcggcctggccatttgcttaattggtggagaactcaggtgtgttactcttggcagaggtgaaagccttcatagagaattagaaggggtataatttgggcactgtactcagaatctttcttggtatattgtttaagagcttcattgcagtgactgccattcagcaagaaataagagatgacttttaaatatttggccagattttatagtggcaaggacagagttttagagctgaagagccatttagttcaatcccatcaatctgcaaatgtgaacagtaagcccagaatcacatttagtgttagtggccagaagggagaccttggctatgaacatttaccctaccggaaactaatggcgtaaccagatttgaaccttttcttccattctgtactaggttgtcttttctttgttaggaaaagcctattataaacggaacattgacatgaattttaatttttgcatattttcttacaacatttgcccttactgcattttataactaattgtatatacttttatattttcctttttgtactcatgattctaatgtttctatgtggcatttctcacaatctctgtggggttttattataatttgctaaattattcccttgtttgggggcatttatataaactttttttttttttgccatgaaagagaaagccacagcaaacaatgtatatatgtagctctttattctctcaagttattgtttttgttctcatcatctgagttattgggggtgacttcattacagcagtggaaaacacatggtaacctgccagcatcagaaggtgtcgctttgtactgtgtgtgtgtgtgtgtgtgaaggttatgtgggtatgactgtgtaggaaagaaaaaaagtgctactctttgtagatcaaacaattgatgagtcttaatgtaggattacgtgttgcctgttaaattgctatttctgctgagaaagataaaggcatttttattagtgtagttgattagctttattaatgttggacaaaatcaatgttatgaaaatgaaatctatagttttggggtaaaataaaatttaataggtaggtgacccattcatacacttatgtgaagtaatttttgaaatgataacatgcatgaaaatttactatctatactaaatgtatattcaaagatattcttcctctagggttctagttataaacccttataaacccttataaaatactatgattcacatatacaacttataaaatactgtgattcatcagacagctctagtttcattttatctattgactctgatttaaattatcactcttttttatgcaggaatatgtggtaacaagttatatggtaagaaatttaaatgtaaagattttgacctaacgttgattcagattgtagagctgtcagttgaaaagggaaacttcatgtttagaaatttgagttctgctgggcgcagtggctcacgcttgtaatcccagcactttgggaggccaaggcgggcggatcacgaggtcaggagatcgagaccacggtgaaaccccgtctctactaaaaatacaaaaaaaattagccgggcatggtggcaggcgcctgtagtcccagctacttgggaggctgaggcaggagaatggcgtgaactcaggaggtggagcttgcagtgagccaagatcacgccactgcactccagcctgggcgacagagtgagactctgtctcaaaaaaaaaaaaaaaaaaaaattgagttctaaaatgtttgtgaaaaatttgataggttctttaataaatgtttatttccaacaaaaattttcctggtggaggagttattaggaccagtgagcatgcatttttttttaccgtcttgattgtattatcatattagcttcaagaaatgtttgtttcacgttacttatctttgtttgtcaatgaggtcagacactttcccccacgctgagaacagtatccactgcctctgaggtggatagtctctagaaatcctttccctgtcctggagcagtttgcctgaaagtgccatagttggtagcaaattcccttccactcctcttcctgcctgttaacactttctggaaacccaggtccccatgtgctttagcactctctgtaatcatttgtgggcctctgcagatgagcagtctgggagctgtggatgaggggctgggcaacttctgtcatgtgccattgctgtgagatcttttcttcaccagaatctgggggtgatttagaataatggttagttagtgacatgaagttttggaaagttttttgttgacatttttaagaagaagaaaaactgatgatgaactaaaataaagctgttctttcagccatgtctctgaaaccattgagaaggtttccaggtacattttgggcagtaaagaagatgtggactgggcattcctgtaatcccagcgctgtgggagcctgaggcaggaggatcacttgaacccaggaggtctaggccacagtgagctatggtcatgccactgcactctagcctgagcaacagaggaagactctctaaaaaaaaaaaaaaaaaaaagaaaggaaaagaaaacgtgccctgtttttctgttgttgagccttatttattttccttgctctcagcagctctgtggttccatcacttggctgccttcacggtgcctctgactagttttggaaatagaagtggtggtacaaacaacggggtggagttgcaggatacattgtggtgatatagtcttttcattctctatatttcagccaatatgatcttttcaaaacacaggttacattatagcattctcctgcttaagatcctctagggcttcttattacgctaagaataaaatccaaatacttggtcatggcctatgaagccgtatgtggctccctgcccacttccattcccactgtccatctaggtcctcaggattcccttatcaaactttcttcagttgctctaccacacatccccatgtggtgggttccattctgtactgtagctcttaactcaaacattagctctttagtgtggtcttatcttaccaaccatctaagtttgccccctttacttttttttttttttgagacagggtcttgctctgtggcccaggctgaagtacaatgaagaatatgattcactgcagcctcgagctcctcggttcaagtgatcctccagcctcggcttcccgagtagctaagactacaggcacgtgccaccatgcttagctaattcttaaaaaaagttttttttgtagagtcagggtcttactatgttgcccaggctggtcctgaacttctgggcttaagcgatcctcccgcctcgacctctcaaagtgctgggattttaggcatgagccaccgtgcccagccgctttacttatgtcttactctgttattgtttcctctgtatcttcttaataccacttataaacatctgaaattacccctttgtaaatgtatttgcttatttattattattttcttctgacttctttcattgaatgaaagtaagttccatgagagcaggaccttagggatgttattaactgttacatccccagcacctagtgctatgcctagcagtgagtaagaacattaatatttgttgaatgaatgcttgaatggccaaaacaagcccctgttatgtggcaggagctgtgctagcagtaaaaaatttagataagttgaattcagtctctgcaaacaatgttttccataatctggaattgttgtttggaattctttacagaaattcacatccaggctcacttggaaaaataatcttgctgattgtaatttttctcgttatggttgttcttggcagtaaagtcagtttccaggtgagaatgttactgctcttggccaaaggccactgtaaactttccagtattcctgagggtcttcaggccttactccttgaataagacagtgctccttgcttgaagaactaagttttctgagagtagaagggaacaatagaaagtgtacacatcagcattaccagtttattgttttctggacagttatccaaatttgcttaaggacttaattattaccagatcaaataatgttcccctcactttttagtctagtatatgctgtatgctaccctgtctgtgattctgatttcaaagtgagaaacaaattagcaagcagttgtttggtgaattttaaatgcagtggtgacccttgcccaatctttcataaaaattattttatatttaatgagttatatcttggggttccacaaatagtaggttcgatatttaggattaggtgcataatacctggagttaagctttgcagagctggaatttggactgtgtgtcttggccagaccctggaagcacaaggacaatgttgagatgaaaagattgagaatttaaaatctgtaagaatttaaagccattttacatcacaccataatttctcttcgctggattaagacatttcacagctatttataaaggagtgatttgctactataatttaattcacttgacaatcgtaggacattggatccatagttatgtcaagctagattagatgcaaaattggtaggaagacttttgtagattaaagacatatgacagtgaaatgcagaatttgagcttctattgaatcctagttcgagggaaatgctgtgaaggtcatttggggacaactggggaaatctgaaagttggactgcattagatagtattgaataaatattaaataacctcttgagtgtgttaatgatattgtaattatggaggacaatatgttccctttcttgttctttttgctttctgatagggtcttgctatatttcccaggcttttatagagcagtggtgtcatcatagctcactgcattcttgaactcctgggctcaagggtcctcctgcctcagtgtctctgtagccgggactacaggtgtgcgccactatgccctgtaaatttttttaaaatattttaatagagaccaggtcttgtgatgttgcccatgctggtctcaaatttctgtcctcaagtgatacccctgccttggcttcccaaagtgctaggattacagggatgagccaccatgtccggactttaaaaacattgttttccaatacgtcatgactattttgactatttgattggttttaaaatatctagttcattttcatgttgttccagatgaattcacttttatattgtatcagttgatgccatttcaaacttgaaaggtaaaagtagtcactgttcttcaaaccaaaatgactactaagaggtgtgcgtgtgtatgtcaggggaggtggagggaaattgtggatatgaatgaaaataatgagtgtaactttgatcacacagataatacatctacagcctttactaaagctgcctttacagtttctggcttcagagatgtggtaagtgcctcttgaaaggttgatatattacttttaacaacataaaaatgatatttgccttttttagagtctcttttttgttcactcagatttaaatgtatcatctaacagtcttctctttgtgcccatgttcttccatgagacacttagaatgtctaaaaagatgagtttggtattgttctagccttccctttgtttttaagggggactttgagtctatcaagagtgtgtgtgtcagctaagattgtatagctggctggtgcaggagctggaatttaatgttgtttttttctggcctctcagtacatcacattgtcacttaagtgagatggcaagcatttcaggtgctcttacatatatctgcaagcatggataacatttaatgccagctctcataattatgcatcacttgttgaattatttattgtacataccctactataaattgtaaactcctcaagggcaggatttttgtctgttttatgcattgcttttttttgtggtatgtagaactctgtctggaaggtgataggcactcaacaaatatttattgaatgaatgagtgaatcaaaatagaatgaactaggaatagattaatggctgctcactttgcaggatttcagggaaataattggtcagctttaacaacacatccccctctaactagctgatctaaactgaaaaattagacactggcttcctgtttaatttcccgtactcgtgggagtgataatacattaagctcacttaggtcagtgatttgacaacttagagtgaatgatttcaacaacccctttcctaggagcactttttgttgggggcagggaggacgggtggagtgctactaagttgaagaaaagtacagatggaaaggggcaggaaaaaagaaagacaaggagatgcaaagacaaactttgagcgtatcatgattttgagcaggacaactttgctggtatgtgggttaagaaatactttggaataaatggcatggtctgatctgtcaaacttgttcatggtcctgtggtcccaagaatctgtaccatgtaatttgtaactccagatagtcaagacttgaatttggtaactcttgtaattcttggtattgtgtatggatgctcatgtacagtttcaggagagtaagctgttgttcccatcttatgtgtggcttattatatcatgagttattactgtttgtcagttattcctgggtaacgctgttaagaaaatgctggcacttcaaggggtttgaggaaatgttgaggatcagatttatttaatatgtgcaaaattctagattaggtagaaagttgttgaaatcatggatctaaagtgaaaaattgagctttttagagcacctattagagatcagacaatttctagtgtagagcctgacacataagagttacgtaataaatatttggtgtgtgggatgagagggaaggagagaggaggaatgttgtgagcagctactcattgaagttgtgaatgcagccaagctgatggttccatagattgtttttctctatgttgaggctttaaatggtatccttaatttactgctacctttcagatgaatgcaactggacatcaagtagactaggggaagaagagtacatctgttttccctagagaacagggaccccccgccccgggccatggaactggtacctgtccatagcccattgggaactgggccacagagcaggaggtgagcagcaggctaacaaacattaaggcctgagctcctgtcagatcagcggcggcattagactctcataggagtgctaactctattgtgaactgtgcgtttgagggatctaggttgcctgcttccatgagaatctaatgcctgatgatctgaggtggaacaggtgcatcccaacaccatcgccctcccatccccaggtctgtgggaaaaattgtgttccatgaaaccggtgcctgatgccaaaatggttggggaccgctgacatacaagaagagtaattcaaaaaacagaaatagcaatacaaagttgcagtctgaatttgtgcatgctattttacctcttggtgcctcaatttccttatctgtaaaatagggttactaatgtatatttcattgggttttttgggtaggagtaaatgaggtaattggtaaaaaggagtttagatacagcatctactgaaatatcagccagtagaagtattttgcggtcaatttgttttgtatgtgcccagagggaagggaaatatgcttaccaattttgttcattgttaccgtctgtatagaattttgactatttgattggttttaaaatatctagttcattttcatgttgttccagatgaattcgcttttatattgtatcaggtgaggccatttcacacttgaaaggtaaaagtagtcactgttcttcaaaccaaaatgactactaagaggtgtgcgtgtgtgtttgtgtgtgtgtatgtcaggggaggtggagggaaaatgtggatacaaatgaaaatatgagtgtaactttgatcatacagataatatatctacagcctttactaaagctgcctttacatagtttctggcttcagagatgtagtaaatatccactggaatgttagctcttaaagctggtggtcatatttatataggttgggtatcccttatctgaagtgcttttgacagaagtgttttgggtttgggataattttggattttggaatatctgcattatacttataagttgagcatcccaaatatgaaatgctgcagtgagcatttctttggagtgtcatgttggtgttcaaaaactgtttggattttggagcattttggattttcgattttcagatttgtgttcctcaatctctgtggtttaaggctgagagaatagatctaatcagcagtcagtagagctcattagtagaggagagaggagagttttcttttaagaaggctatggggtcttgtgaagagacgagatagcttgtatttaattcacctgacagtcattagctagtaaaaatgaaagagagtctgggaactggaacagagagctggaaattcagctccttccaggcagatctgccttgaaattccggggaaatcagaacaggaacctcttcatttcttcatttcccttcactgcgtagtagtttattttgtgcttttggtaaaatgattcaaggtccaggagacatcctgaggtgatgcagtgtaggaaagcatttcagaaaggtaagatggaagacagatctgggcacagcaatgtgaattggacatttcgttcatcctttgggcttcctagaattagctgtgatccataggactgtcctgtccatcctggtgttctctcagaatcaggagcagctcactgtgcgaaaacccatctgaggaaaacaagaatgagctgatggtcactgtatcccaaattgacacactagttaggtagcccttgggtgtgaacttccttaaaatatttaaggaaagagactgctgttaacatactcagggaacaattatatgttgtttaccacatgacaagagaagaaataaacgttagacatatttctgggagcttagataagttgaaatatggaggaattaaatgctatatggtatgataatataaatcatttgaaagttgaaagttttgttagagctaagaaaggccttgaaaccatccgatctcaatcctgtaccttaaaaattgggaaactgaagctgaaagatgggcagtgatttctcccaaagttttgttgcaaaatacagggcttgtcttgatatcggaatactttctattctaagacattttttttgtctttaagataaccagatatgtatctgagggtagaacatacctcctctgtactatacctttgaagtttttgtttatatatatggtttgtgcatacttatgtaagtgttgccctcaaaatggaaaagattcaattaggcaagaatatcaggtgttgaagtcattttatccaagagctatgaagtctcatattagtcagttgggcatatcgtcttcatgacctttttgctagtgttcccatctgttgtatcattgctgattgtgtccatgtgagacggaaaaggagcattggactcttagcctaggaaccatataacaactataatttaaagcagatgttattaacctagcataaaagatgtgagaagtctgaagtgttagagccagagaaaaggtgagattaaactcaaatcttctgaatctaaaagccttgttccttccaaaataaagataagcatatccttctactggaaactttacagactggcaagagtaagaataaaaagagcaggtgatatatgattgattgtgccattattgatagttactgatctgttgcatagtaatggagagcttgattggatggtgatcctccctgtgtgcctcctgagtgtatttggaacatcatccaggaaggccttttaaagaagacaatacttggagaaggttttgaatgtttgaaaagaagcatgggccaggtgtagtggctcatgtccataatcccagcactttgggaagccgaggattataggagtttaccagtcctccagtgggaggatcccttgaggccaggagtttgagaccagcctgggcaacgtagcaagacttcgtctctacagaaaaatgaaaacataagccagacatggtggtgtgcgcctgtagtcccagctacttaggaggctgtggcgagaggatcgcttgagcccaggagttgaaggctgcagtaagctgtgatcgcaccactgcactccagcctgggttacaaagtgagacccatctcagaaggagaagaaaagaaatgtggtttcactagagttatggaatcaggttaaaagacagtattacctttaatgtaaattggtggcacatctctgcatcttagcctcaactcagaatattattggtttaagagtcagagagcttaggggtaaaaggctctaaaagcctctgaatttcaggaggttggtactttcagcggtctgtctccatctctcagcactacttcctctatgggcttcttgtggttcagagacaaagacgatgactgttctgcctgctcagcagtcctgggagagagcaaggctcatcgtttctgtgtccaacaacaatcttgcagcttccactttacagtcctcctttggttatgtggctattcttgactgattgactggatatatgtatagtcatcccactataccctttagtggggcgactctcatggccctctcagcattcccgaaactgctgggaccctgaggcaggtggggttaattcttcaaaagagacttcagctactgttaccaaagagtgaataaaagggctgaggtggcaaaaacaataatgggtttttgaatatatgttactaggctaggcacagtggctcataattccagcactttgggaggccaaggaggaaggattacttgagcccaggactttgaggccagcctgggcaacacagtaagaccttttaaacaaaaattagccaggtatagtggtgtgtacctgtggtaccagctacttaggaggctgaggtaggaggatcgcttgagcctgtgatgtacagtctacagtgagccgtgatcatattactgcactttagcctgggcaatagtgagaccctgtcttcctgtctctctgtctctgtctctgtctgtctgtctctctccctctctctctctgtatatatataatcccagtatgtttttatttctttctacagataggggaaggtgatctatttgaaagtctaatgcagaataaagtagtagtagttatcccctggcagagtaaaaagataagcaaaacttgggacgtcaacttacagcaagagctgtatggaagagaacagtgtggtgtgtagagagaaatcataaagctggctgctttgggccccaagaaagtctcgcttgtgatggttgtatacatggccgtgtggagcttcagatataagaaaagaattaagagatatgtattaataaggctgggcatggtgcatgtgcctgttgtcccagctacttgggaggctgagtcaggaggatcgcttgagcccagaagtttgaggttacgatgagctatgattgtaccattgcaccccagcctgggcaatagagtgagacattttttccatcagctcagtgtattaaattggttttctaagttaaaggttcacaacttcattatcgttactatgcagaattgcacttggtcctgaaatctgtctgaatttctgaataatagtttcttgtcctcaacttgtgtggtctcaggttttaaaacaaactaaggttgttactgccaatttctaaccactgttgcatttgtagtaattgagtgccagtggttggaggtttagagaaggtttaagattaactgattccaaaaatatctgtgtgtgtgtttgtgtgtgtttccatgttgtctgtgtgaatatgttagaataggaatagcatatgttttgattaggcatttttctttgttcaacatacactttggaaaacctagagaatttcagtgggattatagtatataatgactatattctgataaaatcgtggagtcttaacatttcgggtaacagattatctgctatttactggtatgttgattcgtggacagatgcttctctgtcttcaggtaggctccccaggtacactttcttgcagtcccttctaccaggtagacatgcaagaattaacaataaatgccacacatgtgtgttttctcttttttctgcttgtgagaggtgtttaaactttgtggaaatttattagaaaagatccattgtttggtagttctgatagcatcaactcgccctttatctttcatgatgcattgagacttccattactttgtagcgcctgactgctagaattgttcccagagttcaggggcttccaaatgacaatgggctgtaccgggctttgtggccttaataagccctctgttactggaattttaaatattggcatacctatcagagtctggccgtgtgtcaggagaatgttggctttagagccaccactgatggatcacatgtttttttctcaagagagcaaacaagcactttttgtttaggcttactaatgtttggcaaagaaatatagctgtaattatatatcctcgttcttgttactctctccccatctaaattttactctccctacccctaactttatataaaagcaactagggttggatctgaaataaatgtcatgaatgaataataatttctttcatttacacagtaattcaacctgttgaatgctgacttaatgctttactacactctaatttgactggaagatttggccttcgtgaatgcaaagaagaggtaaaaaatagaaattaaataccgactgactatgaaggaggacatttttcagaagggttctccctccttctatttctcatcttcttgtgtttgccccctgctttctgtgatacttaatacttaggagttgttccacaaatcattctttactttgtgtacccagcagtatcccagcagcaggattctccagggacaaggcctaggtctgccactgagggtagtctgcttccttcatcagaattgccgctgctggccttctggaccattagagttctttctggttgttatccacttttcattccttctcaacccatagaattccaggtggtgagtcagtttttctgtatgatcatgcttgacaccccaaaatctacctgaaagtttgacagatgcatggaagccaggagcattttaggaagctgtactgctcttctgagattttctgcctacttactgtctgagcattcaacctgtctctctcaaattttctctttctctaaggtgggtccagtaatgcgagtcggcagcccactttgctgttcttggaagcgaagtactttccaatagaagtcagttttaatcttctttcaccgtgaggaatgaatgaccattttaataaataattcattcctacagttcactccgtaaggagcttctaagctccctccatgatggtttctgatcctgccagggtactgctattttatctgtcaaatgtgggttgttagaggtactgtgtcataagaggcagtgcagttcggaaccctggaacccccttcataaatttgcaaaacacagtgcatggggcctgctatggcaaggtatgctacatggagcctcagctgtctgctccctctcttctgtcagcacagctagcagtcagagacaaatggctaaccctctttgagtctcttggagtaaagcctggttgtgttctgcgtggattgcatcctgtgcagattgtggatagcaagggcttccttgcaggcctgttgggagcattgattgagatcatgggtgtagaaagcctggactatagccagagtcaataattattagttctttatcttgagacaaagggaagtgttaaaatatttttatatcaaggaatctcctacaaacactgtcctccccactgcccactgccagtatttacatgaattaattttctccttatcttcttactctcgcccacccgcttccctttccttccgttccaaagttatactacacttattcaggatagaaatttcctttataaaaagttgtaaaaacttcaaagtgcctgttgtagtatatatctttaataaatactcccctgctatatttgttaaactataattatgagcatacatttcataaaaataaagcccatttactcataaactgtatgtttacatgaaaaaatacacattttataacccactccagacctactaaatctgggcgttagaatctcaatcttgggttttccaacctggctcctttttcgaaataacctggaacacttaaaaaaaaaaaaaaaaaagcaaactccaggctcaatcccagatgatttacatcagcatattttcagggttggccctgggcatcatttgtttaagcttctctggtgattataaatgtgcagccagggttgagatttaacggtctatcctaagtgcttcttaaggtctgaaactataactattaagtgagctggcttaatttatttaatctttgcagcaaccttatgaggcacagctggcattatccctattttcagatgagaaattatagaggcttggagaagtgtgaggtaataataccaagaatgagagttacttgttctcctatgtcttataatcaaatagtatatatagtattaacatctacttggggatgcaataccttttcacgtgatggtcacaatctatgtattacacattggttttggcatgaaattaaactgaccatctcaatatgccttggaaccaagtgtttgtgtgctgaatccttttgaaatatagacacctggtgtgttagtccatttgtgttcctataaacgaatacctgagactgggtaatttataaagaaaggaagtttatttggctcacagttctgcatgctatacaagcatagcaccagcatctgcttgccttctcgtgaaggcctcaggaagtgtttactaatggcagaagggaagggggatccaatgtgtcagaaggagcaagagagatgccaggctcttttaaacaaccagctctcacgtgtgaactcacagagggataactcactcattccccctggagaacaccaagccattcatgaagggcccacccccatggcccaaacacctccctatgcccagcttcaacattggttgtcatatttcaacatgagatttggagaggacaaaacatccaaatcgtattacctgcaggttgacattataaattcattttgttaaactcagtggaaatgagaatcaggttgaaactcggggtttattactgacttataaacccaggtgtgctttgaatgcattggaaagcaggagcaatttaacattctgtgatttttagaggtttggcagtgaaaccctttggtatttatttaataaatcctgccttcacagtcatggattctttttgaatacacccaatttctcctgcttcccaactcttttttcaagtgactttgttaccaggtaccgttgttgcagaggagtgatttgattattctttctctgtagaaatggtgatgatgtggggcaaatctacctcaaactgtaaactatactcactttttccacagatggggtcttgttatgttgcctaggctagacttgaattcctggacccgggtgaccctcctgcctcagcctcccaagtagctgggactacaggcacatgccaccacacacccagctatattcacattaaaaaaaaaaaatcatctgtaattctaagagctccctgtgtggagccttccaagtggcccacctgtgtgggaaagctgccctgcaatatgggcccaaaaattttccttggttttcatgtatctgagcaagttgcttaaaggtgcctggttctgtgtgtttgagattatttattccatttttactaatagtttagagaaccatgattgtgcatacatgcacctgtttgtttagtaaatatttattgagctcctaacatatgtcatgcattgttgtaagtagtattgaagttacagcatccaaaccaaatagacaaaatctctgcattcgtgaagctttatttaatggggaatatagaaaaaagtataaacacataaatcttaaaagtattttggaaggtgagggatactatttagaaaaagaaaacatgtaaagaagaaatcccccttaccatatttggggaatggtaaaatttttaataaggtggttagggtagacctcactgagaagatgacgttaagcaaatggttgctggaggtaagggtgtaagctatgtggatgtctaggaagaacactgcagacagaaagcactgccagtgtcaagttcctggagtgtttgaggctttagcgaggaggtctgagtgctatgtgatatgtttactacctacctataagagttttatggatttggagaagttttctctgcaatatgaatatatagtctcacaaatgaggataaagtttatagcaaattatcatggatttgattatgtcatggcacttgaaggaaagagagggtgggctgtgaaactcccttaaaaataacccatttttgaactcgacataaattttcagggtcctataattttcttatcaggagtgtctcacactgattgctaggtgtagaaaaatgtatgttgcctgaatctgaaggcatggattgtaggcctggttataccacagttacttgtgggactttaggaaacatgcttcatctggtcctgcttctgtttctgctatcttacaatgaagataattttccccctactttttaaacttatttgcagtgaagactagataaaaaaggatatgactaacacattaaattctgaagtaccacataaatatgacttatttttgcaaaatttaagagcacagaatgttggttatcaaagagtgtttaaaatgacctttctctgttttttgtaagtgttgtttgagagcacagtgatgaccacttaattcctttcctggagcaagacatgtttcttgtgggtttgatttgtacattatcactgaaaaacttcatcagtgacaacaacaaaaaagcccaaaaggaacctaatgaaaatagtagtgaagttttacacattacatagttacccccctgccacacacacacacaaagaacgaaaaaaagaaaagaacttggtgaaatatggtactttatattttaaaaggcctaaatcttgcttgtggaagtgggctttagaaagtttgcagcttttgagttatggagaggtggtggaagatggattatctggaactggatggaaagttgttctaccaggagtggctcataatgcacttggcaaaccgaagtagctgtggtggatgtttgaggtgtgtgcacatgtgcattttgtgtatccctacacagcttaattcgactggatgcagttttctgaattcacctgtttcttgcaggtgaaagtgcacacaaacatgcaagattcacattgtgctcaaagtgttcctgctatgtcaagcacattgaaacaaatttatgttttcaaagtaagctttataacagagctgtctgtacaggggatgattcagtccgatacagtcagggaaccgtacatagaatagaatgactagagtataatctgcaaaggatggaatggcagaagtagtcagaagaggtatgcaatggttggatcaaaaagagctttgtatccagcgtcacagggcctcaaattgtactgtaatcatatgtcttttacctgttctctggcatttaaatattcttgtaaagagctaagccattactgataaaatgtctgttgtgtacagttgtacaaattaaattcagtcacaaaactgaaagaacagcagtgggacatctatcctagtgaaagttagaatacacttttgtggtctttaataacagagttgattgtttaccttctcctttggttagaagactggtatggggattgtttggaatgaagaggtaggagagagaaataattcaattctgtattctcccatcatctttatatttgaactgagaaatgtgtgtttctatcattcattcaaattattaaacaaaaacagagatcaaaataataagaacagatgattaaagagagtcccatctgccccatatccaacctttctctcttcaacctcatttctactcagattagcagatggcaccagttttgggccatggtctctcattttctgattacaaggggttgttcttttgcccgcctcctttaaaacaacaacagaaaaattggtaatgactgactgtatgcccattggccggggcaccaattcctgaggactagacagaagcttggcattcaacccagccttctgccaggatggttctgcctggcagcaaaaagcctggttgaattaagcttgggcttttagatcctagaagtcttgtctattggtggctggaaaaatagctagtactagcagagcctaaaaatatcagagaaaaaaaagcagaggctcttagaagttgcttttcctttttgtttctttctcagacagagtctcattctgttacccaggctggagtgcagaggtgtgatctcagctcactgcagccttgacctctagggcttaagtgatctttccactttagtctctcgagtacctgggactacaggtgtgtgccaccacgcctatctaatttttgtagttttagtagagatggggaatcatcatgttgtccaggctggtctcgaacacgtgagctcaagcgattctccctccttggcctcccaaaatgctgggattacaggtgcgagacaccacacggccaagtttttttctgataaagactataaagggaaggtagggaaaggtgattattgccaatggtggttggtatagtgctgagtgatacagaatgcaggattcatgaattctaattttgcatgtgacctctctgtaaaggaaaatgaccctctaactaaatgggaaagtaaggtttcacagatgagatagaagttcaaggtgaaagaacagtctataaggtaatacctgcctgtctgcagagaatggattcaaggctcctgatgcaattgaattatagcctcattgtcatatttttttttttttttttttgagactgagtttcactctgccaccaggctggaatgcagtggcctgatctctgttcactgcaacctctgccttccaggctgaagtgattctcctgcctcagcctcctgagtagctgggattacaagcacgcaccaccacgcctggctaatttttgtatttcaagtacagatgaggtttcaccgtattggtcaggctggtctcaaactcctgacctcaggtgatctgcctaccttggcctcccaaagtgctgagattacaggcgtgagccaccacacccggccttcattgtcatctttgagttaaatgcattttggctttaataaaaacaatatgagtaaattctgaacctataatttgagtcccaatagtatttcctaacaagtgatataagtaaacactgagaaaagagtatagtgcttacagaatgacagcatgaattcagcaattcctgtttagcaagaggtctgggccaataacttggggatgtcatagacagaatgcatttggctttcagcaaaatttttggtctgctctcccataatctctttgtgaacaagtagaaaaatataggcggggtggcattatgattatcagtattcataattaattttataactttttccagtggtgattaaattttatttcactctagagatgactttctaagattatcataaataatctatccttggctctatcttatccagatttttgtcttagactaggatgaagatacaattttaaatggtaccaaaacttcttgggtcataaatatggtagatgggaggaacaggacacatatagattttaactcttttggcagtggcgaaaataagatttgctaggactaaaagtgtgattatgtttgaaaatccaactgtgaaaatagagaattgatagagatgagacttacgatttttagacgacacttacagtgagtcagcagcatgtagttagctggcaataaagctaatggtattttcaagtaccttataaaatatgttttatgtaccggactgtactttgtatttggggaagaggggatagaaacattgaaggtaagatttgcccagagtcacagatactgttaatgttcacattcttcacattttatttgtacatcactcttagtctttaaaatcaaaatacctaaatagctgtgaaaattcagtggattaaaagctactttgggaaagacagtaaaactttattcaaatagggattttcatataatgttaattttttgaaaaatcaacaattttaagaaaaaaataggatatatgaaaaactagatagttaagttgaagtttgagcatctttcaaagagtagggaagtttacatattgcatattatacatttaaaaatcagttccagacatatttttgttcattcatatatatgaatatattatatatgactatattatatatattcatatatattatatgaatatattatatatgaatatattatatatgaatatattatatatgaatatattatatatgaatatattatatatgaatatataatatattatatatgtgaatatatatattatatatgaatatattatatatgaatatatataacatatgaatatataatatgtatgaatatgttatatatgaatatattatatatgtgaatatatataacatatgaatatatataatatatatgaatatgttatatatgaatatgttatatatgaatatatataatatatatgaatatgttatatatgaatatatataatatatatgaatatgttatatatgtatatataatatatatgaatatgttatatatgtatatataatatatatgaatatgttatatatgtatatataatatatatgaatatgttatatatgaatgtgttatatatgagtatctataatatatatgaatgtgttatatatgaatatatataatatatatgaatgtgttatatatgaatatatataatatatatgaatgtgttatatatgaatatatataatatatatgaatgtgttatatatgaatatatataatatatatgaatgtgttatatatgaatatatataatatatgaatgtgttatatatgaatatataatatatgaatgtgttatatatgaatatatatataatatatgaatgtgttatatatgaatatatatattatatatgaatgtgttatatatgaatatatatattatatatgaatgtgttatatatgaatatatatattatatatgaatgtgttatatatgaatatatatattatatatgaatgtgttatatatgaatatatatattatatatgaatgtgttatatgtgaatatatatattatatatgaatgtgttatatgtgaatatatataatatatatgaatgtgttatatgtgaatatatataatatatatgaatgtgttatatgtgaatatatataatatgaatgtgttatatgtgaatatatattatatatatgaatgtgttatatgtgaatatatattatatatatgaatgtgttatatgtgaatatattatatatatgaatgtgttatatatgaatatattatatgtgactatatattatatatataatatatatatgaatatatattcatatatatattatgtatgaatatatattcatatatatattatatatatgaatatatatgtgaatatataatatattatatatatatatatataaaatgccataagccatagagattcagaactaataaaaggcaagttgcttgctcattaaaagctaataaactagaaggaactacaaaaagttttaaggttaagggatgcaaaattgattagcaaaggcagatcagaaagagtttctgactcatgcttcattggtgagaacagcaaggaagaactgggaatgagaatcattgagttttggccgacttagaggcagagtgttttaaaactgctttttggggccgggtgcagtagttcatgagctgggggaaaaaaaattacttcattttcccacctcagtttcagtttcctcatctataaaatgagataacaacagcgtggagtctacacatgaattaatgactttatttatttatttatttatttatttatttagagaccgagtttcgctctcgttgcccaggctggagtgcaatgacatggtctcggttcactgcaacttctgcctcccgggtttgagtaattctcctgcctcagcctcccaagtagctgggattacaggcacctaccaccatgcctggctaatttttgtatttttagtagagatgggatttcaccatgttggccaggctggtctcgaactcctgacctcgggtgattcactcgcctcagcttcccaaagtgccaggattagaggtgcgagccaccgcgtctgactttgaaatattttttttttaagattacacagctaaatggaattctctaggaagcacatccagctgctgaacctgtgatatttttttcttatggaacgttgattgaacagcttccatgggtgacctggtttggatttccgtagggccttgcttataatgctgaatacactgttagtttttacttttgtgtcacaaaagtaaaggttcatagttagatctaagccccttgggggacaggaactgtgttctattcatactttgaattgctagtgtctggcatgtagtagtgattaatatattttttaaaatgaatgtcaagtattatgacaggcactggtacagaaagatcaagaagaaatgacctcttcccttgtgagaggctcactattgtgatagaccaacctctgaacagaggaattaccatctagggggctgttataacaggcatgtgctgttcgagttcaggggaaagatgcacttgctcaaagagggaagtttgggaggtgtacgggaaggaggaacccacctggatcttaaaggctgagctggctgctgaagaagagaggggcacttgggcctggtcaccagctgtgcaaaatcaacaagggcaaggaagtggctgatgaagcctgaaacagggagattcccaaatgtgatctgtgacctcaaaattgaaaattttagttagtgtaattttagtatattttatgtgcatgttccaaagttttttgaaaattggttttatatgtttagcatatggggcaattctaaattagtatatttgattaacgttgtatgctagtcctttgaaattctgcagttggattgtgtatatattgtgtataatgttacctcttttccgacttcatgaacctaacatttaaagtggaaacaaatgcacgcatgtgttagtgtttagtgcagcaagaaagcacggcccaccacttccaagaagtgagtcgttgcatagggtgccccgtcctcagaacattgctcattgttcattttttattcctcagctccttagttctactcaaagtctaatattagtttaactaccaaatggcagaaaccagagtacgttgtacatttttcttgaaggatacaactggaaaaaattttgcagaggctcatgtgatgctattttccttccgtggtgacacttagaattcgtttcacattgcctttgagagaaacgaggaggggggagaagcctgtatttgatagttttgtatgttcctctaaagaaagagagtgcttgaaaaaagaaaggcaggctttcagatgttgtctgaacaaagctacggaaatgtgagacgagagcagcatctggagattttcaaacactggaacatgggctgcacgtttcttttgctgttggaggagtgaaaagctgtttcctgtcatttcccatcttgtcacttccagaaccaacatcttgctacttcttgcaccagctgctgctgctgttgttttttttaccccctccacagacagatggtaaaagagctttgataatcctcgcccaacttccccagttctaaagaagtttgcggtgtggtacctttatacaatgatcacatgccctgatacctactgtagcctgttaatagagttgggaacagagcagaaggatgtgctgcagacttttaatgtctatggcattctttgtcatgtctcatgggaaatgctgtgcacaagccccatctctgtggatgcttcgatttagcttctgaggttatatttagaaaagaggaagttgtggggagtacctttgcttccataagaatttgagatttctgatcaagatttctctgtacattgaatccaggatgggagttgctcttgatattcttgttcgtatccctaggttttcgcaaagcagaattaggcatattggatataccatcttttcacagggctgtttatccttaattactttttttacacctatttcttccaatatttttcttgcattacctagtgcaaacaggaacttagaagttaatgcagaaaatgccgtatgcataggaaagatatttgatgcagacaaccttggttttgttttaagttttattacctttattattacaaactaaaaatgataacctcaatgagggagcttagcctttctgtccccccctaaatcatggttgctttcctaagtataaaagtaacatactcattgtagaaaactttgaaagtagaaaatctattacagaaaatacaaagtcatccataattccttaataaccactcttacatttggtatatttccttgtagcttttttttagagttatgtgtgcctgtatttctcttgtatacttataaacttacattaatattgtggccattttccagaatggatctggtggtagtagtagtggtgatgataatggcataacctaaaatttattgaacatttattatgtgatagtcactatggtacgtgctttacatatattacacatttcatttctcacatcagttctataaagtaaggattatttatttttattttagacatgagaaaagtgaggctgagaaacatcaagtaattttcccaaggtcacacagtgcgcaataggtgaagctgggatttgaacccagatagtctgtcttcaaagctcatgctgtttgtcatttgctcatctatgtttaaaaggtctgaatattttttaaattattgatacatatagcctaagattttctatttattcagacttttcagtcatgagagtacttactgcgctctcaccatcttcacatatcatcaaatatgttttacctttataggtgtttggggtgaatgattgctcagtttttacattggcctttcttgattactagattgattgggcattttccatgtgttattgatcatttttatttaatctataaattgtttatgttctgtgtggctgcttttgttcaacagttaatttttttgtatacaaaatcatcatgtgttaagtatattaactctatgttgtgtttgtttaaaacatgtctccttctgttaacttgcttccttatatttgaagaaaattgtatgaatgttttaaatatgtacatattcatattttttctttataattctctcccacaaatcagttatttagcctatgttttcctttattttatggtttttactatttataacaatttttaaaatcaaatctgaaatttattttaatatatagcatgctatgagactttgaatttattttattgatgggtaatactttttgtttttgttttgctacttcctttaaaaaatattatgcattatatattccactcttctgtggtggcattctttattatatatttgtttattttgtctaccagcgtctcttcaagcaatctttctgtgtcagtggcctgtgtatgggtatgcctacagacattttatggatagtaaatttgtaaaatgtgcaagaagttttttgtcttaaaagcacccagactcagcatcagaaggcccatatccaaacctcagtataacctcatgattgacttgtgacatgaccgcatgtaggcttaaatgctgtcaggaaaattaaaggaagtaaaacgtgaattgagaaatttggagatttctgaaaattttgaaaattgagattttgctgttaatatcacagccgtatcactaaaatttccacaatcctttgaatttgtgaaatctatataaacatgatttaaagtacttatgatattgtcctttttttcatattacccaaagtatggaatttgtggcaaataaataaccaggtatatatggcccatatagatatggtttttatcctgcacttcttttgagatagctgggggctttactagagagaagaaataaaacaagataactttggcaagtatagatgaagtttgagaggtgtcttatttcattttgtgttgctataaaagaatacctgagagtggctcatggttttggaggctggaaattataagagtatggtgctggcatctggtgggggcttttttgctgcttcattccatgggagaaggtggaaaagcaagagagcatgagagcaagaggaagcagaactcactttaataacaacccactctcgcaataaccaacccaactccagtgtgaatgacgttaattcactcatgaaggcagtgaccccacgatctaatcacctcctgtttggccctacttcccaatagtgttgcattggggattcagtttccaacacacaaactttggggacatggttaaaccatagtaagagggaagtttaacatttgtttaacgttggtatcgaaaggaactatttacgttgcagccccgaaaagactacaaataatattggttaaaatagaagtgggctgtattcttttgccattgcagcaagccttagtagtgacctagattcaaaatgttactttgattttatttaaagcactgaagtattgcatttttcctcgtggttttatgcacctactaagtgcagctaccaatgacaaagatcttctataataaaaatgatgtttccttatttttgggtcttttttcaatctgaaaaatgtttctttaatcggattctcataataaccctatgcagccatataatctatggtattattatctccactttgtatatcaggaaaatgagactcatgctaaaatacttgcccaaggtcatatgacttgaaatggtgggactagcctctggcttagctctagtgagacctaaaataatactcttttggtttggtgagttccatcctttctttttttaaagaatttgcatatctaccttatccacttttaaaatgtttaaagaatttatttcaggtgcctgtccagagtgacacatgtcaaaatgttttttaaacagataagtactattcaaatacaaggctttatctttcttactgcctggggtaagatacctgtcttccctgtcccaagttatatgatgcttatttaaaaagttacctgtgagccttgcttattaaagtatgcctcagctatgtcatgaggatatttttttttaattaattttttttgagacagggtctcattctgttgcccaaactggagtgcagtagtgtggtcacagctcactgcagccctgacctcctgggctcaagtgatcctcccacctcagcctcccaagtggctagtactacagtcgtgtgccaccacatccagataactttctatttttggtagagactggggtctcactcttttgtccaagttgatctcaaactcctggtcttaagcaatcctcctgcttcggcctcccaaagtgctgggattgtcagcataaggcactacgcctggctgaggacatttttaaaggtgtatacttcaccatattctcttttcctctacatgaagtttagcaatgttcaagatggtggccactccatcccccttgatgactgagtgactgtgatgagccgagcacctgctgactcacaacagccatagagacataagagtgtgaacaagaaataagcctttgttatttttagccatggagattttgcagttgatactacagcattatgtagcctatcctgaatgaggtaggatcataataatatgtttgttatgcatcacacaagtttttgggttgtttcaatctaaagatctgaaattatacccaaactagatattctccagtatcaccaaacaggatctatccattctacagtgctcaccagattgcttctgtcatacttcacctggacatctgtggattctggatattagaaattggaaggaaaagcttgtaaggggatctcagtgcccagggtcaaagcttcattgttgggcagccaaggaagagatttgcttgacttacttgagtaatttttgacacatacttgatttggtcatcaggcataaaggatggccagattactagtaacttattggagatacacttttaaaataggagttaaggctacttatgtgttgatctgaaattaagaaaagggcaagatttctccctgtggcctgattttcaaccatgactaaataaagcctgaggggagccactgaggatggaaaaggtcactcagtcttttttgctgatgaaaaaatcgagttgtctagctctggattgacatccagcactgacatgctttaggaaacaaatcttttgatggcaaaactctcactagcctcacctctcctctcctttcctctctcctctcctctcctctcctctcctctcctctcctctcctctcctctccctcatttttcccttttctactctcccacttctaccctcatttacttatttctcaatttagctcatcagggctttttgttacaaaaaaatggtgtgtaagttacttagctgtaacttggaaactgttttcccatgaatagatgacagaattactacatgccaaattatcccagaataggtggcttaaccaattgtataattaagttactttaataattaccaagagggtcctgagccccatggaaaccttcactgcttggaggatgtataaatggaaggtgggcagcatgagtcttttggactggtggccggaacaagcagttcttagctttttttaaaatcatctttcatatttcagagcaattctttgcataatccagattgcttctgtcatccttcacttgatcatctgtggattctgagcttcagggtggccatgcgacctttcagcccttgctgtggaaggtggagctcctaccatctctgcctgtgttggggctagacgaagtttccctctgactgcctcaatcttttcactgtcatgtgtcctgggagcctcctacacagtggagaggagggagtatgagtctcaggaaccattgagttttttcactgtgaggtgggacaggcctaaatttctccccttaggcctgccattcactgagggtgtgcagtcatcatgctaagttctctttcttgctccattttcatcttcactcaccccttactttctgcaaagcgttgatggtgttgggttctgacagttaccagttggggcatttgtgatctgtggagaaggcagagatagttaatgagtaggcacatttgctaacctccttggacaggaataagttcaaaggggtggacaagcaggattggctggaggaggcaggtctccacattgttctctcttgcccctgggccctggcgtccagggtaatttttgtctgcctttgtggttcatatttttagctctctgtaagaggcccccttggtaaatatgtcagttcattgttaaacctagacatgagtttgacatctattttgtgaaacaaaccatgtaaaaatatgggtctttatggtgttcagtgttccaaagtcaggaattttttagtttcttttgtcttcacttcttgttattctctcacttgctttacttcttccagccttttccttttccacctcatctcctgcttcttatttcctcatctctttttccttaccattttttcctcttccatttctcccttgatcttttcattatattcaattcatttcattcattgaatggtgttagaagaggctttgtctttgcagtcagaaggctcaggtgaagcttcatatttcaaagcacactatgctgacactaagaaaacatcttgcccgggcacttcagttgaagaaaactatatgatgtgatcagtatgtgatgatggcttttcagatcagatagctgggttgtatttataatttatttctcttatcagtgaaaaagataaatgataatgtagtaacaggattttctagagtttgggttgtagagaaataagtgctcatgaataggaccgcatatgtgtgcatgtatgtgtgttttgggggtatggagaaagaggaggaaaagaatattttatagagaaaatttccatatggttaccttttataggatctagcacatttcaatgaaaacacactttgctggaagaattcaattctctgtaaagtttggtgcagcaaggggtgaaaatgtggggacacagctggaaacttatttgtgctgcaggcttgcagctgtacctacctgtgatgcgatgaatactatttgattgttaatgtctttctgttactgaaagcttgcttcctttcctaaagctgatggtaacaatttactgactgtctaaaccttgaggactaacttgggctgggaaaaataaatcctgtctcctgaaatttacatcttattaaaactcaaagcagccagcagagatgagaaggatctccagcctgggagctggaggtgggaattctgctcaagtcaagatcgcttttagctttcctacattctcctgtgaagaaccattggattgaatgatggtggcaaaactggtgtgacttcattcagtttatctctatcccatttcccctctccacatttgactgtcagtctactaatgagacccagttatggtccttggaaggggaaatggaaggtggacatagctgtgggggatgaaatggaggagtttttaatatcttagcttgcaaatttactgtctgccatagctgaagaccatctagtaccctctttaacttttgccactttggagtttcctctctaccgttacttattcagcaggtttttgtttttgttttttgagacggagtctctctctgtcaccaggctggagtgcagtggcgcgaactcggctcactgcaacctccgcctcccgggttcaagcgattcccctgcctcagcctcccaagtagctgggactacaggcacgtatcaccacgcccggctaatgttttgtattttagtaatgatggattttcaccatgttggccaggatggtctcgatctcctgacctcgtgatccacccacctcggcctcccaaagtgctgggattacaggcgtgagccaccgcgcccggcctcatcagttattttttaattggctgtgttttctttccctgtaaacacacttgttcagaaggaaatataatatcactataatgagcagaaggcaagtatcacatgccataagaaagtaactataaaaatgagtgtaatacaattaaaatattatgaggctctagttagatactgttccctatggaagattccgaacttgaggcctgcactcacttctgtctcaagtagaaagggagcttaaagaggcatacactttacatctaaggaagcactaagtgaggcattgttcttaactaattagacagattaaaaaggaaaggccaaaccatgccattgtcttagctcttgttttctttgattttgaagatggaaaaagagataacacttaaaaataaagcttgcctactcagacataattaaggtattgtcattcttttttgtctgtcctggttctcattgcaatattttgttcactgctcaatgagtatttattaaattaatgaagatttcaatgttaatgtctagtttcatttgcccttcctctaaaggctgtattctttttttgctcttgctctctgtgattttttggtagttctcttttatgtgcttactcacacatgagtgctttctctaacacactggtcctgtgttttgcttctttgtgtgcattcacgtagacatgcacacctcttcaaatgacacatgcctgtaggcaggataacaggttgagttgtcttgttaattaggcattctttttctggggctggtacaggatgtttgagaatactgtcccccagaatactcatctggtacactggaactgccatggactagttttccagggcttatacatacaagtggcttccaaaaaagcattttcagacaagctgcttgttatgtgaatgtgtttttctttttagtcaaccacaatatatgcagcacaaagctgttgccattttcttggaatgagaaaattatgagcataatgtttcttttacatctctgaaaaacgctaatatccagctgttgtggtggttgcagttgtcagttgctttttgtaacccgacaacactgtctcaaggatgaagagaggaaatttggtgactagtctttcctgctcactctcctgaaagtcctattaatttgcttttttaaaaacaacagccaagtatctcagttggagaaggcaaagtcttattggtccttatattctgtgcttggattagtatccacagtaaaccacacacattttgttccttgcttaacgtgagccaggtgttatactttaaagacataatctcacttagtcctcacaaaaactcagtgaatacatactatcattagcaccatttttacagatgccaaaacaaaaaattgaggttaaataattgcacaaaatctggcagccattaaatgactgagctggaatttaaaagcagatgtgtctaaattctgagcttacatttgtaaccactgtatataatgtagtataataacttccccaataattgacagagtactttactcagaggctttacaaggacaataaaagaattagttgagataacacaacccatgttgtgagaagattgtctttttgattcacagttcatgcaaagaaataatatacagcagactgtgaataatacacaaacgaaatgaaatttcattcttgaatgaattatctgtatctccttttaagaaaaattggtaaagcatttaactggtcatggctcagggaaatgtctctattctgtttctgtctgaattttattctttaaatattcactttttttttttttttagcatccagtggccacctagttgttgttgttgttgttgttgttttttccccctgtgcttatgcttgtgccttgcagggctgcatttctgcttgctgtgaattctcagttcacagctgcagttgttcaaactttaaatttaaaattcagtctatgtttctagtaattgctgctgggaaactgaaacaggactacttggtttcagagtgaggctgttgcttcatattggaagaaaggtttcattagcttggaaagcaaatctcgggatatcaagaaaacaacaaaggctgtaaattaatgcagaactcaccctaaaaagggtcaatgatgaaagaagggagaaagaagagacaggagtttcagtggtcaagggaatattttcttcatgataacagtgacctgaattggacagaaagcagaagggagtgtgtcattttaagaaggtcagtttgacagaccgcaatattccaggtttctattattatatataattgacattgttagctaagggatggattttcactatttccttctgtagtacctcagtcccttttaagtaattttttttttcctgacttcaccaccaggatcgtgtgatggtttaggaggagatttgggggatagagaggtgattctgaagataaacccactttggctgcctctgtggtctaaagccagtttggagagcgcactacagaaacagggaattcacaggggatgagtcagagagagggactggagcagtttgtcttgtttcacttgctcttatcacacagttcactcctttctgctcatacattgtgtagtccaccatggagagaaagggagaaggttgcacaatgccttgacagatttttttttttttttttgaaacggagtcttactctgtttcctgggctggagtgcagtagctcgatctcagcttactgcaacctccacctccccagctcaagcagttctcctgtctcagcctccctagtagctgggattacaggcatgtgccaccacgcctggctaatttttgtatttttagtagagacagggtttcaccatgttggccaggctggtctcgaactcctgacctcaagtgatccacctgccttggccttccaaggtgctgggattacaggcgtgagccactgtgcctggcctccttgacagactttttaatgattgtagggatagagaatggtatacaagtaaatatactactactgtttttgaactggcacagtgatgaagactaagccagtaatgctatgaaacttcaagtattaaatttctaaatatttggcattaggcaccaatctaagttacagtttaatgcttttcatcacttgtaacattaccaaatcagaggaatgaaataatatttatccaaataaaagatgtgttaacttcgccaaagtgaatgcacatttttctttgatttccccataatacatctttctttttcggggaagacagaggttgggaatgggagggagggagattattgtgaatctcagattatattgatcagaaccaagtttagcttgttctggtatgtaaattagagatttgtagttaagtgaaattgattttgctgagactaaattaatcacagtccttaatcactgtaacctttaaacattgcagtcttggccacagctgcagggcagagcagtgctcctccgagctttatgctgtcatttcatgaaaggctgaatgcccgtgacttgtgcaaacaagaattcccatgtacaggcttcagagctggttccctgccctgcaggggatcagctggagcatctcccacagggccaagaggctgctgtggcctcttcaacccaagaagatgttctgctcagacacaaatattttcagtcttcctccagacatcatcaaactagccatcactgcgaaatgctcacaggaaagtagttgttagaattaaaatcagaaacaaccagttatattgtgatagttttttctttaattgtatatgtttatgtatatttataaatatatttatatttatagatttcttttatatatttatattatatttatatatatatgttttactgatcacattttgaactatttggaagggtgatgttgacaattttgaaagatagtgaggcatggagaggttaattgactcttcagaactaatcctgagagcctagaaggagggtcaagaatagaaactgggtttggtttggttttgatggtcatttcagttctttggtttccgtttcatgaagcatcccagaatcaaaccatcattaagcctgccatagaaatgcaaattactttcccactttagttggcatatttgaaaatagttttgtgtgattttttttagccccttttgtagtctattcatgaagtttatacatgtaggactcttttttttttaacgcctttaactaccaatcctccatttttcctttaacttttctatattcgctgacttttatgttcagttgaaggaattcatacacattcagtataataaagtgcagctggatcaatcatttaaaaaaatcagtgaacatctgtatttcacaaaatcacactttatcaggactgaagggtataccaggatctaacgatcaacttcaaccactcagttttgtaaatgaagaaaccaagagtagttaggtgaaatagctttctcaaggtaatttactatagccattctgaggctgcaccctagctaatttgattcctgtttaacactcttctctatgacattgactgttttctctgtaaaagagatcccggttatacaactatttcacaatccgattccttataaaaaagcaagtagtgctcaataaatttgacttaagttgtactttataagctaatgtaaaaggagatttaccataatctgccgtggtgagttgcttatagtaggagaaagaatatcttaaaacttactttacaaaaaataacagatgctggtgaggttgctgagaaaaaggaatgcttatacaatgttggtaggaatgtaaattaattcaaccattgtgaaagacagtatgtcaatttttcaaagacctaaaaacagaaataacagtcaactcagcagttccattactgggtatatacccaaaggaatataaattgttctatcataaagatacatgtctgtgtatgttcattgcagtactactcacagtatcaaaggcatggaatcaacctaaatgcccatcaatggtagactggataaataaaatgtcatacatatataccatggaatactctgcagccacaaaaaagaatgaggtcatgtcctttgcaggaacatggataggagctgtaggctattatccttagccaattaatgcaggaacagaaaaccaaatactgcatgttcccacttttaagtggaaactaaatgatgagaacacatggttacatagaggggaacaatacacactggggccttttggagggtggaaggtgggaggatgaagaggttctggaaaaataactaatgggtactaggcttaatacctgggtgatgaaataatctatacaacaaacccccatgacacaagtttacctatgtaagagacctccacatagacccctgaacttaaaagctaaattaaaaaacaaaaacaaaaaaccaaaatacttactttaaaaacaatttctgtggttgtccttctcttttttattgtatattggtttgtgtaggtccatttaatttgtttacttttcgtagtaggaatacaattgtcagtgacatctagtagattgaacataggctctgaagctgaagcctcaggtccatctttggccctgacactagccctgttacctttgtcattttacttaacagctctctgccctaaaccataacacctaccccatagagttgttgagacagttaaataagttaatgaaaagtcaggctcttagaatagtgctgggcatatatgaatgttcattggatattatctaatattgtggtcattatcagttgatttcttcttaatttaaaaaattttcgtatgtgatttcatgtggttttagggaatgataaatgtaatttagactttttattccattgggtctgttacagcttttttctcaatgaaactgatttggttacctcagttctaatgctggctttgcctctgctttttgatcacatttagaatacagcactcagttctgggtatgtccaagatagataggggagaaaggtaaaagagaatattaatgcaacttgattgtgcagctgttctttccacaaatatttattgaatgactgctgtttgtcacatgttgatgcatagggacacggtgcacacctgagattccattcctgtagacaggacatttgcctgcttcctggcacttatacctctccccaaattgacaccaagcattattttagaaaggcatttagtagaatgcaatatcagcaaatgaaaattgtagagttgtatcttgaagaaacttgaccccaccccccactctcacctgcatccccacatagagccaggacatctcttaagacccaccttcctgggtttgctcatagttggcacttaaaacattctattgcagttacctatttttgatggactctgcaagagagagactgtcagttcacaagggcactgatgtttggttcttcattttatttacagtatgctatacaaagggataggtttttgttgttttgaatatatcttgagtactcctttggaaggatagagtccaaaggcatcttacctgagccagaattcataggggtggttccctaccgtttcttctttcctgtacacactcaccaccctcaaatttccgctcagtagaggatgctttaggaccttttttcttctttctttctttcttccttttctttttttcctttttctttttgaggtagggcctcactctgttgcccatgtagtggcacaatcatagctcactgcagccttgatctcccaggctcaagtgattctcccaccttagcctcccaagtagctaggattactggctaattttttcagttttatttttggcagagacaaggtcttgccattctgcctaggctagtcttgaactcctgagctcaagtgattctcccaccttgatctcccaaagtgttgggattataggcatgagccaccatgcccagcctagaaacttttcttttcttttcttttctttttttttgagatagagttttgagcccaggctggagtgcaatggcgtgatctcagctcaccgcaacctccgcctcctggattcaagcgattctcctgcctcagcctcccgagtagctgggattacaggcatgcgccaccacacctggctaattttgtatttttagtagagacggggtttctgtatgttggtcaggctggtctcgaactcctgacctcaggtgatccgcccgccttggcctcccaaagtgctgggattacaggcgtgagccaccatgcctggtcagaaccttttcttgactccacttaagctcttccatttgaactttcttttaattatctggattttaactttatcagaattagtctgccggtaatcctgtttttagctagaaggttaggctttgagaagtgtgaagctggatgggagggaaggaggccagcaaagggaaagggactagctgggttgaagaggccccatctgctattccagatggggcatcctgaattcatcactcctaaaactttgctctatgtgttttctaggctgcagcatccagacagcagcacacccttcacatgttcactgtagtaaaataacgtggaaagggtagaggtatctggcagataagagaggttatttcgtaaggctgtgatgcccagcacataggtctgtacatcacctccttcctgctgctcctcaatctgcctttctttggtcactgccccctgctagtatttaattctgttgaatttgttcaaattgacttgtttaagaaggttacccaaatctgcatacagccttcagcattgctttgaatctcctttaggaaaggaaatgtagattcaaatacacaggtttatctctctgacctttagctaattattagattgagataaatgtgtgtaagtgacaaattgcctttaatgacatttaatctgcatcctgacattaatgtctggtttagtgtcccagttccatagaggcaaagagcatggacttttgtcttaatttgacctatttaaaaggtgtttgtggtgagagtcaacctgtgattaacttaatagcatgttttacatgaaaagcaatcaaatattgatgtaagaagaggctactagatgacatattttccagtctgtcataattggcaaaaacatcagagaaaggagagagttgttagtaactaaaactgaatgaaagcctcatagctgccccaaatccaatactggtgagcacattgatagtatctgaagaaaggaggctcttcttgttgtttattgtcacagaggccattcactgaactttggtgggtgttagactaatagatttttttttttttttgagacagagtcttgctctgttgcccaagctggagtgctgtggtgcgatcttgcctcactgcaacctgtccctcttgggttcaagccattctcctgccttagcccccaagtagctgggattaacaggtgcacaccaccatgccaggctaatttttgtatttttagtagagaaagggttttaccatgttggccaggctggtctcaaactcctggtttcaagcagtctgcccccattggccttccagagtgcagggattacagacatgagccactgcacctggcctaaactaatagattttcacacctttttgattcactaaaggacatcataggggcttattaaataagtgagctatttttagggagtgagaggtctgggaagtggcattcttggtggatttgttgtgtgctagtcaggtgctaggtgctttgctttttgcattctcatttaactcctaactacaaaaacatttgtacaggcaaccctctaactcgtgataccatctttttgaattaaattaatttttttttttaaataaggtcttgctttctcgcccaggccggagtgcagtggcatgatcacagctcactgtaacctcaaacttctggggtcaggcagtcttcttgctttagtctctagaatagctggaactacaggcacacgccaccatacctggctaaattttttgtagagacggggtcttgctgtgttgcctaggcttgtctcaaactcctggcctcaagtgatctttctgcctcagcctcccaaagtgttggaattacatgtgtgagccactgtgcccagcctctaattggtgacttctcaattaactttgacataagtgtgtgttttataagatcattatcaccgataataaatgcagcttaatttctaatcaattggccaaacagggaaatttgagttgagtgagatcattaacaactttctttagcgctttaagagctaagtgatagcttttccagttctttaaacattacaaactgccgttcctggtgaatgtcattttctcaaattcattttcagagactggaatgggtctgtgctactctatataattttgtgctgagcggatggtatattgatgggaggaagtaggagagtagtgatggaagggcacaggcattggagtctgtctcccaggtgactctgtaagtttttcaactttcctatgccttgatttcctcatctgtaaagtgaggataatgagttaatgaatgtaaagcacttagaagggtgcctgtagtaaggacttacaactgttttatttattgtttttggagtttggttggaggattcaaagcaacattcattaaactaaacactcactaaattcactaaaatggtttccaagtgaaataataaatatagcaaaggagtctctcctctgctatggagtagctgagttgagtgcatctgggtgtccattctgctgcaaatccaggccaagcaaatacagtttctgtgcaattaaatggttgttgactggcaaagaaaaaaaatgtaaaccatagtttttccttctaccctgtaatctgtggtgtctttatgcattaccttaagagcaacttcagtgacttgattagagggaggtttataaactgcttggaggcaaagcaccgaactcttgactggcacacagcaggtccacaaggaaagccacttcccagggtaagaaagcacacacaaattattcagggacaaatgtaatggttacaagggtgtcatagaaacagatcagaatacttttatactactgcctggcttcttgttcccccattccccattataattctggattcttaagtttattttaatgacaaacatttttgcctgtctttaagtaaaagaacagaaaagaagttacttaaaatgcagtcctaattatgtcctaatgcaattttgatgcagcaatatgctttcaaacaagcaggtactgggtggcagattgacacaagtatttagtgaattgagaacaacatgtgttacatgaaattataatcaaattacaaacaatggaatggattgttgcttttaaaatcctctgaatgttggttaacttcatagggcagtgctgtgactatttccattaattacggagtagttatactgggacttgaccaagctcttttaatagttccatctgatttatgtttttctcttctctatttttcttttctgtctctttatttctttttgtcactatttttgttgacctgtatgtgtgtttttttctctttctgtatcagttcaagttctccagagaaataaaaccaataggaggagtgtgtgtgtataaatctaaagagatttattttaaggaattggcttacttgattgtggggggctggcgagtctgaaatctgtagggcaagcagtaggttggaaatttggcaagagttattgcagtcttgaggcaaaatctcttctttgtgataccttatttttgctctgaaggccttcagttgaatggataagacccacccacattatagaggataacctcctttacttgaagttaactgattgtagaagttaaccacatctagaaaatacctttatggaaacatctaaattcatgtttgattaattaactggctgcctgctattgccttgccaagttgatgcataaaattaatcataacattgtctcattcctttttccctcactgtgtgtttctgtctctcatctcacatgcacacaaatgaggttatgggacagcattagtgttaatgaatttcaggtaacaggataatgatcattatagcatctaccagtaattggatacctattatgtgctgagtcttgtatttgatgctttgtatttctgatctcatgtaatcctcttgacaattccatggattggacagaattaattttattttatgggtgaggaaactgaggcttaaagagctgctagcttttatttagccatgtagagctcaaggttcaaactctaatctgcctttcctgcagatatactctcttctgtatctgcttgtttctctaatattcccccatcactgtcatcactggctatttttcagtgtttcacttggatgaaaaacatatctacatactttttttgtttccttttttttttttttttttaaagacaaggtctcgctctgtcaccaaggctggaacgcagtggctggatcttggctcactgcaacctctgcctcccaggttcaagtgattctcctgcctcagcctctcaagtagctgggattacaggcatgcactaccatgcctggctaagtttgttttgtatttttagtagggacagagtttcactttgttggacaggctggtcttgaactcctgatctctggtgatcagcccgccttggcctcccaaagtgctgggattacaggcgtgagctgccatgcctggcctgcatacttttttttactaagcttttttttttttttttttaataggatgctgaaggagctgaggcagtgctgaaggatgttaaaagcacacacagtggagagcttattgttgttccaaggcctaattggagatctaggttggcatttcctacagctttcaaagtgtacaactaaaagactatcctaagaagatgagatagtttctgaactaggcacgaaaagctgtaaggagtgtcacctcccagtgccctctggcctatttttctcactgatggattgctttgttatctgctgccagaccccttaatgtgctggctcagccttcacagggattagtcacagaagatgggcgctgcagctgcaggtctggctccagaggctttgggtggtacctactactacttacttagcccttagccagatattccctagaagggaaaacgctccttagtttcactgaggatctggcctcatgagcagacactagttctaataatactctttaccttctttgtagctcccagccattgtcttctaccttcccttgcctagctttagtcactgccagcagctatttctaggctgttggcactttgaagtggaattgggcagacagaggtgagagcaggctgtgagttccctctctggaggttggctccttacagcacacatgggaggcagtgctgaaggatgttaaaaagcacacacagaggaagagcttacttgttgttccaaggcctaattggagatctaggttggcatttcctatagcttggcatggaacgatttgaatgtttgtggatggtgcttgcctcataccttgccaactcaaattttgggcagatcagcttctgtgagttttgtctcgacaagttgggaaagtttcctaactttagatgactgtgtgaatctttgaggagcttgatagttagcaggtgagggctgctattttgaaggaaatagacattaatatattcttctttaatatatctgaatgggtatacatatgtgctcctttgtttcttgtaaatgggcagtacaggagggagaaactgaaggagaggacttggtcaggagataaacccccacagatgccaagatgttggcttgttgaagcttattcgtggttagttttactgtgatactatgtgcagatggttcctaagttataatggtttgacttatgattttttagttttatgatagttttggtgcaaaatcatttttttttttacgtttagtacagtatccaataaagtgtgacatattcagtactttattataaaataggctttatgttagattattttgcccatctgtaggctaatgtaagtgttctgagcccatttaaggtatgctcggctaaggtcaggtgtatcagatgcttttttgacttttgatattttcaactaacaatgggcttattgggatataaccccatgataagtctaggagcatctgtatttgtctgtgaattacttagggactcttttgatgtcttcgttttggaaactctctgttgttggtttttgttattttagccttgtcgggttttcctcatactggtctaactgctagtatcttttattggcccctctttcttggatatcctttacatgtttatatttgttagtgtttcttccttgacttgtctcacttctcgtgtttccttgggtttgcctccattactaagtcttcatccagcccctatgtcattggttctcaaagtgtggtccccagaccagcagcagcagcatcacctgggaacttgctggaaatgcctgaactaaacttaagacactatataaaacaggaaaaggcattttacattttgatacacattgtcaaaaacattgtactggtttcatggtatgcattataaggcataaagtagatcaagcctatgttcctaatgcatacatttctattgacctcagagagtgaactatcatataatagaaataggattatcattagtttaatgaatgagaaagactcttcatgtttgttctttacctaatctatgcagtttaaacctagatcgacctcagggaaatatgggaaattgtgttctcttctggcttgtttaagtacaaggaactcagacccactctaatttgctttaagtgtttttttttgtttgttttgaacagtaagaaactatttagggtggagaactttatttcagtaaggcctcatgtgaagtggaattaagacagtcataatgtccttttgtggcttgatcttgatgaggtgataggcttctgcacacattcatcaactgttcatattctttcccgctctgtccgccccccccaccctcatcttgcttgcacacacgtgcatacttttgcatgctctctgactctctctcttcttccctctccttcctgccaacacagctgtattcatcttcatttctttttcacctggcttcctccctctctgctctgtgtcttttcaggtccctcccaagtttagttcacgcattactcattctatgaacctcttaaacttcgtgcattctatcttttatccctattactatgtcaccctggcagtttcataatgcagatttctgagtaggagtcccagtgggacagaacctggccacttgatggcaggtccagtgtcctggtcgattcccttagaaagtgctgtgcagaggactgttactttttcttatagatcattctatgttttaagtattaaatgaagcctcagctccagcatagcgtttctgacaggctgactcacttcacatttaatgattgtatccagcatcttgtctctactctccagcaatgcagctccttcttctggtgtcgtcacttctatggacatatcctgtggatgttcccatccacctgagcccaaaacctctgtgcttgtttgttcctcctcctccttagccctcacatctcttcaatatttttctctctctttactattacttaatgctactgccatattgcttcttgactagattttaataatcttctgatttcaatctgttactttgtctcagtcagaataacctacttcccctttcacatgaaatacttatctaccctgaggaatatccctcaaggctctctattgcctgcgaattgagaatagactcctctgctgaagattcacggtcttcagcagtatgccccctacttggttcttttactccaaacactgtactctagctacataggactactgagtaatactcctcaaaggctccctctcttgggtacttgtaaagtgccctttagctgtgtagcagagaataggacaggagtgcacactctggggctagactgacgggctggaatctcagcccagcttgaaaactttgagcatttgttattttatctttctgtgcctcatttttctcaactgtaaaatggaaacagtgatagtatctgccttgtgggttgttttaagagttaaatatggagcactcagagcagtgccagacacacagcaaatcctcaggtctttccagggatacttttttttttttttttttttaatattctccattagacgtgatgtttctgtctctgcgatgtggtaattttttctgttttttatttttaagggtacctatcacagtctgcttcccccttttcagattatttgtggatttcagatgttcacctgtttttctttgagctccttgagtatggagatggtattttattgaaacttatattatgacatacggagctcaataaacatttgttgaattggattatatccaaaagatgcttctgctaaaatactgtagtaacttccatctgtcccatgaatgttcgtgttctgagacaataatgtaattcttaaaactaggttttaaaccttaaaagtgaaagaaagtgaatactttgcggttgtcatatagatgtactgctactcaagtatagtaagtatattggtgaaatatttagaaaaaaacaactagttgtgaatctgaatcagagatcagcaaactttttgctacagagggaaaaatattaaatatgttcaactttgctggtcatattatctgtgttggatctgtttaccacagcaatcgtaatatgaaaaatatgtaaatggttgagttccagtaaaactttatttacaaaaacaggtggactataatttaccaacctctggcctgtgtcattactgtgcaaaccacacatcattttagaagctgtttgttgcaaaagctccaggtgctgccacatccaaagatacacacctgcatgtcttctcattaggtataaggaaacctttccagaaaatctcagcagattactcacaagttcagtggcccaaagttgtatcacattctcacacttcaaaccagttactgatgatggaatgagactaccatgattggcccaaatacaccaggaatcacaggtgttgttgtggataaggcctccctatctgcatcacgtgaccatgttgatgagggcatttccttgtgaagtgaaaaccattgaattgtacaatgaatgtgatacagcatgggctgccacagtccagttgtcacctactcttctgttgttcttctgaacatcatcataatgtcacatttgacaggtgtgaggtttctttgttaaagctcagacttattttaaattaatattcttatcacatgaatagacccgtggtaatgatgtaatgaccttggaggggcaggccagttttccgctgtgaagcataaagtttcccatatgacatccttgggctactcattttggtattctcagatatgcaaaacagagaaaacaacaggcttcccacttcagaattcaccatatacccttctccttcttgaaagggagaaaccaattagacaaggactagccttctcttatacttaataaaggcaggtgagttgagcctcttagtatttgtcatacactatggattaaaccagtttatggcccatgtcattgtacccaaaactctggtgtataatagtaaaacgttcatagttttcaaattagacttagagcttcttggtctcactttagaatattttgacagccctttggctttcacagaaagacctagtccctcaggggtcttgaactgagctaattatcctagtcatatcctgtagaacgggatcccactatggcttgtctgagactgcattgttgtcttgggttgtatgggaccatgagacaaacggctgtactgtttttccacttggcttttctgtggtgtaaaactatcttttaggagccacaaaatgctattcttttacttgttgaaagattttaagaaagaaagaaagggagggagggaggactgtaagggaaaagagaccattaacatgacatgtttcctgtcgctctccaatctgagtctaaccccagatgactgtattcccattgttttattgtgagggcatttgtgagggccttccccttggttgtgtcttggtttacagtctatagaattggattagacaatgttaattcaattaatgactgtactgaaagtttgtcttagtgtgcagtgaaaacaggagagcagcctctaataatctatggatttaatgactgcaactttgaagagtgttaagctaaagtgaagttcagaatggcttgttaactgggtttattagctgttgaccttccctttcagcataatagtggcagtcagaccgaagagagcactaacgtcctgattagcatttatctaaagataggctgctgcctgttacacagtaaattagttcaatcagccataaagagcttgagaaacattttctgctttataaaaagaattagatgttagaacagttcatctggcatagctcagtgaagatggattgagcccctgaacgtgctcatttgaggaaggcgctttgaggatattgagtaattgaacagattttcctacaagattgatcaggggccctagatttcctgcacaattgagtgatgctctaatttttgccttctaataagagcagtacatctgctcctgtttctgtgtattcatcgagtgaaactgaaaatcaatttatttagcacctactatgcactctatgtcccttacgaaataaaagcaataggatctactgatcacagtctatttgattgaagagatgaaaactacactaaaacttgaaattcaccacttccactaccactgcttcttttcttctgaaaagaagaaactgtagaatgaaagctgctacttttggtatatttcttgagatcatcttatgaagtgaagcacattttcccacagaaacagtatagtagtcggggttaacgtttctgactaaagtcttggcaccaactaagttcttctcatagtgggtcataaaagcaaaaaggcaaaaattataaacctttctaaatcatttaaaaacttaaattatgatccaggtccttaaaaaaaggacataaatgtactgtacaattgaattttatgaggtgccccaatgtactataaagtatacatagagcatataaaattctaactccgctgtatcataaatttgacctcactgaaatgaataggctcactgtatggcaagcattaatgaaacgtttaattaacattcccttcacttgcatttttagaattttaaagggcttcctggggactatttcaatggctgaggtttttgcaaaacaaaagaacaaaaccttctcataaaaactgatctcttttgctcaataactcctccaatagagacatttaatttaattagactgatgaacctgaatttgaattttatacccaaacctatgatcatccttaaaaaaaataaaacaaaaaatatggtattgagacagttaagcacttgatgacttcatgaaggcttcctgtggaccctttaagccactgtgtatacacatatcatttatgtccttgcagttttcccaagctaaaagccacagggatatgagtactttgtgagggacagtggtgcagtgttagaatggatgagctgtagggctgtgggcttcagaccctttcatagctccctgtaaggtatcctcctcctctaaccttccctgtaattatgctatgttggtttactttattgcctggtcactccaggagaagtccccagggagtcatacttgaatgaacagatagaggcagagtaaaaaaaaaaaaagacattatgctaagtgaaagaaaagtcattcacaaatgactgcatatggtgtgactatatttgtattaaatatccagaataggcaaatctgtagagatggaaagttggaaagtagattagtagttgtctaggggtgaaacatgagagggatagggagtaactgctgataggtacagagtttctttctggggtggtaaaaatataaaattagattgtggtaatagttgcacaactatctgaatataataaaaaccattgagttgtgtattttaaatggttgagttgtatgtatgcaaattacatcttaataaagctattatttttttaaaaaggtattaagtttcctcaagttaaatgaaatgaccaaaaggggaaaggttttaagcagtgagcactccttgtaatgtatgtgtatagtgagtatgcatatgtttgtaaaagtataatgtgtgtgatccaactatgagccatatggtgctagtcatgatgtgtatacatgaattctagaaaaagaggaagaacctttaagtgagagaatgccatgcattgggaagcagtgtggggcaagatctgtgtggctctagggtggcaaatttagtttgagcttgtgaatccttgcagagattggcaaatatcagatactccttggcagagaaagcagtagagtcaaaattgagaagatttaaggaagcagagactaataaggagagaatgttgaaacctgttatttgtagttagaagtgtagatgtatacaaaatagaaaaaaacaaaaagaatcttctgcattatatcaggaggaacttattggtgttttaggaccattaagatggagaacacagctcactcatatgtgggagctacaaagttgagctcatagaagtagaatataactgtggttattcaaagttgggagacgtggaggggcggggaggatagggagaattggtaagggatacaaaattgcagctagataggaggaataagttctgttggtctgtagcatattagggtgaacaccgttaatcttttattgtatattttttaaaagctagaagagaggattttgaatattcccagcataaggaaatgataaatgttagaggtgatgggtatgctaattatcctgatttgatcattatacattatgtacatgtatcagaatatcatgccatagcccataaatatggttgctacatgtcaactaaaaagaaaatttttaaaagatggaagacaaaagtaaaagataaatgtagatattcttttaactgtttggtgcttacctggtgtcctctgaaaaatcagagtcgtgggagatgaataacatttccagagagcactagatgaggagttagaaaagctggtttatcattcctactctgtctcttcccatgttacattaaataagtaactctgtgatgctttcttcctcccttgagttgtccttcttaccctgagaggatggcacaaggatcaaatgagctgacatatacctattgcattgcacctactagaatgtaacaaatgtttgtcagactgagggaggaaggaaggaaggaaggaaggagtagagtgatatcacatgcaaggaattggatttactgacttattcctctggccaagtgtgtcaacattatgattgcaataagaacttttgcattaatactatttatacttatgggtattattgctgcatttggtaattctacggtaaatttggaggtgcttctagtatcactgtcttgttctaccaatagtcttgtatttattgacagtttggtggttgttacaaatgacaggattgcaaatagaaatcaagctccaaagatggatggattagcttccttgttatgaccgtgttaaggttaccactcagaacaaacattggtagttgagcacgtcttgagtgtgagtgtcatactcagaacaattctaattttttaaaaattacttttttagaggctgtctcactctatcatcaggctggagtgcagtggcataattacagctcagtacagcctggaatttttgggcccaagcgatcctctcaccttagctttccatgtagctgggactatagtcacgtgccattacgcctggctcaattctacttttgatgaagtttttgacatattgacattgggtttgacatgtcattccaatataatatgatactgtagcattcaacaattctcttcccagaggagactatagaaaacagaacatttgcatttcccattttgtactttatgccacccactaaagaattccaaagtcatgcagaatgcctttgatgatgtgagctgcatgtgaatttcttattgcttgacttttaaatcccctttgttatctaggtccattacttataagctgtgtcacattaggcaagtgacatgcctctctaagtttccacttcctaatctggaaaggggggaaataatgagattggccctgtggcatcaggattaggcaaagtacttggcataacaccagtctcacagaatgcagtttttcttgagctgttgggtcagtgatgcctgaaagaggaggagtggaggttctgaggcattgctgtttttatcacgtttgatttgttttctttttgtctagacttgccatattatagcttcatcaggattttaaagacgattgtgaattatattttcaaaagttgtatggactcttgtactttagtataagcagcacaaaattaggcttaagaaacttagattttaatgttagctatgagaccttaggtcactggtgcgtgttcctctcatgaaataagagaatggaaccagctggttctttattcttcccggttccaagatgatgtggtcatagagtcttcattgcataatttcttgttcctcctcatttcttcttaccacactcttgtctttaatctctgacacctttctacccatctccttcaatgctccttctattcatcctttcatacgtcctaaaaattgttatgtcaactatgaggcaagcagtatattaggagctagatatgtaatgttgaaaaatatagacatggttcctgcagtaacagaatttacagtttaatggaagaagtacagataacacaagtaatacttacaaaatgtggtaagtgctatgaaagagcaggacagactgctttgaatgggggaaggggggatccctggcagtttaaatgacttttctcaaagcaggctgccaaaaggtagcggcgccggccagaggtggtttgagaggcaaagcagcaccacagacaggggtccaaggcaagaaaacgctgagctgctctcaggtgctggaaagccagtgtggcttgaagcgtgctaagagtgagactggaaatgcatgccaagtttgaggccgagttcaggattttgtattccatgataagtgtaatgggaaatctatgagaacttttaagtaacaacaatatgggaatcatacttgacttggctagaacaattaaaagctgatctcttttagaaagtacagttttgttttacattaatcttaacacagaatagtgtattacacctaaagtgaatactcttttaggctgggtaggggctgtcccgtggtttaatattgtttctatcataggagaagccttggtttcctagtttcccaccttgtttctcctctctctgccccactgggattctagctgcttcttcactgcatttgctcacctcttcttctccacagtcctttggtccttgaaatgctgtaagagcagaaataacagctatccagagaccttcagatagcagatgtgccttgggcctgtgggtctgtggctctggagggctaggaattacagaagagttaaaagagaaggcctctgccagcaggaattccgaagacaccaaaactgatgtcactggctgtgcaggcactgagctaattcttttgccaatcagttaaatcacctaccaagagtgttcattgtaagtaacactttcttgccatttggtggggatgtagagggacaaaggatgcaaaaggcaacaggttctttccttgtaaaactgtaatctaattctgtaaacaagccatgtacctttggaaggtcattttgaactcagtcctggtaaatatttgacaggtgttttaaaaaaataattatatttatacaatctataatggaatattatgcagcttttcacaaggaggaactcctgccatctgccacaacgtgggtgagcctggaggacattatgctaagtaaaataagtcagacatgaaaaaaaaattgcatgatttcacatatgtagaatctaaaaaataggataaaaatacagagagagaataaaacagtggttactaggattgggtttggaggaaggaaatgtggagatttgagtcaatggatacaaagtagcagatatataggatgaagaagtctgaatatctgtacaacatgaggactatagtgaatcacaatgtactgtattcaggatttttgctgagtgagtaggttatagctgctcttgccacaggcaggaaaagtaagtaactgtgagatcatggatatgttcacttgttttcctatagtaaccttttactatatatatgtacctgataacaacatcatgttgtacaccttaaatatccacaataaaatgtattaataattttatttaaaaatattttaaaatgtggacaattaaaaattttttatataattttttggtagttataatgctctgttcttttacaaattgtgagctggatactcactactcttcttttagcccaaattgagaacatctggaggcatttttatgtgatgactaaaaatacggtaattgagttagactgtatgggtctgtaccctgctctgccacttcctggacatgtctcagttttctcatctgtgtaatgatgatagtagcgtccacttcttgttgttattataggattaaataatatattacatgtaaaatgttgagtataaaacctggcagatattaagcacctaataaatgttaggtattaaaaatatataaagtatgacttctgctttcgagaacttaacctataaatatcctttgataccccgccccccgccctttccaccttgatttcatttacacaagagccaagtgaaagagtagtgagagatgaaactaggaaagcaggaatgaggcagtgggtagagaaggatatgtcctgaccaatggcattgacagagtggttttgacaggtgagtgtggaaatggactgcggtgagggagagtggaggtagtgttgagaacccgtaggctctggcagcaatgtggagcttacttgcagcatagcctcccttcaacttggaaaccaagcatttcaaagtacctgggaactttcttcatcacatccttccagcatttacattgtttacaaatgaaggagggaatagagtatattttattttctgataactttctgggtttccaaagagagaactgtaaaactttgataaacacatccataagagttgctgcccacacggtttcaaaactggatctcttgagctgggcataactggtcataggcagagaaacgttgactggtgatttataccttataccctctcattaaacactcttacctaactacgcaaattaggcttttaaaaatagattatttttattgtttaaatgtagaagaatatatctcagagttataggaaatttgcatgggtacatgtttataataaaaatcctgccaccatttatcataaatggccttggtttaggagtttacacagtagagagctcaaaccactggctttgctatgaaatagacccaattcaagctccatctcttaaaaagccatgtgagtttgggaaagtggcatcactttcctgagccctgggtttctaattattattattattatttttgaaacggagtctcaccctgtcgcgctggagtgcgatctcagctcacggtaacctctgcctcccgggttcaaacaattctcctgtctcagcctcccaggtaactgggactacaggtgcccaccatcatgcccggctagtttttgtatttttagtagagacggagtttcactgtgttggtcaggctggtctcgagcttgtggcctcaggtgatccacctgccttggcctcccaaaatgctgggattacaggtgtgagtcaccacacctggccaggtttcttatttttcaagaggagttataagacccacaaaccttacaattattgtaaaaattggtaataatatatatgaaaagtccccagcacagtgactcctgcctggtaagcaacccacgaattttacctattgtcagcattgtttagatcacctttatttaacttagttataatggggcttaattacaaaggggatccatattctaaaagcaaatactgaaacaaatttttacaattcactaccggttcttcagattaaggtcttctgatcatggttcagtttgggtttttgttgttgttgttgttgttttttctccccaagatgcagtcttgctctgttgcccaggctcaagtgcagtggcgcgatcttggctcactgcaacctctgccccctgggttccagcagttctcctgcctcagcctccctagtagctgggattacaggcgcctgactaatttttgtatttttagtagagatggggttttgccatgttggccaggctggtctccaactcctgacctcaggtgatccctgccttggccttccaaattgctgggattacaggtgtgaatcattgcacccggcctgagctactgcgcttgggccatggttcttaatagtaaaattatttaacgagatttttcccagttcttactggtaaaaatgtcctgtggtttaaaaacgttcaaattaatttgttgtatatttcacatgacagtgatacgagggataattgattatttgaggtattgatttgacctaattcagcataataatttactgattttcattcagtgcatgctaagtactaaatccagtcttgctgggtacagagaaacatacattcattcaaacatcatctcttctctcaaggagctcacagtagaacctatttaaatttaggcagtggggagcatgaggctgcagagaaacaaacatccaactttatgaaaagacaaaattatggagacagaaaaaatgatcagtggttgctaggagttggggagagggaggaatggataggcagagtggagaggatttttagggcagtgactctgtattacagtgggtacatataattttacgtacgaccaaacccatagaatgtacagcaccaagagtaaaccctaatgtaaactatgaaagttgtgataatgatgtgtcagtctagactcatccattgtaactatgtaccagtcctgtggggaatgctgatagggagattgtccatgtgtagggacaggaagtacatgggaactctgtactttctgcccagtttttctatgaacctaaaactgctctgaaaaaagtattaattttaaaaagtggtcttactgctttggagcacaagtaaatcatactaagaagacgatgtttaaattaatatactacagatacagtttgctttactgaaatgcagtatatgatgttcaaaacatatatctttaagtaatagccattttacaaaggaattgcatgtttttacagggaggtttcactggcctattagggcatgttggcttggtggtacagctaagatctaattccttctgccaccaaggagctttgtgaccgtgggaccacccaggaacctctctggctgtattctctgcagaaagacttaggacaacaacatggcatgctgtgtggacatgatttgctttgttgggcaaactggtgggattggtggggtggatactctctaatggaggttaaaggtcctgaagccactgcaggttaccctggggcgccatttctgtgctctggattaattctttgctcagctgttaaatgtctgtgtctggaagtggagatacacaagatgggttggtccccatggctttttatacctcaacaattatttcatccagtagatatctatactaacttgattgtaaacattaagtttacatgggatttctttaacacatccattttctaagaaagtgatccatgtgtaagtatagagtgaccaatgagaaaatagggtaattcccacacacccttccaaactttacaaggagtgaaataatataaattagcttcctctagtgataaaactgcaagaattttcaggcaaaagaaaaacagtttagtagcaccatctacaggctactgaagaggaaaacttcctatgtggcttttaaatgcaaggagtttgtggaaaagggaatacaaaaacttcatactctcttaaaaaaatattatccataaaatatactaattttagtatttttgttcttctttaccatgcattcaattcattttacaatatgtctctagttatcctgaactagtggaatatagacttgattatgtgttttcattaggatccctgtttcatccccatgcttacaaatttctctccctctctgtactaatgataagaatgaactgtgaaattcacatgaattccagtagtttcattgatagtaattcacagtataagacttgaagcacaaagcctgccagcaagggatgtttcatcttagcttatctgtatactcaaaggatttattgcatcatttacttccattatgggaggaaaaataaaagcagacactcttgggtatgtatgtatatgtgtttgccttttttaaaacaatgaagttgatttattaccttctgggtttaaaatcttatctgagccttttctgcccctaagattctgtgattctataatcagaaatagcttggggaatggataattattttgtaaaggaatctagaaaacttgtctttgaatatgataacagtgaaggtaatattttcattcccagataccccagttttattatctttttttgctagttttattttgttttcttataaactattatcaattttggtaacctggaaaattttattggattctccaaataactggattataaagtatttatggaattatcagagttgtaattttctgttagaaatggcttattaaaattaacttaatggcctccttgtaagttgttggtggagttgctgtttcattcattcattcatttcattgtgtgtgttattggaaagtgggtaagagttactggaatgcctagataataagttttcagtaaagcattacacattgcaagaagccaatctgcacccccacccaccccccaaaaaaaaattgagcataaattataattattagaacaatcttacttgaacagcattatttcttggaggaaaagaggaatagaggagatacatattgaaatagtttgctaaactaaagaggaattcaaaggataaaaaaattgataatgagattttcaaggttcctgttgaaacagatgaggcagagcctatcaaaactggagccaggagtgataatggtttttaagtttgtgtagcttaattgctgatggtttaggttgatggaaaacttagtaatactgtttccaattttttcctcattattttaaatgtgtaaaaaaattgtgcattaaatactggaacctttctctgaaaaaaagtaaagcaagttctagtatgaatagaggtttaaagtaaggcactgcctcgtcgtcctatagctaatatttttccctgtttttcttgcaccagatggcactgtttagttctatttcacaatcttattctggaactttcttcgggagaatctgttttagcccagggtcaccagtgacacctctctattctgcatgaagtctttatgaatgcttgtaaaaggtcactgactcagacatgaagctgtttatttgaggtcttgtggttctttccagttgcacatttgctgtgaggtgagcctaataaaccagctgatagaaacctacatgcttcttatagagttcagccagtattttgcttggagacatattgcaacaatatgatttcagcattctcacggcccagtctaattatctgacacattttggaattattttatatgtaaaagtagagctataagcagaagggcacactcactaaaaaaaaaaaaaaaaccttgcagagcttaaaatgtttcatgacagtctgttgaactatagatttatcaaattaacttgcaaaaataaaatttaaagaacctttcctgactattcccaaggctgacttggaaggaaattatcaatgacctctgatgtcattatgcataaatggggcaggtccatagccaagctcgcctctttgctgcacataacaataaaacatccttttggaagatagaattagctttatttaataaaaatgccagggtcatattgtaagacttatctctgtgagctttgccctcccctcccctcctctcccttgaataatacagaaacgttggacataattatgacacagatttcataaggctgcttctccttttacaattatattttatgaagaacagacaatgttttctttgcaaattttgaagctccttcattttctgaatgcattggatttggtactaaatgctctctcccgtttgcatttccttctctccctccctccttgcctccttccctcccttccttccttccttccttccttccttccttccttccttccttccttccttccttccttttttttttttttttatttttggtcagtgtttcactcttgttgcccaggctggagtgcaatggcgcaatcttggcttaccacaacctccacctcctgagttcaagcaattctcctgcctcagcctcccgagtagctgggattacagacatgcgccaccacgtgcgtctaattttgtattttcagtagagacagggtttctctatgttggtcaggctgctctcggactcccgatctcaggtgatccgcccatctcagcctcccaaagtgctgggattacaggcgtgagccactgggcccggcctcccctttgcatttcactgctctatgtattctcttggtggtgatatgagttgaagggtgggagtaggggtggagagccctctctagactggagctatgagtgcataagtgaaatctcattatttccatctttaaaagaaggagtattggcgtgtggtgtttttagccagccctccctcctttcctctcatgcccatccacaggccattgactggaaggcacaacagctcccagcacagcccctcctcctgccgctggagaggtgttgggactggtgtgctggtttccaggtgcaggtcctccaggctgagccacagctctctgtagaagtaagcatgagacaggctgcttccataaatcaagccctgaattttattacagtgtttatgtaacctcagtttatgtgctataattctttgctgtgttgcctagagtaattcccaaagaggatgtttgttctttttccctggaaattttctagcataggccttttgttttgacattctccttccccccaccctctgccttttttgggatggcctggggatgggtatcactaacagtcaattgctttttactgagtaaataatataatccagcgtgtgttagattctgtttgtactagatgttattcctactcttaagtgggagaaaaaatctcaaattaatttttacattttcaagattatagggtggtagggttaatgtgtacttaattgatgagtaaatgaaatataagtgaaaacaaatgcctttgctatccatgggagacccgttccttttcatagcctccgccaccatcacagatctcatgttgatagagtcagattgaccgctgagagagaaaatacagactggaaattttgggtgatttagacttttaactgaagaaaatgtcagggtaagatgaccagattcaactgtattccatgtagacaactatgtcaagagagaaatgttttctggttggaaatgaagacaatttgacttaaccggagcatgtttttaaagaaacccatagcatgttttttttttttttaacttagctctttttttcgaaccttatgtttggccctacagagaaattaggtgatgagactggacctactgaaagtgttaccggacctattctgcttggacacgctagacttgtgaactgctgactggtatatttcagttagtacagttaatgttttatcatcactgccattagaaggtattacatagatgtgatctttttcattgtagtttaaagaagatagttaatcctggggcaaagtttatgaaggaagtgtgtgaacagagcaatctttttagatttactttaactacaaaactggatatttgttttaaagctgtgctgtttaggattgtagacactagccacatgcaactgttgcgcatttgaaatatgaccagttctaattgaggtgtgctgtaagtctagaatacacacttgattttggagcttgagtatgaaagcaagaatttataggtcctctttaatcatttaaattaattacacattgtaataattatattttagatacattgggttacataaactgtatcatcaaaattaattttatacctatttttaccttgcttttactttttaaaatgtgactcctagaaaaaccttaaaattgcaaatgtgactcacatttgcaactcacattattttattatattatattttattttattttatttattttcaagatggagtcttgctctgtcacccaggctagagtgcagtggtgcaatctcggctcactgcaacctctgcctcccaggttcaaacagttctcctgccccagcctcccgagtagctgggattacaggcgcatgccaccatgctcagctaattttctaccttttttttttttttttttttttaagtagagatagggtttcaccatgtttgccaggctggtatcaaactcctgacctcatgatccgcctgcctcggcctcccaaagagctggattacaggcatgagccactgcgcctggccttgcaactcacattattattggccagtgctgttttaaagttctgttgtccaatgaagggaataacagatgagtacactcagtaaaaccttcaaagttatacgtttaaaggaatattctatgcttcctgataaaatattaataaccaaaattagcaacaatatatagatgaaattattgcctcaagatttatgaggaaatattgactggaatactgtctattaaaatattcctctttacttgtcaagtctacctctcagtatcttaaaggaaagttctcatctaatagggtgtagaggttaagagcatgaactctaggttggaatcccagcttggttgtttactgtctgtataataggaagtaagttatttagcttccctgtgcatcagcttccctacatgtaaaatggatacaccttaatatcttcttcatattaaataaaacaaagtgtataaagcacatgctaggattcgcacatactacataagtactatgtaagtgctagctattatagtgatagatgttattgttcttatcttgttaaaatacgtacaactttttgatagattattcgaacctggactctattctcaagcaaatggaagctgttggctttcagtaattagtctgaattttgttgaaactcagaaacaactggcagtaattaaaaatgggaaagtaaatgagcaaagaagggagctcatttattggaacatatgatgagaacattccataaagtaaaacttgtagtaattgtcgattaaaccaattttctacctgatataaattcagtagtactatatttctttttatcatgtttctttgtcaccaggtatattggtctgcaattttgagtctttggaagttatttttgtgtttattatgctctgataaagagatgatgacctcttaatcttgtgtccaagagtggtggtgctatattgtcctagaattgtttgaattttagagcaatgtgtatgtgtgcatttaaacccaagtttaataagtcattccattgtgttcttaatagggctagataacctgagaaccagttggttttttattgtgccgaataaaatttgtaatctggtttagactctgtacagcactgtaggtataacaagtcttttatgcagttcgggggtgatctgtgatataagtttgttatggtggaattgatgtttgtgatgggatgtctagatgaaattaccccatggaatataatcttttttgagtagaggatggtatttaagaaatatgtcttcaaaactcttatacaggccagtactgcctctttagatgtaaaagtttataattttaattgcaggaccttcttttacttggcttttaaaagttattcacttagtcaaaatttattgaacacctatagtattccaggcagaatgctaaccctcacggagctcacaggggatacacactaagggatatatattgtagtacagcacagtgctgtattaaatagcaattgcagagacactttccctattttttatgtttttactgccactttgcctttataacatgaggtgattttagcatagagctgaaccaaatgttgggatattaaaaagctgaagcaaagttcataaagagcatgacttgggcttggactttgcattttacaaggtgtgcagtgtgagcttacagaggctttgacagcagggagtgagtggagcgttgggctttgttatttggagagatcactcttagtattggtattgggacatagatggtataataacaaggagagactgtaagaaactttgcagtatctaatcaagatatggggagaaacttacactaaagagtgtgtgctaggtgaagaagaggtaggattttaaggaaattctccaagttttaagtgcagaagtgtgggaggaaaaaatgtaagatgatgatggttctggcttgattttccagagtagagtagagtagccttcaagatttgatacaacgcttgacataggacatcttaaaggggagctcttagacttcaaggagaatatggtaaatattaagtacactattgggagcatgggtctgctgtatgggagagtgtcttggctagaggcttacttgaggtagtcatgatctaaaggtgatagctgaaggcatgggaggtagatggtataaaataataagcctctccactgtgcttctgggggatttccaaacaccttagcatgccttacaaggccctttagggtttttttctgtactttgttagtctcctttacaaaagttaatgctgttctctctcatgcaacatgcattcctcgtgtctccagctgtttgctgttctcctcacttcccgggctcttctgtatctccattacatcacacatgctgtttcctgtgtttgcaaggcatggctcctctttgtccccttaacaagctctggatttttctttaacacccagttcctgaacctccatggcccagctaatagctccatccttgaacccataagattttgtacatatttctattagtacttatatctcacttagagtaattatcacttgcctttcactcattctgtatagactgtgaactcctaaaggaaagagaagtaactttagtcatttttacatccccaacctcaaaatggcacttggcaaatagatgctcagagaatgtgttttgattgaattaattcatttgtgtgtgagctgcaggtgtcacattagtggcttttggatgtgtccagaagtatacctattatacgttgaaattttgcaaatcatcatatttgcaaaggttaaatgtaaacaggagaaaggtgagacctgaggtccttgtcaaaactgtttttcttactgtaatatcaatgtgtattgtttgtggaaaagttgattgataaataaaagaagaaaatttaaaatatccatagtctgaccacccagtgatatcttggcttaaattgtacgtacccaaaatagcaaaaataggatctatctgtgtatattgtccttgacttttttaaaaaacttactatctgtgcatcattaaatattagtaagtagtcatgttttgtggggttttcttttagtttgagatgaggctggtcttgaactcctgggttcaagcagtgttcctgtctcagcctccaggtagctgggactataggtacacaccaccaccatcctcagtagtcatttttgagtgggctagttaaatagacgacactcccatcatgcattatttaaccagttccttgctgttggacttataggctgacttataggctgtttcaaatttttaatttatatagtcacatttcaatgaacaatccagtagtgttgtcatattcatttttatttagaatacttcggtgaaaggaagtatatatcttactttttccaactctattagcaaatcatctcttggacatttttttttttggagacagaatctcactcttgcccaggctggagtgcagtggcatgatctcggctcactgcaacctccacttcccaggttcaagtgattctcctgcctcagcttcctaagtagctgagattacaggtacctgccaccacgcctggctaatttttgtgtttttagtagggacagagtttcactatgttggtcaggctggtctcaaactcctgacctgaagtgatcctcttgccttggcctcccaaagtgctgggattacaggcgcccagccagtctcttggaaaagtcttaacaatttttattatcaccaactgaattcttctcatcatatttttaggttttaaattgtctggaacttaaaaatatatgaagataggccagccacagtggttcatatctgtaatcccagcactttgagaggctgaggcaggaggatcacttgaagccaggaggttgagactagcctgggcagcatagcaagaccctgtgtctacaaaacccaacaaacgtgtgtgtttgtgtgtgtgtatgtgtgtaaaacatatatatgaagatatgatatatgaagatacattacgaagataattcaaatatatatatgaagatacataggaagataatttagcttgctgcaacagaaattccaaatttagggctaaagaaattatcaaactgaagcctttttgtaaatttaagtagttttgttgattttagaagtagacttttctggccaggcgcggtggctcatgcctctaatctcagcactttggaaggctgaggcaggcagatcacctaaggtcaggagttcaagaccatcctggccaacatggtgaaaccatgtctctactaaaaatacaaaaattagccaggagtggtggtgcgcacctgtagtcccagctactcaggaggctgaggcaggagaatcgcttgaatccatgaggtggaggttgcagtgagccgagatcgagccactgcaatccagcctggcgacagagcaagactctgtctcaaaaaaaaaaaaaaaaaaaaaaaattagacttttccaaataatggtcaaggtttttaagtatgagaaaggagtttcatggtcttggggatcagggtcctcttggcatggagtgggtggtgacgtgaaggtgagccctccagttccagctctgttattagccttcttgtgcctcttgtgtggctgtttcccagctccaacccaaagttttattaggataaagtcttggatttaggcatatggatattaaatatcagtagctgaatttggggtttgaaataattgctgcttacttctaacttccccatcccactccagattctttttgccatccctatctacattaaatagctaattgaagccaggcgcggtggctcatgcctgtaattccagcactttaggaggccaagacgaatggatcacctgaggccaggagtttgagaccagcctggccaatatggcgaaaccccacctctactaaaaatacaaaaattggctgggtgtggtggtgtgctcctgtagtcccagctacttgggaggctgagacaggagaatcacttgaacctgggaggcagaggtcgcagtgagctgagatcatgctactgcactccagcctgggcgacagagcgagactctgtctccatcaatcaatcaatcaattattattcataaaatgagaagaagctcctccgccttcccctgccaaggggatgagcaaatgtgtgttacagctcactttgaagagctgtccaggcttttgagtgaaatgcagaatttttacctcttgcttagtaatttgctcatttttcagactactttgcacagatttaatgattaaggaaacaggataggcaaaggtgccagcgtttgatattatcttaaggcctaaactgaccttacggtgatgaaatgaactttttgagtgcgtttgtctcctgaataaatctgtaacagttttcttaactgactccctctgtctctcagcatcagaaagaaatgagagaacattaagccacagaaagcaaataatggtcaaaataaagatactcttttgctggcaaacttaaaaattcacttgtggggctgagcgtgttggctcacacctgtaatccctgcagtttgggaggccgaggcaggtggatcacctgagttcaggagttccagaccaacctggccaacatgatgaaaccccttctctactaaaaataccaaaaaattacccaggcgtggtggtgggcacctgtaatcccagctactcaggaggctgaggcaggagaatcacttgaacccggaaggtgaaggttgcagtgagctgagatcacaccactgcacttcatcctgggcaacaagaacaaaactccatctaaaaaaaacagattcacttgtggaatctaatagctgtaggcaagggatatttattgaaaccaagatttaagtgtggtttatgatgtttatggagtagtttaatactacttttcttcaaaatgagtttttaatttaggaaaaagaattcagatatgttcccagagtagagatgactgaccatcatgggagtggttagggtttggggtttgtgtgggtaagattctgtttacccactacagccattgtgtggatttaaaagctttcctggatggaatttatggagtgaaatttgaaactagtgtcctgtgtactacaatatatggtcacaacaagcaatcaatttagaaagaaatggaacggagaagatacaggttaaatgatgagtattgtgcagtgcagcaagacatagagtgatcttaacagtaatgtggtatgtcaccatctgagttctgttataaagctcctaggcaatgactaaatcctagaaatcattgcctactttcagtggcagacagagtataatccattcatgatagggggttccaggtacattgatatagaagactggccaagggggaatgacaggggttacagctaacatttcctaggtaattggttctaatttccaggctccaagcaagatactgtatctcttttaccctgtttaatcctccccagcacccagtgaggtacagatggtattgtatccattttagaattgagatgactgaagcttagagagattttcccagtcatatatattcacggttcctggatacagctgtacaggttgttcactgcatgaaggtggctggctgaggtagcaggcaaaggatttgtttgctcagcagaggcagcattttctaatttgcactaaaacctgtgtaggccaactgtagccctactcataaagttggttaatgcctgaactgggagtagaggtgaggcagtgttgaagtggataggtagattctgagaagcttatactatacctactgaagtcctaatctgtaggctgtctgcaaactggtttgttttgctaccatcctatcccagcatttcctcaaagatcccacagtgacttctttattgtggatctgatggtctttggcagctatacagacattcttagagtcacagccaggattaaagtctaggatgcttgtcttcaagtcatgcatgctttctgtatgagataatatacaaaaagatggtcaagaaaagtgattttgagataaatagtggcctagaatagctagactgagattgttcaagcacagctattaatttgcttacttgctcagcactcaggctgtgctatttgcttcaagggatataaagattgctgctttctagaaaattataactcaattagggaaaccaaatcaatatatatttcataatataaaataagagaaattacagataacaataaataatagccaaaatacctttcttaactaggcatgtctatgtttctttaccttgctttagtgctcttagatgtcccattccagcctttgagttggagtggggaaggtgttccttattaaagaagcatctactacaaaaaatctaaaaccagatctgaggcccatactagacccttctattagtggtaattttaaaaaagaattttccatctaaatttaatagctttcttctgtagctaccctaccctatccctgggccaggcaccaaagtgaataataatgtgctataaaatccaaaccaaaatagtacatcttctttggcatttgaaatttcagtgttttttgcgtgtagctacaaatgtcttccattgtggcaaccactgttttgggtggttttttttttttggagacaggatctcactctgtttcccaggctggagtgaagtgatgagatcatggctcactgaagccttgccctccagggctaaagtaatccttccacctcatcctcttgaacaacttggactacaggcatgcaccaccacagtcagctagtttattatttttatttttgtaaagacagggtctctactatgttgcccaggctggtctcgaactgggctcaagaggtcctcctgtcttggcctcccaaagtgctgtgggattactggtgtgagtgaaccaccacagtcagttttggggttcttttgaataatcagaagctgaaatcagaagccaaaaatagcaaaatgggaattctgtgtgcttttgtgatatgattatatttgtgttcccagcctccaaagaaagcaaatgtaatttatatggtactcaataaactatggcagtcaagaaaaccaaaagaaaaacctttttccacttggcactgtccaatagagctttctgtgctgatgaaaatgtcttctatgtgcactattcaattcggtagctactagccacatatgcatttgatatgtggctagtgtgatcctaaggaactgaattttgagttttactttcataaatttaaatttgcatagccatgtgtagccagtggctaccatactgggtagcacaggcatgccacatgctgtttctctcttaagttggcacctttaatttctgttttaaaattcatgtctcctttacttgtccccttctatcttctctttctcactcactcccttcctttttctctttgctttttatttctccttgcttctttgctttcctgttttttctcaaccttctgtgatactactaggctgaccgtaaccccattaattataattatttattatggtctttcacctagttagacttgcctgcctgtgttctccttctgtccccaaagatgggggcattcgcggatatgcagtgtttaccaaaagctcctgatatactggttacttaataaaaacaaacaaaaaaataaatgggatttttctgacaagatggttttggtgaacctatgctgattcctgagatcacggcttctttttctaaatacacaaaaaaactgctttggtaaatcattctagaattttgcacagaatgaatcaaaatcagtggtattacataatcctaggctccatagttctgatttccagaactattgactaatagtaatcaaaacactggaatacttcactggaagacttctctgtccttacttttcagtagggggtttaatctaactcctctccagtctttcttctagaggaactctgtaattccaatctcactattttggtcttcccttctcctcctccttatctcttccccctttctgcttttccttctcctccttctcctgatataacttacttcctttctgagaatgccacttgtctctttctaactttaggtacttttgcctacttctttccttctactttaattcacatagaagtaccgtgagactatgtaaacacatctactttaagttaaacatttcctctattcagagtcatgcctttttatatttaaaaaaaaattctaggctgggcacggtggctcacttctgtaatgccagcactttgggaggccgaggcgggtggatcacctgaggttgggagtgcaacaccagcctgacaaacatggagaaacctcatctctactaaaaatacaaaattagctggacgtggtggcacatgcctgtaatcccagctacgtgggaggctgaggcaggagaagcgcttgaacccaggaggcggaggttgtggtgagccaagattgtgtcattgcattccagcctggacaacaagagcaaaactccatctcaaaaaaaaaaattctatatttgatttcaagcctcaaataacttaagtaataatgactacccatctgtaagagtccttgctttgtgatactgttacactctgttgtattgagaatgctctaagtcatatgttaccaacatgctgtggacctttagcttttcccagtttccagacagaagcagtggtcagtcacttaactgcactagacagaaaagcagtttttcccttctgaaggttaaacaggtttttacaccactggagatttttaaggtgggtatgggtattaaggtgggtattgttagtcttttccctctaagtttccccaatgtccaaagaattaacaaaattttaagggttctgatttatatggtaacacagtctgttagtcagatgtaccaagtttcttcctatctaattttttttatttttattttttttgaaatggagtcttgctcttggtcaggcaggtctcgaactcctgacctcgtgatccacccacctcagcctgccaaactgctgagattataggcgtgagccaccatgcccggccttttttattgttatttttttcagagacagtgtcttgctctgtcgcccaggctggagtgcagtggcgtcatcttggctcactgcaacctccacctcccgggttctagcgattctcctgcctcagcctcccgagtagctgggattacaggcgtgcaccaccgtgcccggctaatttttgtatttttagtagagacggggtttcatgttagccaggctggtctcgaactccggacctcaggcaatccatcctcctcatcttcccaaagtgctcaggatacaggcgcccagctcttgccatcttagagtctttgcaatttttacttttatagcctaaagtggcgctttgcatgcctagatgtatcttcagcctttatactttaatcattctgaggggggttttctgtgtccctccttcatcaccttcaccctgtttactccctccatatcattcattcctcaatacttatttccatgtttccctgtctccaccactgggatgtaaggatttcttatcacttgttctgtgcagttaatctcagtgctcgggctcacagctgggagctgataagtgctcaatgaattcaagtgtttagaagaatgttagtgcagagtagagattgggcaggcagtgttagtaggttagtaattattactagaaccaggtagagtttctacaacctgcattgaggccctgagcatgaagaatggagtgttaaaatgagcctttcaaaggcaggattggcaactgtgtgaggtgacaccactagagacatggtttggacagcgcttccgaagatggaataccagataaagatcagtgtggatggtggagtccttaactgattcagtttaagatatttgattttgatgcatttgggaatagggtgctcttgctgagaataggggttagggctcaatttacaaacctttctgttcctacattctaggttcctatgattataatgattcttgctgataatattttctcccagcattatttcttatatataatacgtgactataaaggctcgttcctgtttcaaatgcctttgcacatgcatgatttggatttttttccagccaggtctcaggggccatgtttttaaagtctgctgctctttgggctgatattgtggcttcttgaatcgcatacaaagcaggtttcttgaaatctgctcatctaccatagtttaccagttatctgtatccttgcggctctgcttgaactgaagcttaatcttgttctttgtagggcccagctatttttgcttgtcattctatcacatgccgtttaccaggaaacattcaaataatgattaatgatgccaaaactttaaacatggaggaagctggtaataccagctccgctgtggagattttcaggagcatcaatgccggctgaccggactggtatttgagtctcggataatggagtagtaggtctcaaaaagttacacttttctgggtaattgtcagcttcccagagtactgttaaattctgtccctcaaaaatgatgaaattgcaaaggaatggtcactgttacaggtattctatcttcattatctgatttaatcctcaaaaaaataattgatgtggaataagttttttcattcccattttaatgctagaaaattgaagcacaaaatctacccaccaaattgtggactgtgttttctgtatctcttatcaaagctctccagggtccctagaccctctgttgtccctctgttctagcctttcagattggcttctttcacttagttattatacataaaatgccatgttataaaatgcctcagtcaggataatggggaaagtgttcttgggagacagtgcacataaagaccttacagtgctgggtgctcaaaatgttaccatcacttttattgttagcctcttccctcttaagtttccccagtgtttaggaaattagcaaaactttaagggttctcatggtaagacagtgatacgactattatgtatatggtaagggggtgatatatctatcatggtaagtaacaggacattgaaaagacagtcatgggaataaagctaagtaaacacatgtttcattggaatagcttctattagtgacaatacctcctatattttggactaattcccagatgaaagattttgctgaaactaggcattaatgaaactaagccattcagtacagtgtgattttctttttttatcttgtgatttgagaagtatattctaaaaacccagtaattcagccaggctggacattcagttaaatatcagtggagccagctgtgtaaggacttattggctttgtcctatacatgtggtatgtctggagttttggaaacaattcatggcctccttttatcggttgagtagcattgaggcctcataaaaaatagtaacttgattctaaggtaaatttccctggaaagtatgaaatgggaaagttaggtttccatgtacccccccgctacgcatagcattatttcaattccaagaggcatttgtagtcaatttctatgatgattggaaaggagcttaaaaaattcttacaatctctttaaaaacttttgaagcagaggagaaaaaattggtaatttgtttttcaggaagaaacatacctggatttatctattgctacatgtaggttttttttttttttaactaactagaatcacagcatctttttctttttaaactaacttgaatcacaaaatcttatgtcatacttcatgtctttccttattaaggataattagtttatggaggattcagttatgatggtgatattattagagacttatctgaatgaaatcagaaaagtgtatcccgttttatgtagaagatttttacataaaatatttacacacacacatacacttcattttttagagcagttttaggtttaacagcaaaactgagcaaaaagtgcagaatcctccctacccccaccatacccctcaccctagcatccctgactataagcttcaagactgcaccagtatggtacagttgctacagttgattaactggtattggcaaaacataatcacccatcttacatagtttacattagagttaacttttggatttgtacattctgtgagctttcacaaatataaaacggcatgtactcaccattatggtatcacacaaaatagtttcattgccctaaaaatcctttgtgctctacctattcatccccctaccaaaaccctgatctttttactttttccatagtttcgccttcgcaagaatgtcatacagttggaatcatactatatatatgtagcctttcagattggcttctttcacttagttattatacatttaaggtcctccgtgtcttttaatggcttaatagctcatttcttcttagcactgagtagtacattgcctggatgttccacagtttatttttccattcacctaatcttggttgcttccaagttttgtcaattatgggaaaaagctactgtaaacatttatgcgcagatttctgtgtggagatcttaacattcacattggttactttttttaaatttcagatttatcaatattacagagctattgcaagagtcatatgagaatcgaggatctggaaattctgtatgaaagaggtgccatctgagtagggccttaaaggatgcgctgatttggacacatagattggaggaggtacatcgtactgtggctggcacagtatgtgattttctgtttgattggagttcatggtaaatgtaggaacacggtgttatgttttcgatgccttcgatgctaggctaaagaagataggcttccttagtgaggccataggaacccatggcagatttttgaggtaggaagtgataagtaatgtcactcatttatttaagcagctagtcaagctcgcttagttccaaatagctgcttgaccttgcctagttccaaataattgacttaaaattaacaagttgacatttattaaacagtactttttacagtttaattgttcaccactttagactaaattttttctacaggtggtgcaagttaattagattttcttataatgagaaagaaaagcatttcagtacagtgtcttctgttctgatattcaaggtcatttcctatataaaagtaaaattctacacagcataaaaccatcctttttgacatttagggaccataggttttaataacattgaacaaagggttaaattttttaaaaagtttttgtacactctttctttggtatgcttcatctctttcatttgagctgaacagctttaaatttcacttaaagaaatgctagataaagagaagaacattgtataagggcaactaagtgaacaggaagctgtgcttctcagaatggggagattttaaaatagaggagaaagctgtcaaagcaaaagtatagcagcctcagctttacttgggaatttattagaaatgcagattgttagactctaccccagaagtcctgtgggcggggctggcaatctgtgttgtaagcgagaaagactaatctaaaccactgatcaagggagggggatgttaagacttactgcagaaaagaggtgagaaattgtactaacagttactgttaattcaacacttactttgtaatgcacattttacagatacagcttatgtaatcttttatgtcaaccctaggaagtataatattacaatatcttactatatagatgagcagaaaagaatggtttaagaagtagcattgcaaaacttccggcatggaaggtgtctttgactctatactctgacctctttaaatcgtgctaggccatgcaggtatgttgtttgtctcccagaaggcagcggtggggctaaggcagcacccacctctctgctccctctgctgcattccccagcctccctgactgaggtaggtatttcttccttcctgcatccaggtggagcctgcctggtccagtgaaggaagcagaacaggaatggcaggaaaccagctttttctgtttctctggagttctcttaacaaaccctgtgaccctaggcctgtctcttggtatctctatgccttatttattttcagcggtaaaatgaggactgggataaatctgtaggttctttctgaattttatctggctctagcacttaattagagacagatggtcaaactaggtgacctctcaagggttcattctggttcgtgttgagaggagtttgatattggaaataatagattcttgtttatgtgcgaaatggagacagtactttctggaaatggtgtgatgcaaagtgaaatcatgtctgtgaagtccctagtagcctgcctggcatacatggaaggtgctcagtaaatggtagttcctcagtccccaagaggaaaacagccgcattcctgattctggtgttttctttccttaagttttaacaggttagtattttaattttcctctcaaggagggaataagaggtgctaggtttgtattaaaatattaagttaattaaagcttcctattaaaattttaagagagaggaagagaatggggcaacatgaccacaataaataaagcaaataggtcattatgtttccaaatggcattatcccttgactgttggtagctttcctaataataataggttgaaaaaatgttactgtaacataaataataaaagatacttatggtagtactctgctaagtactatatagacatgagatacttaataacttttaatatcatggtttggcaaaagaaacttcacaatggattaactatttatttggtgaacttaacttggggcaggcttgtgggtggaatttaagggttatttcttcttttttttttttttgctcccccggagacggagtttcactcttgttgcccaggctggactgcaatggcgtgatctcaggtcactggaacctctgcctcccgggttcaagcaattctcccacctcagcctcccgagtagctgagattacaggctcccgccaccatgcccagctaatttttcttattttagtagagatgggattttgccatgttagccaggctggtctcaaactcctgacctcaggtgatccacccacctcggcctcccaaagcgctgggattacaggcgtgagccactgtgcccagccgagttgtttcttccctaatttctctcacaaaccttccttttatatagagaaaacatttttacttttcatttgaaatattcttattgttgtttttttctgatcattactgatgtaccttctatagaaataagacacatatttggcagggcacagtggctcatgcctgtaatcccagcactttgggaggccaaggagggcggatcacgaggtcaagagatcaagaacatcctggccaaccaacgtgatgaaaccctgtctctactaaaaatacaaaaattatctggacatcgtggcacacgcctgtagtcccagctactcaggaggctgaggcaggagaatcgcttgaacccaggaggcagaggttgcagtgagccaagatcacgccactgcactccagcccaggtgacagagcgagactccgtctcaaaaaaaaaaaaaaaggaagaaataagacacatatttatcccaacgtacattgtttttcacaagttgcaatttgatatccttagctagtttcatcattctaccgtgacatttatccccattatgacatttctaaattatagtgcttctctctcatgttacgcatgtttctaagctcttggttggaatctgtaaaatagctagttgttaacatttaataaaatttagacttacctcaccttactctgttagcaaagagttacatgaactctgttgttttgaattaagaggtcagttgtggcagtaaacctgggtagaatttggaaaggaactaggctacttcctttttgattcttccttattaggtcatttgtcaagtggatacattatcttctttccctgagggcaggagaccatcttagttcccttctgttaaagagatctatgattcattacttccagtgtgaaggccaggtgcttttgcatgagttgtaaactgctaagcgagcccttttgtgccttgtttgtgtatgagagtctttctcttcagagtgtagggcaacctgtccccaaccagtcccctttcccaacatccccacccacagtgtgatggatgctggcagtcataccacattcaacatttccaagtgggacttgtttttattggatatgatcaccaaaaaaatttgaatttagatgagaaacaaatcaaggggtggttattcacattgccgatgggttttgggttttgtttttttttttttccttcaaaatggttcagcctaggggttctttaaatagcaagttgctctgctagatttaaatgggatttgatatataaaaatccatttacacatttaacaggatgttatgttggtataccagaatgatgaagagcaaaattctggagtcttaaacccaagcaagtttagaatcccagctttctcgtatcctggcttgtgtgatcatgggcgagttatttaacttctctcagcctcggttttctcactggtaaaccagagatcatagcacctcatagatagcacttctggagtgttttgaatggcagaaacagaaagtgtcgtgtaagacaacacatgcattgtgtaaggaaagtcttagatgtctaacacagcagtggcagtgttcattttcagggccattttgcctgagtttttgttaggcccttctctcttttcttctttgaatgtatttgtaaacttgaaaagaacaccgcgaaaagagctcaggatcctgctcagccacacttcacctgctctccagcttggcatgattgattgtcaggaaggcataaagaactcaaaccatgaattaccctactcggggtaatcacaatggtttggatggcatctccttaatttttgctttgacttttctttcctccgggcaagagagagtagaaggagtggcaagagtatgccttttagttactgagttctaaattcttggaatgagcatagtctgttttctcaggatcagactagaaggcgtcattctattacagaagagccaagacttgtcccaaatggatgtgggtttcagcaaagcatctttagcttaaggagcgaaggatttggactgtgttcagcatctgtgcttcgcaggccactctttatccttttagtgagtcccgcttgtctgtcctctgtcaagggctcgtgtacaccatgctgatttagtgctaactggggagattacaaatgccttgcctggcactgtcagctaaacctgaatcattgtctgtgtactgtgacccgactagtcagaggtttaccctttgctttgctgctcactcttataggcagaaaagcccagctcaccccagcttttataacggggtcagctccagaaatagcacctttaactgggaatagaagcaacacaaatccagcaagtagatagtatacaatggctgctttttggccttggaacaaacaaaagtggtttatgtttactacataccacttccaaaactgctgtctgtcatttactagagagtttatcattcctgagggccaaggtctaggttttcttcacacaaatgccctccaagtgggagctgcttggtgttggtcattgtttgcacccagatttataatttggggttaattagacataaagacttaaaggcaaatgtggtacctgatggaccatgggtagataagacacctcccaaaatggatggtgaaattctttttaagagtcatagtatggagaaagtccccttgtgaagctttgtgttggagcctagaattgtaatgtatggcactattagacttccaaaaccaatgtgaacttcagtcgtttgtatcatgatttgctttatcctatgttcctatctttcccggtagtaggtattactttgtctgtgggttacatgtctttctcctctaagatttaacctggggattattacatgcatatttatatgcccagagacaatagtaggcgctcatcaattgttgaataaatgaatgaatgaatgaccaaatgattgaacaaacaaaggagcaagtgaacaaacagagatgtgaagtggtggggggcatttctatatgattgtgtgtaaagagcaccctaacacagcatctgaacaaatcactcttggaaatctgttcaatcccaccaccttcactagctattcctgtgaaccccaaccctcccctagatacattttggtgatatattagattattttttctttgcctccctcctaccatgataaaaaggatattgaatggccaaaccagtgcattacagtaacatgaaagaaatgtttatctttcatctaccagaattcaaggaaaaaaaccacaaaactttgtcagctagatactttcctgaattgttttttaaaattgtttaaaaaattattattattgccaggcacggtggctaacacctgtaatcccagcactttgggaggctgaggcaggtggatcacctgaggtcaggagttcaagaccagcccgagtaacatggtgaaaccccatccctactgaaaatacaaaaaatttagctgggtgtggtggcaccatgcctgtaataccagctactcaggaggctgaggcaggagaattgcttgaacccgagaggcggaggttatggtgagccgagatggtgccactgcactccagtctgagcaaccagagtgaaactccatctcaaaaaaatatatatatattattatttttaatagggtcccaccctgtcacccagtctagaatgcagtggcacaattatagcctacagcagcctgaaattcttggtctcagggaatcctcccacctcagcctcttgggtagctaggactgcaggtgtatgctaccatgcacagctatttaataacagttttttttagagagggagcgttgctttgttgttcagactggtctcaaattcccggcttcatgcgattcccctgcctcagcctccttctcaggtagctggtattgtatgaattgtgttttgaataagaagaaattaaggcttataagatcagttgtgtgttagcagcgatgttgctgactgatctttgcaatctgtaggactatttggtgctacaataataagaaattaatcagtttgataattttgccatcatttttaaaaaattttgtaaaataattgaaaatcatatgtgcaatatcttataaatttttattttcaaagcacattcctatatggcaattgaagtacagtttgaacttacttttgactaccttcttaatagtgattgatcataaattataaaattttcacttaccaaattatgtttaaaaagctaaatttaacattttctttttaattttggagttgaatggtcctttattccagtctttgtttttgtttttttccaagggaagacaaatatttaagttcaaagtcatgtttaatagaggaaatgaatgaaaagtggatgtctgttatctgtttgcaacaatcatctttatgtcctagtaaaagtttaattttaaaatctaactttacagatctatacccagtaaatttttttttttttttttttcaaacagagtcttgctctgtcacccaggctggagtgcaatggcgctgtgtcggctcactgcactccgtctcccgggttcaagcgattcttctgcttcagccctcctgaatagctggtactacaggtgcatgccaccacacccagctaatttttgtatttttagtagagacagggtttcactatgttggccaggctggtcttgaactcctgacctcaggtgatctgcctacctcagcctcccaaagtgctggggttacaggcatgagccgccactcctggcccccagtaaataattttaagaatcttaaagttactcatttttacttagactttatgagattaagctattttcaaactcacttctatttgtcctcccctgagagctatttacaaatttgtatagcactctggagtgtgataatatcgaagtcaatgcacagtcaggaggcttgttaacttatgtgatgatgtcagttttgataaacatctttctcatttaggcatttaatgataatcatttcttcaagaaaaagttcttagtggggaaaaagaggcgaaaagtacagtgtgattaacttatgatgcattttggattacagccttttaaccaaaagagaatcatcattaaaacaataattcctcagaaggcttgaggcatttaacttctcttaattaaattagctcagtttactgccagtcaataaagtctggtttggaatgatgatagaaattaaatatctaagaatgcagtatacataatagttaaagaaatgcaattaaaagtaataaggaggtactacttttcacttaggaaattaataatgatttatagaagtgagactactaacttctgggaaaaatatagtgagactgtcacttttatacaccactagaaagcccttttataatgtttgtcaagattcttcaaaatactaatagcttttgatccattaattctttgtctaggacatgctgagttggtgatcagatgtgaagaaaacttcaggccaggcttggtggctcacgcctgtaatcccagcactttggtagttcaaggtgggagcatcgcttgagcaaaggagttcaagaccagtctgggcaacatagagagatcccatctctacaaataatttaagaaatgaaattagctgggagtggtggcacatgcctgtggtcccagcttacttgcaggactaaggcaggaggatcacctgagcctgggagattgaggctaaagtgagcccgtgatcacaccactgctccccagcccaggtgacagagtgagcacctgtctaaaaaaaaaaaaaacctggaaaaagaaaaacttcatacagccaaaatacccaacatcatgcaaatgcatggttgatttatgttattttctattttggaatattatgcagaggttaaataataagtgcacataatatttactacaaggcagaatatttgctatatcttaattttactaaaaagtgtaacatataataatatttgaattatgtatggaaaaagagagtgagaacaagaatgaattgaaaacagaaagaaaatgcacccagatgtttacagtcagtgattatgttctgactggcaaaacataagtagattttttttttcttttttttttttttgagagagatggagtcttgcttgtggcccaggctggagtgcagtggcgccatctcagctgactgcaagctccccatcccaggttcacaccattctcctgcctcagcctcctgagtagctgagactacaggcacctgccaccccacccggctaatttttttttttttgtatttttagtggaaacggagtttaaccgtgttagccaggatggtcttgatctcctgacttcgtgatctgcccgccttggcctcccaaagtgctgagattacaggcgtgagccactgtgcccggccataagtagatttattttctaaaataagtgcatattacacttatgataaaaattatcatcatgaaagattttatgttcaaggatttcatatagctgctttgtatttcttctggcacattacagtcatagtggcagtgacttgtagggacattgtcctgatacttcgagtgcaattgatgatatttgtttaatagtgaatgtagcttaagaaaagaaaagcaatcaaacaacaaggtgattaatgtagccacttcaactcctcagatctttggctgacatgttttcctagcaaagcagaggtacttaactaaccacagagaaatgctcacacatgtcagaaggaaatccaagtgatcacttgttttgccttgggcatctgcactttttatataagtatgactttcagtctgtgagacctttcgataagtagtgataatccagaaggattgatgtagtgattctggacttgagatttcttttcaccactaagacatttgactgtcacttgcatcttaatgcgtccatataattttctaaagcattgggggactgactaggtaaagtcactgtggccttttaagtatgtggccagctgatctcatggcctaccagggcttccaagtgattagtggggattggcaagaattgacctctttggagcctggggaggcagaagtacctcagtaatagggttcagggagaccatacatggagcatagctctctctgactttcaagtggatagagctagtaggcctctactcattgtggtgtttgtgatcagacaacccttgctttggaatcactcttcgttgagagatactgagtccaggatgtgccaagcaagattgtagatactctcacagatgaattcacccattcatttattgagcacttgattttttaggagtacaacttcatcattaatttcctagctgtgtcatacaggatcagttaggttagattctccctttgtaattaatcctaattgctgggactttcatgtttctaataaatgtctattcccataatcctgtcctacattagctttcttcatgttgttctgtgagatctatagtaagcagatgacactgcttattatagattagctacttcctgtgtaataaatcaattattcctctcaatagggacaatcttgaattaaaatcacatttttttcttagagaattctctgtcaaattctatcaaaggccatggttttttttgtttttttttttttcctgtccagagacaccttattaatgacttgattttatccttatttcaaattctaattcatgaatatcagggtataaaatattaaatatgctggttcagctaccagcttttcaagcatcattggggaacatcctgttatataataggaaaacatttggtatggcttttgggatgtagatcatttttataattattatagggagtaaaaaatgcagaataaaaaataatttaaatataattagaagtgagagcaggtcagtatgaccaagaatataaatcataaatctctctatttttgtgttcctttatttcatgcagagaaataccaaacctttgtttctaaaagggcaccaggtctttcagaaagctgtggttctcagcagcaattttagttaggtttcgtttcatgttttctggtattctgggcctcccaatagccatttgtgcctaaaagagagagaggatgaggagatttgggttgcttgtactgccagcctggtggcactctggggatattagatgtgttctgaggatatatgtgtttatttaaatttaaacagaaagtatttcaatggatgctgggcgcagtggcctgtagtcccagcactttgggaggctgagttgggtagatgacctgaggtcaagagtttgagaccaacctggccaacatggcaaaaccccgtctcttaaaaaaaaaaaaaaaaaaaaattagccaggtgtggtggtgcatgcctgtaattccagctgctctggaggctgaggcaggagaatcgcttgaacccgggaggcggagtttgcagtgagcagagattgcgccactgcacttcagcctgggcgataagcaagactgtgtctcaaaagaggctaggcgcagtggcttacgcctataatcccagcactttgggaggctgaggagggtggatcatgaggtcaagagatcgagaccatccatggctaacacggtgaaaccccgtctctactaaaaatacaaaaaattagccgagcatggttgtggtggcacacacctgtagtcccagctactcgggaggctgaggcaggagaatcgcttgaacctgggaggtggaggttgcggtgagccgcgatcaagatcatgccactgcgctctagcccgggcgacacagggagactccatctgaaaaaaaaaaaaaaaagaaagggagagagggagggagggaggatttcaatgggacagaaattcaccaggtacattagaaagccttaacacttgagaatgtgaagtcttaaaaaaaatttttttaatagtttgggttacttaaaatgaaatactgtactgaagcagatagaaggactcttaggacctttctgtgtttcttctgtacctaatggcatataataaattcactgttttgtttaaatgatcagttgacttgagctttctgtcatctgctcagaaacactactttaggaatcttattccatttgggaattctgactagaagctctcccagggtcatcatatgaatgagtaacttacttcgcagctctcctcttcctcagtagctgcttctctgtagggctggagggaaagagagtcttccatgcagtctcatcagccaagaggaaggagatgctggtacctggtctgcatcccaacagacagcacaccctcatgccttccccttgaatgtacctttttggctcttcctcattcctggggaaatgtaatagttcttgattgttcacagtgttgactgctccctacaatgtgaggttccccctctcctctcccacagatggcacagagaaagtgcttatcatcgacacagtagtggggaaaaaaatggattctcattttagcaggtgacttgagggtggttggttgtcagtgtgctttttttcatattggcttgttgctacagggtctgatgctggcagattacaactttgtagctagtcattttcgatttatttgaacctatttctccagtctactgagctttcactggctagcatcaattcagacacattgcaattcttcagaatctctatccccatcagatggttcgatctatgagaaatttagctagaggcgtttagacaaaaaagaaatattgtggctggggaagcatttaagttagaggaggcagccagggctgttttattacttagtcctgtgtcacctgtgatgacccatgagagtggagaatattgatcgcttgtcactcaaggcattcagcagattgcattgacaaagcttggcaggtctctaatagcagggttactggccttgctgcggcccaagggaaaactctgcaggccctattacttggcggcctttaactcttatagaattgggagagaacactgacaaaagcgaggacatgattttacggttacaaatgatttttcttgcttgctttcttctcaccctttttaatttttcttttcttcttttcctgtctatcttaccttccctccgtgatccctgccagcccctcctttcttattatagctgatcatggcagtattgtttttttctgggtaaaaatcagagtggattagagaaagcttagcaggcctagcatgaggcctgagttattctctccttttaggacagcttgtgcctgaccacattgtttggaatgtgcctgtggatatatatacagtacttgaacttgatgtgtaggccattcacagctgttgtcctctagtagaataagaactgccacttcatgacagatgggtttctctcgttttccatttcctggtagccaggcttggttcaagcctttgaccttacatagtcccgaggttcagctgaaagtaatgtgctgacatcagagagataatggcactagtgcaaaacaggaatgattctaaaaaaacagtagagaggattctatctttcctagacactgcctgatttatgcacaggttcgaatcaccaccattaatgacattttcattcctaacataggttggcctcctgttggacactgttgtgtaatgagcgtttctgcatggctgtcatttgctttatgaagcattctttttatttctattttctgtgtacctttcatttaaaaaaatatcgtgtttgttatctccattgtctctttgaggatgagaaagacaaatatcattacccccatttcaaagaagagtaagttctaatcacaagtgatttaaatgttagagtttcattcaatattttcactaaaatttctagtcctctagtaaatcagatataagcaaagatcatatgtctatttcagcctctaggtaggctggccagctttcttgctttctccctctcccctcccctcccctcccttcccctcccctctcctcccctcccttcccctcccctctcctcccctcctttctcctctccttttttttttctgtagtcttgtactggtcaccccttcacttcctcttcctttgcaatgctttaggctgcccaaaaggttctagccagatgaacagaaacagaggagaggagagcttcttaagaggctggtaggccaggtgcaatggctcatgcctgtaatcccagcactttgggaagccgaggtgggcagatcacctgaggtcaggagttcgagaccagcctgaccaacatggtgaaaccccgtctctactaaaaatacaggaattagctgggcatgatggcgcacacctgtaatcccagctactcggggggctgtggcaggagaattacttgaacccaggaggtggaggctgcagtgagctgagatcacaccactgcactccagcctgggtgacaaagtgagacctcatctcaaaaaaaaaaaaaaaaaaatgggatgggtcagccttgagtagtggacatggcctttgcatttatattccaacattttgccacagatgagttatgtattattggcagattacttaatctctctgagcctttgtttctccatttatcgaatggaaggtaatattgtttaccaaaaaaagtgaattatgtggtatatggattatttctcaataaaaaatatgagttgtgtaaagtttctaacatagaaatgccctcctttgcttccttcctccttatacaactaagggcccacaaaggcagaatgagaattaccatctaggccaatactggggaaatatgtgctactactggagacagaaatgtggaagtattgcaaacgaatgtggacctattaatattctatagcactttgagccactttgaattaaaatacttatctgtgaaaggttttataatttatatgacctgaaataatttacacctaattagattttgtcaactgaataattctgtctcatgttgcttccacagaataatttaagcaactgcattttattctcaaaatagctgtaaatgtcaaattaattttgttgacatgatcaacatgtagaagagctacttggcagaattgtttgtcaactgaatgtattatgcatctttacaaaatatgtagattgattatggtttagctgacttttgcagtttgttggtctcctggaaagaagtaacgggtggtggttacaaaaaccgttatggcatttctgttcatctggctagaaacttttcgatatctgtaagttttccttcacttttcattatatagaccatgtctttcccttgggtgttatcttttttgtctgggtgagactggatcccacgtaactgctttggtgtttgttatactcctcattaattttatggggctcttagttgacactggccacataaaaatgattgttgagtctcactctttttattttggaccatttctttcatgtgggagcctctttatccctctccttaaaaaccctgtttaaggattagtgtccttgcagtttagttgtagcttactcaagttatcccatttattccaaaatcccttttccactccattataccctgtctagtccggtcttctagctactaagattgaagtcctgtcatcttcaggtttggttgaatccagtgcttcccaaccctgtctcatcatggcacatgtagaaaatgatattattgtacagcacacggaagtaaatcaagaccttttgctgtggaggtacctggctcagaggccatgacctgccttaagtaggagggaatacatgcatactatcctgtatgttttggtgtaaccaatccccaaatttgaaccaatcttggcaggtattagaaatttgcttatttggtgacatctggaatttacctcctcttttgagctcagtatttcatgtactttaaggtcattactgagctttctaccaaatcattcccatttgtgtctagtcattagataattcagatttctaccttggatgccttgaagtgatgacaccttacccttgctcatctctctcccaagggaataaacctgtattttgctttcagcttctgcttagaggagctggctccatccagaacaattcccctcccactggacatcaaaagattgcatttccattggcaacaagtctcaacatagctcagaaactactgttgactacttgtctcccctataacaatattggatccattggagagtgaatcagtgtctccctcaagttcagcccactcatttagatttttcattttagactccgtgggaaggatgtcccagtgcagagttggcctctgtacccctgattatgtttcagctttctctaatttctctgctaacctgctgttgatgcccctaaaggcactcaatattgagtgtgctttataaatacatgaactacatgtattttatgaaaacataaactacaaatacgttaaaatatactgtagattcattactaaaaggcattatctattcagtatccttaatgtacaaataataaaagagatatgaaaccctgtgtctagagctaaaaatataccttgacagtacaaatacacatggctaaaaggcattatctttttagtatcttcaatgtacaaataatcaaaaggtctgaatacttctgattttcataatggagaaggggaattgtagaaactgtagaccaattagcttgatgtcagctcagaaaagattctagaaaatattattaatgaatgctttctgagagtttaataaaagaagtagtcatcactgggaacctgtggaggttcacttaaaatgttatgccatctatattccttcttctgcagcagagattgccaaactttttctatacatagccagatagtaaatattttaggttttttgggccatacagtctctggtacagctactcaactctgccactgtagcaggaaagcagccacataggcagtatgtaaacagatggatgtggatgtgttctaataaaataacttaatttataaaaacaggcagcaggctgatttggccaattggccatcgtttaccaacccctgctttagaagaatatcttagataatgtgtacctgatatattctattcttctttctgatgggaaatactttctctttttttggcgtaaagacgttttattttctttgctaataaagagttggcataaaaaaaagcatcgcattaaaatcttcataaaggacatggaaaaggctcaagttaataatagtttacagtaagttctcacttaatgttgtcagtcatttcttggacactgctaccttaagcaaaatgatatataatgaaactaatctttttttctcaccaacattgtagtgaaaagatgttgaacaaaaagacgttatccaaggatgtaaatcatttaatttaaagttgcagtttccaagaacctattgactgtgctaagtgaggacttactgtagttaggtagaattataacaggtttaataattatgaaacatgaagagtggtctgtggttgcaggccacaggctgtgtgctcttgattcaattatgtcaatatttttattagtgacttgactgaggttggaattgacttgtggatcaaatgtgtggatagcctgatgaagagagagatcacttacactttgggtgataggagtaagatcccaaaaggccttaggatagcagctgaaatctttcaggcttaaatgttgaaaacagataaatgggaaaccctgtgtctggagctaagaatgtatcttgacagtacaaatacaaattgtgaaaacatagttgaatagcagcctgtttgaacaaagctaagagagtatttcaattagagtgcttgcagagaaagttatccaggtggttgaagggactcagaatcatgtcctattagaaatggttgaaagaagtgtagatatatagcctagggggatatatgataactgtcttcaattatttaaagggctgtcatgtagaagaggaattagacttattctggggggtcctggaggacacaggggagagcagtgggtagaagatacaggtagattcaatatgtaaataggaactttctaacaatttgagctgtccattagagggatgggcattatttagagggtttaagtcactggcaatattgtagacatctgttgctgaccttgtggggatgttgtgagagaatattagctttgactcattattggatgggatggttcttatggtcactaacaattctgagagtgcgtaaaaggtaggccgagggataatgtgctgcgccctacgtcccagtagttggcaaagtccaaacccagatgttttgagtctcctgccttgtttatatggttgaaatgctgactttacacagtgttccatatatgtatctgtacctgtcatctttatgtgattggctagagaccctgtcacgttcacttttgtaatctcacaaagcttgacaaatgccctgtacataggaggagcaaagtgtttgttgacctaaagtgaattacagaacagctgagacacatctaaatattgttcttttactgatcctggttccataatgaaaacatttggaagttgaccagaaattatacctggggattcctagtagaatggtgatgtagatggaacggctctctgcctttgtttctgtctgtggtacaccacacacaaatgccaacacttcaccaagagtggaagccatcaggctgcactctctgaccaggattgttttaccccttctggatggcaatacatcgctccctttctttttcactgcctcctgtgcatacctccgtgctaaattaaactccagaccctgggatgtctggaatatattttccagtcttctgaattctaccaccctgaagtagtcatttgctgtcatcataattctggaagatttaatattcagattgacagtggatatgccggtctcattctttgatgtttggtacatgggcaagtggtcaggtatcctggcctatttatcaccatattctccatggcctgtactcagggtcaggcatatggtaggtagtcagtgaatgtttgtttttgttagtaggactctggtttagtccttacagtagtcccttttatccatgttggtatgttccaagacacccagtggatacctgaaactgtggacagtaccaaaccctttccatactgtttttttttaatatgataaccaagacagctactaagtgactaacaggcaggtagcatatacaccatgctggacaaagagatgattctcatcctgggtggacagatcaggacaacgtgagaatttcatcttgcaactcaaaatactgcctaatttaaaatgtattgacgaattgtttatttctggagttttccatgtaatatttttggactgtggttgctcatgggtgactgaaaccacagataaggggtactactgtacttctgtttcatcctaatgaagtaaagtttctttgttcatcaaggcagtattttctttctcttttgtacctaccatgctctacctacctcatgtcttcattttctgtgccactttcttgctgtgttttattaggataatgttttaatagaataaaagaagggcaaaggtatagtaattgaatgtccttcactatcaatccccccaacccctgaagggagaaaggaaggagaatgtgggggagaggggaaggaagaaaggaaatggtggagaaagtagagaatgagagaagcatcctgtttcatactgagaagactttggtattgaagaattttgactttgttagtgccatataacttgtgtgttgctttgtttaaattctcgtctgctctcatgttttcattgcattctgtggatagcagctaagagagctttcagacacatctgtattagaagtaaaataactgttaatgtcaagactatatctttgcttttttctccctcagcttcttttctcgattggtagaaaacatggaataatggtgccagggttagctttgcctggagaagagttctgtttgccagccctgctgcagattgataaccatcaagggaaggatagcccagtcataagtgaccttgtggactgcgtatctttatgtaccccttacacactagtaggaagaacccaaataccatctgccaatgacagtgaggcaggaacctcacttttgtgacaaaaggattgtactttgctctgctggaactggctcgttaacaattcataagaaccaattaagttttcaagaattttgtgagctggttttttagtaaaacctttattagaagttaagttatattaaaaaaaataattagatgggtatggtggcaggctcctgtaatcccaactgcttgggaggctgagacaggagaattacttaaacccaggagatggaggttacagtgagctgagatggcaccactgcactccagtctgggcaacagacagaaactccatctcaaaaaataaaaaaaagttatgtaaacttacctgtgcttttaatataatttacttaattgtaatcagtattcaaaattcatcacttccttattagctgctacattttactaatatccatgaccttgaggttatttacatctagtatatggtagaaatactacaaaatgatgtgttattgagcctcttttcctaactctgtattcaatgacatcactttagtagccatggtggaagtatttacaccacagaaattggtaaacaggatgtcttattctgttttgttctgctgtaacagaacaccgcaaactgagtaatttataagcaatagaagtttatttggcagatggttctggagactgggaagttcaagatcaaggggccatatctggtgaggaccttcttgctgtatcacagtgtggcagaagacatcacatggtgagagaacatgctcaagagagtttgaagctcttttataatcagcattaatccattcatgagggtagagccctcatgacctaaacatttcccattatgttccatctcccaacactgttgcacttggggttaagtttgcaacacatgcttttggggggacacattcaaaccatagcactgtacaaatccaaatttggtcatttgttttgttgattgtctacacttaaaagaatgatggaggaaatgttattaatacagattaaatttaaaagtatgttgtatttgcatccattacattgtggatagcaaaacaattaagagaatatcttcttgtattttgaaactgtttccaactcaacaaagaagttattcatgtcctcgaggaaggaaactgtttatatcattcatgtcttaggtgttccactttaattttactggttcaaaaacatcaaccaggttttacaaaactacactcattcttcaggtacaaccataggttggctgtagatataagaattgcacatattttaacagaagcattctgtgaatgttaattttcccatttggttggaattcacagtaaagtttagcatgtactttgttattatttgtaaattgcttgctatacatgatttatatcagtaaattttataataaataggtgtacatctatacatacatacttcttttcccaaggagctggttgttaagtattaccaacacactactgtttacaatccaaatgagaatgtagctctgtgtcttaaggtagtgatgatcttgtgtaaatggtgagatttttgccttcatcatagcaaaaggctcaaatgcactataggaaggaaacctttctgattatggaatatgaagtcaggattttaaatgccaccaactgtcgaacacttaaaggacaaagtgtttgaaatcttaaagcctgcctactctatttaaaagaacattagagggcgttggaaagaggtgataaatatcattaggacctcagcaaggctttggaacccaacacattgaaagataattgagtgaagaggatctctggacacaaagcaggcaatttagttatccaaagcatttatgtcaagcagctaatgcgtgaggatttatttatttgtgtttttctctcagagcttaatccatgaggagtacagagtggtggtagggtggaggctagcctttattttgcattgctctgagaagtgttgcgataatgggagaaatttggtgtcctagaaacgttattattataaatgaaaaatcttgaaatacgaggaaagtgaattttttaaaactgggattagaaactcagaacaaaatgagctggacgcgctggtcatgcctgtaatcccagcactttgggagtccaggaagggcggattacttgaggtcaggagtttgagaccagcctagccaacatggcgaaaccccgtctctataaaaaaaaaaaaaaaaaaaaaaaatcagctggatatggtggtgggtgcctgtaatcccagctgctcaggaggctgagtcaggagaatcgcttgaacccgggagatggaggttgtagtgagccaagatcatgccagtatactccagtctgggcaacagagcaagactccatctcaaaaaagaaagaaggaaaaaaaagaaactgagaacaaaatggtcttttgcctctttctacttaaataagatggctcatgcaaaactatatttttgtgtgagatttttggttaacaagaagttgtatttccgttcatcagttagactcagtgtggaggaatgttttgtttaacctactttaactagaaacaaaatgtatttgcagaagtttataggtagaattataaggtgatctaataaacttgaaggttactttcagcatatggaaatcagaattttgttagtggaatggcaaatgtgaagaatgaaaaatccagttgatgccagttaacattaacttttaggaaagaaaaaacggtagatttttctgtgaagagtgtgtgtgtgtgtgtgtgtgtgtgtgtgtgcgcgcgcctgtgtgtgtgtttaaattagatttttctgtgaagagtgtgtgtgcctgtgtgtgtgtttaaaatttagctcatctggttctgtgttgtgtgttttctctgtgtgtgtttgaaaggggacatattatgaacgttatggttccctacctctaagatccattcctaaaatagttttactaatccgaagaatgactaagaatgtaactatggaaataaaatgacttttcaatcctgtgttgactacgtgcctaaaatgttgatttgctaaaacctggtacttccaaattaaatttcatggtatatggatgatttattgtaatctcttgtgaggaaattcatcttaaaaactttttcgaaatcatcctaagtttgggagaggagagcatttctaattcaaagcaggagtcaggctaagatcacatgtctccctagaggaaagaggggaggttttacttgtgcatatgttttttaaatatttatagatacagctggacttttagtactttagttctggttttaatgatggaattcccaaaggactaaaattgttccaaatgtctgaaccgtgtctgaagttcaagaacagtatatggttggtctgaagactttaatcctagttggaaactttgaatgagaaacctggccttttagtcttgtatttcttgaactttctgttaacagaatatctcctcgccttttatgtagcccttaactagctgcagactgacttggtcttctctagtaaagcattttctatgtaaggtcaccagtaaatttctttttgtcaacagagtaccttcttgcctcctattcagccgttaactgttttgtactgacttggtcttctctactaaagcattttgtatataaggtcaccagtaaatttctaagtcataaaattaagtgatttttcttatttcccatctatccagtcaacagtcattttattcagtacctactgtgtgacttggtgctagggattcattagtaaacaaagcaggaatattcttttacaatgtggagctttcaattttctgaccctgttgaccttccttcttcaaatttcataaactcgcttacttctggttagtgaaatcaatgatgattattttaataatgattcctcccctcatgattgtgctcagggccctctctttccctgatgattgtttttcttgatactttgtggatgattttatatggctaagacttccaggttgtcatctgcccatacacagaggaagtcctgagggaacccacgagtttcctctcactgcttccgtgctgtgtaggcaccttctcctgttagaaaaccatcaataggagcttccatgatcatggtggaggcggcaaatagtgtgtattttgcagggataaggcagcgaggacaagttgcctctatctactttagccagaagattagtactaatttctaaaactttcaaatttgtctttaaaaaattgcacccatatagcatatacatttagttgtatgcacacacacactaaaataaacttctttgtatacagtgatttggtataatcttaggacgattgtattttccttttgtttgtaacaactttattgagatataattggcatataatgaactgatcatatttaaactatacaacttgataagttttgacatgcatacacctatagaaccaacacaatcaaggtaatgaacaggctaggtgtgatggcttacacctgtaatcccagcattttggaaggctgaggaagcagaatcacttgagcccagaagttcaagatgagcctgggcaacactggaaaactctctcactacaaaaaaattaaaaattagctgggtatgttggttcgtatctgtagtcccagctactcaggaggctgaggtgggaggattgcttgagcccaagaggtcaagactgcagtaagccttgatcatgacactgtattttagcttgggtgatagagcgagattccatctcaaagaaaaaaaaatgaatatatccatcacccccaaaagtttcctcctttctctttgtaattcctttctcccccacctcccttccatctccaccccagcttattccctggcaaaaaaacaaaacaaacaaacaaaaaaaacaaaaaacaaaaacaaattaactgttttttgtcactataaagttgtatacatttttctagaattgcatataaatggcattacatagcacatactgtttgtccttttttttggaggagggggggttctggcttctttcactcatattatgcttatccacattgtgctgtatataatgtttcacaatattactcaatttatggatataccatagtgtgtgtttatacattggactgttttcagtttttgttattatgtataatgcagctatgaacatttatgtaagagtacaatgtacattctcttggacaaataagagtggaatggctggataatgtactaggtatatgctaaatgttctaagaaactgccaaacaataatcaaagtggttgtaccattttatatgctcaccagcagtgtgtaagagtcccattgtttccatatccttgccaatacttgttatgggcagtcttttccattttgccatcctaataggtatatagtgctatctcattgtggtcttgaattgcatttccctaatgaataatcatgttgagcaccttttcatgtgtgatttttcatctgtatatcttttttggtgaattctgtttatatcttttgccaatttttaaaaattacatttttttcttgagtgtcgagttctttattctgtatacaagacctttatcggatatatggtatacaaatatttgcttccagtgtgttgtttgtctttttattctcttaacagcgtcttacaagataagaggtttcaaggttgttttttaatttttatttaatttttagagataggatcttgctctgtcacccaggctggagtgcagtggcatggttatagctcaccgtaaccttgaactcctgggcttcagccatcatcccaccttggcctcctgactacctaggattacaggcacgaactaccctacccagctaattttttaaaaacttttttgtagagatagggtttcaccgtgttgccgtggctgttctcgaacttctgagctcaatcaatcctcctgcctcagtctcccaaagcaaaggtttcaaattgtggtgaatataatctatcaacttctttttatgggtcatccttttggtgtcatatctaagaaattatttacataccaaggatacagggttttcccttatgccttgctctggaagggttacagttttaacttttacatttatgtctgtgatccattttgagttaatttttgtatatgaaatgagacatatagtgaattcatttatttttgcatacttttttttttttttgagatggagtctcgctctgttgcgcaggctggagtgcagtggcacgatcttggctcactgcaacctccgcctctgtgttcaagcaattatccctgcctcagcctcctgagtagctggaattacaggtgcccgccaccacacccagctaatttttgtattttttagtagagacagggtttcaccatgttggccaggctgatcttgaactcctgacctcaggtgatccacctgcctcgccctcccaaagagctgggattacaggcatgagccaacatgcctagcctatttttacatacttctatacagttgttccagcatcatttcttaaaatgactgtcctttcttcagtgaattacctttgcatccttgtcaaaaatcagttgtttatttacatgtaggcctaattttcttcctttttactaatcaatttgtctgtcttgaggttgccaacccaaggcccatgggccaagaaaagctcacagcctgtctttgtatcatctgttagataagaatgcttttttctatttcttaagggttgtataaaaaaaaaaattaaaggaaatgtgacagaaaacatgtgtactgcaaagcctaaaatatttactgtctgaatcttctcagaaaaagaaaatttctaaacttgacctatcttgacaccaataccacgtcttgattattgtagttttataatctattaaaatcaggtaatgttagtcttccaacttactttttccttttcaaagttgttttggctattcttggccctttgcatttgtgtatgaattttagaatcactttgtaaatgtaaatttcttcaaaaagacctgctgggatttttattcatattgtattgaatctatagaccaatttcaaaaaattgatatcttagcagtattgagtcttttaactcataaacaaggtgtgtttctttatttctttagattttctttaacttctctcagaaaagttctgcagtggccgggcacaatggctcacgcctgtaatcctagcactttgggaggctgaggcaggtggatcacctgaggtcaggagttcaagaccagcctggccaacatgctgaaacccagcctctactaaaatacaaaaattagctggctataatggcgggtgcctgtaatcccagctacttgggaggctgagacgggagaattgcttgaacctgggaaacgatggttgcagtgagctgagatcgcgccactggactccagcctgggcagctgagtgagactccatctcaaaaaaaaaaaaaaaaaaaagttttgtagttttcaggttacaaatatttcacaacctttgtcagatttatcattatgtatttttgaagctgttgtaaatggcattgttttataaattttaatttctaattattccttgctgcaatgtaaatgtacagttaacttttgtatatttatcatatattctgtaatattggtaaactcacttattagtgttaatggctctttttaaaatttatttgtattgtatatatagttgataatgtcaaagaagagtaaatataattttccttttttttttttaatctggatgctttcatttcttttcttatattattgcactggctgcaatctctagtataatgttgaatggaagtggtgagagtgtacatgcgttttcattttaactcatattatggggaagcatttggtgatcttccattatttatgatgttagctgtaggttttctgcacatacctttatcagtttaaagaagtccctttctatttcacatttgctgaaagttttaatcaggaatggatgttggttttgtatcaaatgctatttattaatccattgaaatactcatttttttattttttagtttaatatggcaaatttaactgattttcaaattttttttataaaaacatgatatatttttataaaagtatattaaaaattattcgtatatatatagttgaacttaattagcctgtcattttctttttcttttttttttttttgagacagagtctcactcttgtagcccagtctggagtgcaatggcgtgatctcggctcactgcaacctccacctcccaggttcaaacaattctcctgccttagcctcctgagtagctgggattacaggtgcccaccaccacgcctggctaattttttgtgtttttagtagagatggggttttaccatgttagccaggatgctctcgatctcctgatcttgtgatctacccacctcggcctcccaaagtgctgggcttacaggtgtgagtccctgcgcacagcctattctgtcattttctttcattgtctttggtttctatatcaggataattctgacattatagaatatattgggaagtattcccttctctccaattttctgaagcagtttgtatagaatttatattattgtttccttaaatgtttggtaggatttatcagcgaagcccttgggcctggagttttctttataggaaattttaaactccaaattcaatttgtttaattgacaaagggcttttcaggttttctattttttcttaagtaacatttggtagtttgtatcttttctgagatttattatttctttaatattttgaaaatctgtgctgttgtaacctttcttattcttgatagtgacaattcatgtcttttttttttttttccaggtcagtgtggctagaggtctgtaagttttatcggtcttctcaaagaactaacttttggtttcattcatatttttgtttgtttgtttttgagatggagtcttgctctgtcgcccaggctggagtgcagtggcgtgatctcagatcactgcaagttccacctcctgggttcacaccattctcctgcctcagcctcccaagtagctgggactccaggcacccaccaccacgcctggctaaatttgtttttgtatttttagtagagatggggtttcaccatgttagccaggatcgtctcgatttcctgacctcgtgatcttcccgcctcagcctcccaaagtgctgggattacaggcatgagccaccgtgcctggccacaggtttcattcatattctttattgcctttcagttttctattttatttggtttctactcttatcgttgttatttcctgtattctacttacttttgctctctttttttttttttttagtttcttatgatggaagctgaaggcattgatctgagacccaccttgtttgtttgtttgtttgtttgttttgttttgttttgttttaaagacaaagtcttgctcttgtcccccaggctggcgtgcaatggcgcgatctcggctgactgcaacctccgcctcccaggttcaagcgattctcctgcctcagcctcccaagtagctgagattacaggcgcttaccaccatgcccagctaattttttgtatttttagtagagacggggtttcacaatgttggccaggtgtgagccaccgcgcctgtccgagacccatcttgctttctaatacagtttaatgctatttctccttcaagtattatactattttaggttcatcccacacattttgatatgctgtgttctcatttttatccatatcaaaatactttctaatttttctttaagtttactgagacttgctttgtgactcagactatggtctgtctttgtaaatattccatgtgtgcttgaaaacaatgtatattctgctgtcgttgggctgaatgttctataaatgtcaattatgcataatagtattttttaagtcttatatccttctcgattgtctatttatttgttctttcaattattaagaaaggggcattgaagtctccagctaatatttgttctatcaattattaacaatggagcattgaaatctccaactatagttatagattttttttatttctcctttgagttctatcagtttttgcttcacttattttgaagcttttttattaggacatttaagattgttgtattcttttcatgaattgactactttattattataaaatattctttgttctgaaatatattttgtctgctattgatatagctattgcagctcacttttgatagtgtcttttttcattcctttgcatttaacctatttgtgtccttatatttagagtccattttttttaagagaacttgttttggggtatttaggtctttataattctttttattgtgtctgacaatcttttgcctttttaattgtggatatttagactgtttatatactttcttgatatggttatgtttatatattttatcttattttttcctatgttcctctgtattctttacttacttttccacattttgtgccttttaaaaatcagttgagtatttttaaaggccgggagcagtgtctcacgcctgtaatcccagcactttgggaggccgaggcaggtggatcacttgaggtcaggagttcaaggccaccctgtccaacatggcgaaaccccgtctactaaaaatacaaaaattagctggatgtggtggtaggcgcctgtagtcccagctgcttgggaggctgaggcaggtgaattgcttgagcccaggaggtggaggttgcagtgagccaggatcgtgccattgcactccaagctgggaaagacagagagactgtttcaaaacaaataaataaataaataaataaataaataaataaatttaaaaataataataaaataaaatagaaatcaattatttttaatgattccattttatctcctttcttggcttattagctgtaggtctttgttttttggttttaattgttggttttggggttataccatatcttcaacttataccttcaagtgatatactacccattcatgtataccataagaatcttacaagtgtatacttttgtttcaactctcttgttgtcacacaattctacttttatatatgttctaaagtctatactatattgttattgatatttaattagttaattgttctttgaagaaacttacataatataaattttttttttttcttgagacgaagtcttgctctgtcacccaggctggagtgcagtggcacaatctcagctcactgcaatcttcacctcctgggttcaagcgatacttctgcttcagcctcccgactggctgggactacaggtgcgcaccaccatgcccagctaaattttgtatttttagtagagatgggatttcaccatattggccaggctgctagctgtgctacaatttctggtgctcttcattcttctttacatagatgcatttctatgtaataccatttgccctcttcctaaaggttatcctttaagatttctgtctttttttttttttttgaggcggagtctcggtcacccagactggagtgtagtggcatgatctcagctcactgccgccttcgcctcttgggttcaagcaattcttctgcctcagcctcctgagcagctgggactacagatgtgcaccaccatgcccggctaatttttgtatttttagtagagatggggtttcaccatgttggccaggctggtctggaactcctgacctcaagtaatctgcccacctctgcctcccaaagtgctggggattacaggcatgaactgccacacctggcctaacgtttcttgaagtacaggcctactggtgattaattctttcagcttttgtatatctgaaaacatcttcattttactttaatttttaaaagacatgttagttgtgcatagaactagcggttgatactttcttttcccttctcccagtactgtaaaaatgtttcacagtctttgcaattgcattttttaagtaagaaaattaggtatcattctaatctttaacctctgtatataacctgtcatttttcccctggatgctcttaagaatttcttttatcactagtattgagcaatttttttatgatctgcattggtgtacttttctttatgtttcttgtgcttagggttctttgagcctttagatttgtggttttatagctttcatcaaatttagaaaatgttttatcctcataggactattctgattctcctcagctagtaatttctttacctaatggacccatttacaaaatacactccaggtcctataaattttttttaataggtcatataaaagttactaccaggaatctgatgtttatagtgacagaatcaagtctcgacacttggaaaagaacattgtctgttttctcttgtaaactctgggattgctgaggttttcaaggaagccaggtactaaaccactctgctgttacagtcactgttcttctttttggctttcctacctcctgagattcttggcagatgaaggataagtgcttcataagcctgaaatggtggcccttctgggtcctgtggtaatcatctgagcacgtacttttcatttctgagttagtacggagattcctgaagttctgtctacatctttccaatgttggatttatacccaacatgtaggaatataaaatttagtgctaagatgataggtgttcactttgttccaatcctgtaatttgctgtggtgacatacaagggaaagagaagagccttaaatatttgcctgctagctatcaagtaggggggattatactcttaatctcatttacattttcttgtagctatagcaaagtttgacaggcaatcgtcatatcccccaaattatattagtgtgccagttacaggtctgtgactcctaagtattatttttaatacttaggagtattttaatactcctaagattatatttaaaaaacataatctcaccagtacatttttattccttcctttttaataaaccagctttgacagatgaaaaggaatctgtgctgtagctcagatttctcatgttaggcatattttagccgtaaacttaattatcgcaggaattttcaaatgactccaactttttctgcacttggtatcagaggataccaagtcctgtttttgagctgataaaatcctccttctgaaagcatttgtttattatattactgcttcacatgagctgagctctatcctgaccccgtgttaagtgtctgtggtagatttcattacatccatatactggaagtcctgccaatacactggcagcaaaatcctagtggaaaataaatggcaataaaaaagagaaatgatagcctgtgtgagtggtgaggagcacagctttattgagactggacaaccccagagtagtgacttggcatgcagacatgagcttaagagagtgtgagtgaaagctgatattggaataacgactctgtggcacagacatgggaataatttaattaattgcactgaaatttctttgatgaatagttatgtggtgataagcatgaggtcgaacagcagaatgagtctcagctttttaatgggccagcacagctgcggttttggatgccttcccactttatttctgcctgcagctctccaccgctttattcatccacatctcagctaggagcaccactcgcggggccccctctccatgtcggcagagctgaggggcaagtacatttggccatgggaagcaggctggtgactgctttgaaatgaaaaccagatcaaacgaaaattgtaggatggtgtccttatgatgcctgcacctcccctcctccccaaatctctaggatgcttttacagagtctttgctgctacgttgtataaagattttaataaaaatttcttgtccctggagaaacaggcatgtctttgttgtcagagagctagagggaaatgagcaatgcagcccagctggagtaccagcattaatcccatgattcgtagcccgtattttcagacagatcaattacttatggctgtaaccaatctctcatcgttttcttgctgtgcagggctccatttccagactcggcagctgacataaccttccaacttgataggacttcagctgcaaatctcttcaggtctgctgcctccattcatcgtggttatacaaatgagttgttaaataaaaatcaaaagtaaaaaattatgggtggtaatctctgcctggctcagtaatacccatgggcctaggcaacattttcagttggatttttaaaaaacaagatggatgattcacttgtctgacttccttcacttttatggacaggctttgcatgagagaaaagccatctctagagggaagaaattatccacagtggatacatttcttatcaatttataagttgaaagattaacttagaagtggagagaaaggagattatgaggagacacgaaggacatgtacaggtgagctgtgtctaatgcatttcacactgagtgagtcaccccttttcagctgctaggctgcctgggcttaaggccaggagattctgtatcaaaaagaaatgacccttgctaacacagaggtgtcatggaacatgtaagctgtttatagagtatgtcactgtgtgaatgtagaacttgtgtgaaggatctaaacccaataacctttgaagaatttacccagaatttatttagtgttttcaagttataactactccttgtgtgtattgaacccttcacagctatgtcaggccagctaagccttcctggaagaggtacttaggggccagataaagcaaattggagaatctctttgtgatttgactcactttagatgcacagatgctcatctgttaggaaagcatgtattgactctctttgtgcccttttctttcattgtcactccatcatttccatctcttcaatgaatagtcctttgaggactttcccattttccctataataaccaactacgaaaatttgcaggaagcaaaaaggaaaatgtggacatctagagaatataaatggttttatgtttaatctagggggaattatgtatgtatttatatatatttgtgtatgcgccctgcatgcttgttgcattttgctgtatgctttagaaacctttgcctacatggaacccattagtagtgtcctgggacaggtattcatgaactctgttaacaattaaggaagtaagttcctgctgctacaggctgacagccacagtttccccttgggcttgtatggctttggattgattctaaagaagcaaaggaaacatacagaacatacttgtttgatttgaaagttaaaaaccggtctgtgtctgttttcttctcccttttcactctagcccttcttaggcatcccaatgcgagtagtaaaacataaatcatgcaatatcataagatactgctacagctcttgccctgccctggatttgtttttttgtgcatctgaattttattatgatccataaagcagtatggaaatggctcattggtagggttgcatggcagtaccccatcctcagaccctgccaacaattgaaagtctgagaggtaataagaaataaaagggagatgagatttatagttcgtgagttcaagttgcttttttttctccgtggaatgttgcctgtcttattaggagttctttagtgaaacaaaatgcagtggtagcttagagaaattatggatactttccaggggtgtgggagaagcttaggagtctgtaagccttctcccctggttgcagttaggaagccagttgacagtataataggcttttggaagtgggtgcaatggtttgtgtgttctgtttgatgttgcaaataccaagcccgcagggagatctgcaaagaggatattctgttcttaaagaaaggaaaagattaacctgaaacgtgaactgaaaaactcctgaattctagaggacttaggtgcagccaaggaaggatctcatttacttacgtggaaacatcatttggcaagctgcctgctccagacaagcagatattttttaatgatttcaattaatgaaaagcaatcactaataaacttgagaggattggatcacatattaagagtgtgtgtgtgtgtgtgcgtgcgtgcgctcacgtgtgcgtgtgcagtatttgcatggttaaggtttggaaatacgtgcattctcatacacgcatagaagtcttacaactacgtgtactacttggagcctgcctgatggtccttttcttcacattcagaatcatgcttctgacccattaggagaggctaactcttgttattttggagacattttcaggagtggtaatgaatgggcattaaggcacttctgttattcatgaatatgtacattcacttaacatatttattgagtacctactgtatgccaggtattatgctaggtgctgaggttatagcagtaaaaaaataaaaagatacatagtctctgctctactttagtttataggttattggagagacagacaagaacaaataataatacagttatacacttaaaatttttatattgcctttgtattcaataaaaatttgttgagggcttctagatgctgtagactctgtgatagagtctaaagaaaagcgtcttgcctaatttctgttaaaatcagtggtttgccatttacgaggaataaactggccatgtttagttatggtattgaagaaagggtttgatccatacaggaactatacttcacctctatgtattaatttagtacacagttttaagaacagcaaggtagcattcaagaagagcattctgttatatacttgtatataaaccctattgtatctactaaggatattgttataacttcctcttcactggtatctcctcaactctgagttcaagacctacccttctctccagctgtgggaaatgggatttgtcaacctctctgagacaaagtttcacatcagcaaaatgggaatagttgtactagttcacacggggttgtaaagagtgaatggaattgtgtatttgaaaacacttcattaaagggatggatatttcaagtacactgatttaatttttacaaataatatgaatgtattagatcatcacatgtaccctgaaactatgcatatcaattatgcatgaataaaaaaattgttgaaaaagccggtcgcagtggctcacgtctgtaatcccagcactttgggaggctgaggtgggtggagcgcctaaggtcaggagttggagaccagcctcgccaacatagtgaaaccccatctctactaaaaatacaaaaaattagctgggcatggtggcgggcgcctgtaatcccagctaactagggaggctgaggtaggagaatcgcttgaacctgggaagtggagtttgtggtgagccgagatcgcgccattgcactccagcctgggcaacaagagtgaaactccatcttaaaaaaaaaaaaaaaaagaaaaaaaaagaaaaagaaaatactgtgtaaaggactatactcatttgagtttgtataattttcattattattacatcagatttacagagagaataaaatttattgaagccaactgtgttgtcttaaacctccgaaaattcagaaggaggataatgctgagttcaagtacgatatagaaatcatcatatcttttctctagcaagtgttccaagagaattagaatataatgccaaaattaaggtagaaattaagttattctagaagtgggatagccagtgtcagcatgcatgcatgatccttgaaaagtgatattgggcagcatttacaccaagctttgctatcttacgttctctttttgcttcttctacctggtgttatttgtgccttccctaaagggctgaaattgaaaagaattagtacgaatgcattttcaatgacaccttggccaagaggttcatgcatttcagctttggacaaggtgctatggttcaaatactcatgaatatgatataagaacagtcattatttaaatgatgaacctttatatgagattacactgggtgttactaatctgcaagttgtattttctgtggggaaaaatcagtatgaatgaatcaagaactcagtgtgcatcctgcagtgcatgttgtatttgcatgaacggagatgtaatctcttcaccttttgaatcattttgtttaaaggccctatatagatcattctgctcttactggtgggtgacattttcttaaggttctctccctagatagactaatttgaaaaaaatgcatccctcttgatgtctgcatgtgcatgtgtgtatgcatatgtataaaatatagaggtgatcacaaagcatactgggccacttagcacttccactaattccacattatcagagattgtttggagagcatatttcattctccctactttgtcacttatttctaacactgagtatatctgtacagttcttaatagtaaatggcataatatcttattctctgtattctatacattgtcaaccccattcctagctgataatcagtagtcaaaaatgggtgaataatttgaatggtacttgtctttaattgtgattcatgtctgaatggcttgctggtaactaggagctaaatttaatgttaatccaaggtcacactctagtccacatactggaagctcagcctcttgacatgcatgcttcatgcaattatcaggctgctcccttgtaggataaagtgcggcagtctagaaagcatggcactcaaatgggaagaactgttggtgagtctgtacagaacagatgaggttgcagatatttgaaagcatttgctaatggaaactctgggtaaggcagcatcttaaataatacgtagaatcagcatgctgtctccaaaacacatttgcagcatttattagctgggtgtgagctaaaggtaagctcccattaaaagaaaaaaaaatcttcgtaatgattagcaggggcccagtataatttaaggtattctttggagtttataaatatggcctcataaaaagcctgaatataagagaactgtgactttaagtcattagaagcccagtggtttgataaaataacaggaaacagacaatttattatgagcagtctcagtagctctggattatctataaaacttttacggccttccccaagtggcaagaagccataaaacttgcctgaatgagggacttgttaatttacttgttaaagcaaattaaaaatttataagtgcttttaggtaaatgagatcttctctcattgctgcccttgcggggctgggagtcctaggaggggagagtggatatgcttagacaccactgcagaacaataaaagctattaaatttttccagtttattacagcagagccatgcagctgttgccatggctagctgtggggtaccggtggttgacagcctggagtctcactcaaagggggaaaaaataaaaagccaaggaaagggatgattttttacttttataattctccaattgttgatgttgtagaccatgtctttttatttttccttgaccttgtaaatccagaagttttaaacttttttcttttctttttttttttttgagacagagttttgctcttgttgcccaggctggagtgcaatgtcacaatctcggctcactgcaacctccgcctcttgggttcaagcaattctcctgcctcagcctcccgagtagctgggattacaagcgtgcgccatcacgcccagctaattttttatttttagtagagatggggtttctccatgttggtcaggctggtctcaaactcccaacctcaggtgatccgcccacctcgacctcccaaagtgctgggattataggcgtgagccactgtgcctggccttatactgttttttcttatccccagaagtgtttctgtttattttgtcatacattgttggtccttgaaaattcctgcccgtcatgattccttttagtcatttagtccatggacaaaggccaggtcttaggctgtttttgttaacctcaacatttcttgaaaaaaacctctttctctctcttttcctttcccatatctagccacaaaactaggagaaggaagaaagggaatctggtacatgttcttgtgtatttaactccaaaaactgttagaatcaatattttttgtggaagccaaagtttataggtaaaggcagattttcttgcactctcccttggatgaaatgtcagcgtaggttaaaattcttggatcttagcatcttccttaacttagggctgttctctacgtgttgaatttcttctgtaataataggtttctgaatggtgactttggctggtgggggtcatttttttggctttaagccctgtgactcaggggattttttttttttttggctcccttaaatacaattcacaatgagcagttttctccctgccctagtgacagtaaggtttctgggacataggaaatagcttattcttccactcagatcagaagttttgattgagctctgtggcatttttaaggcagaaaaagacacgttatgcctcaactacctaccctatttaatgttaaattaaaatgatggttatttttaaagtgtgtttacatttaaaaattcctccagaaaagtcaagttctgcaaacattttcttgtagtatttccagtcactgcacaagaaaggtacattttattagttttaagaacagaaatagtagaaagacataattggtacaagtgtttgttcttctacagtatttactcttcagtttttacatatatatccatacctctgatttgtagtttgtttggaattatgtttagaaaagcatattgttggcaagtaaagcatcacaaaattaagggtagagaacagcagtaaaaaaaaaatgacaaatatgtatttttagactgtattccagttttaggaggtatcagcttttagagattccttaacgttaaaatttgtttcagtaagtaactcttgttgtggtcgctgtcttcagtattccagaaataatgctgtatctcttattcaacttcatgaacctctttactggcttccatattaatgtcatttgcatttagagtgtgtcatcttcatttagaatctcagcaaaaattctggtttataaccatctttgcacaaattatctctgtgctttaggacacttttctgggcctggtcttgcattttttatgaatacaactttaagagtggaacttaaatatgtccccttttattggattatccccatagacctgaccacaaagtctgtggaagtagaaagctataacggttgtaccatttttttttttttaaatactttaagttctagagtacatgtgcacaacatgcaagtttgttacataggtatacctgtgtcatgttggtttgttgcacccatcacctcatcatttacattaggtatttctcctaacgctatccctcccccagccccccaccccacaataggccctggtgtgtgatgttcccctccctgtgtccatgcgttctcattggttgtaccattcttttgttcaagagtatcaagttgaatttcatgtactgaaaaagtagatagatttaaaaacatttaaatttaggtagcaaatgacattgggccaaaggtccattgctaaggagacccaggaaagaatttattacaataggaatatgaggtgtggaacccaaggacagctgtcatgaaggataggtaatcacagtaaagtagtgatgcttcatatacatttgtttttgtttttgtttttttgagacagagtctccttctatcccccaggctggagtgcagtggcatgatctcggctcactgcaacctccgcctcctgggttcaagcgattctcctgcctctgcctcccgagtagctgggactataggcgcacaccaccacacctggctaatttttgtatttttagtagagacggggtttcaccatgttggccaggctggtctcgaactcctgacgccaggtgatctgccagcctcggcctcccaaagtgctgggattacaggcgtgagccacttcgcctggcatatatttggttttaagagttcaagctagaattttagagtagatgttcactcattagtaatattgatatatgttgtataatgattgcttaattgctaattttcttatgctaattgatgtttttctataaaaccaaattcttcagctctttacatttattgaatgctatctggcttatgaattttcataagaactgccaaaaaaaaaaagaaaaaaaggggcaggtcccctccttccttctaaaaagagtggttcatgcctgtaatcccagcattttgggaggctgaggtgggcagatcacttgagatcaggagttaaagaccagcctgaacaaaacagtgaaacaccgtctttactaaaaatacaaaaattagccgggcatggtggtgcatgcttgtaatcccagctacttgggaggctgaggcacaagaattgcttgaacctgggaggcagaggttgcagtgagctgaggttgtgctactgcactccagcctgggtgacagagtgagacctatctcaaaaaacaaaaaacaaaaattaaagaaataaaaataaaaaggtagagagtatgtctataatgactttttaatgtgtcagggagtttttaataggaaaaaaaaatcattccactaaaaatatgtcctctgtctcccaactagaatttcttccccatgtcactgccagccattgctgtgacaatatagtctcttactcttttatcaaatattctccatattattgctgtaagtactggacagatatcataagtaaaatatgtccacctggttgctaagaaaaatcccacatttattttatatattttgtaatagctttacgtattcgttcaaccgtaacattttggtttaaagacttcattaagctttcattgtccaatagcaaagaagtatgaagtagataccccttactttgcagtgtttactttttttttttttttttttttgagacagagtctcgcactttcgcccaggctggagtgcagtggcgtgatctcggctcaccgcaagctctggctcccgggttcacaccattctcctgcctcagcctcccgagtagctgggactacaggcgcctgccaccacgcccagctaattttttgtatttttagtagagacggggtttcaccgtgttagccaggatattcttgatctcctgacctcgtgatctgcttgcctcagcctcccaaagagctgggattacaggtgtgagccaccacacccagcctgcagtgtttactttttatttattttttattttttggtgatttccttttaccattagctaccagctgtcaggtattttcatatagttttggcattatagtttctttggttagatcacacacacacacacacacgtacgtatatgtattgtaggtataagcactggaatttagcagagctttttaaataaatgggctagtctacatgcctttctattcttttccttctaataatcttatactaataagattatagttacaagtcagacagcaatttcatggcacctgtagattttgagtaagaaataaaactaacttcagttgattatagttttttttccatcattaatttaatccaaatttctttaagatggctaaggtaaatgaaattatattctcaattgcttgtctggtctaatatgaccaaaaaaaactgttagagactgctttaattatttgaagtgtttgaagaaatttgagagagtattgtagaatttattcttatattaatgcaattaatatattaagattcaaccacatcaaattatgtattagtcatccagaattgagagacatggttgtaaaaatatcattaaggtgtgtggtatttacttaaaatttattcctttagagataccagaataattatttatatctgtttgctaattgcttactctaaatgtttggtcagtaaatcagaaaaatattagagctatccaaaggaacaaacacactgcaatgtgttataacatgcctccattgcccataaattattaatacaatgttactctggaggggtagcataatgttttggaaataatgcacactccagaataaaaaggcctgaatgtgaattctaggcccatctcttcctttctgtttaatcccaggttaacctgagcctccacttacttaactctaaattagtaataattatatctgcctcacaggttctgagaggaacctgtagctcagtacagcaaatagtaggcactacctcaagggcagtaaatagaatattcagtcagggatccacgttctaggctcagcttaccacccaatccctgggtgtcttggtggagttgttcatctctctatattttagtttctttgtaaaggggatacattaaaatttacttttctcactttaaatatttacgtgaggattaaatcatttatgtacaattattagaaaattgtataacagtaggctgggtgcagtggctcacgcctgtaatcccagaactttgggaggctgaggtgggtagatcacgaggtcaggagttctagaccagcctggccaacatggtgaaacccctatctctactaaagatacaaaaaaaaattagccgggcatggtggcgtgcacctgtaagccaagctagttgggaggctgaggcaggagaatcgcttgaacctgggaggtggaggttgcagtgagccaagatcatgccattgcactccagcctgggcaacagagtgagactccatctcaaaaaaaaaaaataaatgaaaataaaaataaaatagtgtaagagtagacaaatgtgtacaacattattatcacaaaaatgaaagcagcttaatggtaattgatcatcctgtttttaagctactagatcagagaatgtgatgtgcccacttgtcctttactgtccttatgatagttgtctttccatgttggcacaatggtagaagctgctgtccaggctattttgggcaatttgagtcaaaaattagcagttattcaatatatacaccttttttttttttttaccagcagctcaatgagggtttctattatatatcaaggggctaatgtggcataagttgttttttcttttttttttgggaaaaatcctaactagaaaattgggtctgttcttaaattgtaaatgtgtgtacatcaaagccattgtaaggataaatttaagtctgatagtgtacatgtgtacatagtttcagtacacattggcgaaatatcctgctgattgctgattgaaaacagttgttaattctctacttcactaaattcagagtggaaaactttccttaatgaagaacagattgaggagatccaagaccttactgtgtgggaattaatggcagatgcatatactggtagttaaaatgtttcattagatgttaatgtcttgctgtgtttttaattgttcaggaattagcctctagaatattaaaaccatctgtttgttatgatgaaacagaatgcttaaatagttattaatttgtgtttcttgtctttttttgagggataatctgtaaaactttgatctgtttggagtttagggaatttggaatgtggaagtgaaaaataattttaaagcacaccagtgtcctgaatagctgaagtatgtctttttttttctccttacccactgcatatattttgtgttctttctctcttttttcttaaaggagggtgagttgactttttttattccatggtgtgatgagaatctattaaacagagctggtttaatagttgatttaaactttaagattatcttcgtgcatgtggattattttacattcaacatcaaaacagaatttagacatttagaggaatgaaggacagcttacgtttttaactctaaggatgtacttttactactatattccactagctctgcataactgttgatggctatacagactactgctggcatgggttctagtcttgactctgctgtttcatgccttgtgatctggcacagattagtctttctcagctttagtttatttgtctgtaaattgggaagtacaatttaatttatagcattttttttaatgcttagaagtaatacatgaagactgcatatttgtcttttgttttgtttttatagagatggggtcttactctgtcacccaggctggagtgcagtggccaatcatagctcactgcagcctcgaactcctgggctcgggcaatcctcgtgcctcagtctcctgagtaactgggactacaggcatatgccacaatgcctggcagtatttaaattttttttagtgattgagtcttgctatgtttcccacgctgatcttgaacttgtccctcaagtgatcttccagcttcagcgtcccaaagtgctgagattacaggcataagcacatacccggacccacatttgttttatgtagtgggcatattaattgctgtctttcttgattacatggagccagtgagatactttggatgccactgagaatatacattagcactgtagctgcaagagccagaaataaactcttcatttactggcctctcccctgtgttgatagccaaacagtggtgcatttaagttcttacccccaaaatgaaaatctcagctaatgtcatcttggctctagttaattgccaggtgtgtagagctacagtggagagaacaaatctacctgtgcatgagatcccaatttatgtctctgggggccctagtatttgtctttttgtctgtgagtttggctaagaaaaattttcagcttctcataaatttatattaatcagtaaaatcatgccaagaattagaagttttatatagttgaatctttctgcatcttggagaaattccatgtgtttagaccaaaaatgaatgatagttgggaaattcatggttctctttacgtttcctttacctcacttgcccctcaatcaaaactgaattatctcatttcctaagtctgttttgcgcaggttaaaaatgggagggtctttatacatcttctggagctgagtgaaagtcacttgctacatgaaagtgaagtttgttgtaaaccttgagtctctaattcaggttcctcagaggccaggctcataatgtgaataagtgacacaggacaatgtagggtgtggggtcgtccttgtcatggtgctccattgaccctttataactatagcattagtgcagttagtgctcttgtttccaggggcacacccccttgctaactggactatgctggcactggacgtcatatgaatgattcattcagtattaaaagaagaatcaggccaggtgtggtggtgcaagcctgtaatcccagcattttgggaggcccaggtggaaggatcatttgagcccaggaattcgagaccagccttggtaacgtggcaaaatcttgtctctcaaaaaaatgtagaaattagccgggcatggtagtatacacttgtagtcccagctactggggagactgaggtgggaggatcactttagcccaggagttcaaggctgcagtggggtgtgatcgtaccactgcactccaggctgagcaataaagtaagaccctgtcttataccatctccatagaaagcaccatcttaaaaatttacccaggatttcttttataaaggttgttgttgttatttttattattaagaaatcagtgattgttagtacacattttaaaagctttctgtcattgcaggatatgtcagaaaaaagtttttgctgtagtgatctttaacaacataagaaaaggagtggttttttttttatacttgttaggtaaaataaataggatttttaaatgcttcatattatccaaattacataaaagtggcaatctcgtcagtaagtatgtataatactaagagagctattaacttttcttggtagtggtttttgaccttttgctgaacaagtactttaaaaattttcaaatgccaggatgaagacttcttaaactaactgtaattatgcaactttttctttataatccgatacctcactatctaaaatatctgaaattacatatgatcactgtttcaagaacaaaatcagtgatagcacattttgaagactatggaatctaaaggctgattttgtatgctcactagcacacatgatacttttcatgttaccattcagcttttgagctctccttactggccaatcccagatgagaagctttttttttttttttttttttttctttgagactgagtctagctctttcgccaggctggagttcagtagcgtgatctcggttcactgcaacctccgtctcccaggttcaggcaattctcctgcctcagcctcccgagtagctgggattacaggcacgccccaccatgcccagctaatttttgtatttttagtagagatggggtttcaccttattggccaggatggtctcaatctcctgacctcgtgatccgcccatctcggcctcccaaagtgctgggattacaggcgtgagccaccatgcctggcctcacaattaagtttataacagggatatgttatgaacttaatatgcttggctattaatatttggatatgttctcaaatattctagaacataggccagatgtggtggctcatgcctgtaatcccagcactttgggaggccgaggcaggcagatcacgaggtcaggagatagagaccatcctggccaacaaggtgaaaccccgtctctactaaaaatacaaaaattcgctgggcatggtgggcgtgcctgtaatcccagctaccccggaggctgaggcaggagaatggcgtgaacccagtaggcggagcttgcagtgagctgagattatgccactgcactccagcctgggcgacagagcgagactctgtctcaaaaaaaaaaaaaaagtttaactctagtgtgtggtataccagttcagttctgtcctcatggaagtaatatggcctttcatgggatagtcactaatgataagtttagtgacatatagtttattaagatagctatggacagtgtaggggcttagtcttgatgagattttaatttttggctgcacttgaaatgaactgggatcaaaatagtggcaagttggatagagatttgctgtcagaattaatattcaagaagttctgatagcttgcaaccaaagtattttatattataacaaattctagatgctcataattattcaattaaaatggataaacagtaaatatatgggttagagaagaacaatgctttttccagaaacaaagttttaaaaacttgttaatatggcaattttaaaacatacatgaaagtaaagataacggtataatgaacccaacatcatctaacttcaacaattaagacatggctaatcttacttcctctatatccctacacttcccccttcccaataggtattgctccccctatcccctggattattttataaaataaaactcagactcaagttatctcacccattaatgttttactgtgtatctgtaaaggactctgcttttttactgtaactacaacaaaatgtaaataataattccaggccgggagctgtggctcatgcctgtaatcacagcactttgggaggctgaggtgggtggatcacttgaggtcaggagttccagaccagcctggccaacatggcaaaaaaaaaaaaaaaaaaaaaaaaaaaaaaatagccgaggatggtactcaggaggctgaggcatgaaaatcacttgaacctgcctcggcttccgaaagtgctgggattgtgagccaccatgcccggcccaaattgttccatttttggtcagtgggaaccccttcagtttggctcccaagcccctttgtcagggtcttgctaggatgacaaggtgttccagactcatcttacatatttcctttctcagaccttcagttggacacttttagttttttcgtgttagaatgggaaaaacaaaagatagaagacattttctatttgagagtggtggctattttaatgaatgacaggccatttaaaaagttattgaaacatgttttttaaaaacagaaaatcataaaaagtaagttttgtgtgtttattttttatattcatccttgaaaaccaaataatattgtctctaaattactttttaataatcaaaatcttattttaagaaagctgaaaactgtactaaagcaatcaaatattccttcaacacattattttttacattgtgtatgtgtattgtgtgtgaatttctgagcctatttgaaaacagatttatcatttagtccatggttatactcaaggaatgccaaatgcaatctgttcattctggcctttctctttaattcttgtacatcttttgtacatttctattcttgtacatctttttttctctattgtttagactttttggtcaaaaatttaaaaattttctgattggcagttggttgaaagagataatttattatctaaagatctggaatcaatagacaggaatgtctggcttactacgataaagggttatggagaccaacgttttatcatgcagataaagcctccaggtatcaggcttcagagagaataaattgtaaatgtttctcatcagacttagagagtctgctctattagtaattctgaaagggaggaggttattatggggcatgtccggtccctgtcccccatcatggcttgaatccgtccctcaggttagccttagaatgcccttgctgagaggaagagtccattcagatggtgagggggccttagaattacattttacagcataattaaacctaggaatagtatccaagttgtagatagatatgtgagttatacatcaaacactgccttttacacttccattttcttgccttcacattattaaattatgaagaaatagtatcgtaatatcctcttggcctaatcatagagagtagagttaacaattctcttgataagcagtagaacattgttaagttctgctgtctggattgagcgtgtctatagtaatgatgtcaaagtcggtcagttcgctcttgattttcttaactgcttcttatttatgtttgagactatatagttagattgatcttggcttattttcctttttaaattttattagggctgggcgcagtggctcacgccagtaatcccaacactttgggaggccgatgtggctggataatctgagatcaggagtttgagaccagcctggccaacatggtgaaaccctgtctttactaaaaatacagaaatcagccaggcgtggtggtgggcacctgtaatctcagctactcgggaggccaaggcaggagaatcgcttgaacccgggaggcagaggttgcagtgagccgagatcgcgccattggactccagcttgggcaccaagagtgaaactccatctcaaaaaataaataaataaacaaataaataaataaattattaacttagtttttctactgctatgaagtccactgaacccctttaaataatgtgcatgtttggcagctggaagcacttcagtcgtttttattttctaagctaatagcacaattttaagtcatttcctgtctaataatgcctaaagtgtttattgggatcatcattaacacaggtaaataactttccaaagtccaaacatatccaaaaatcctgtttcttactttgcattaatgaaacttgtctaattgcattagagtgactttacgatacatgaatttcaagggaatacctaactttctttctttctttttttttttttttttttttttttgagagtctcgctctgtcgccccagtcgcccaggctggagcgcagtggcgcgatctcagctcactgcaagctccgcctcccgggttcaggccattctcctgcctcagccccacctcgagtagctgggactacaggtgcccaccaccatgcccagcaattttttttttttgtatttttagtagagacggggtttcaccgtgttagccaggatggtcttgatctcctgacctcatgatccgcccgcctcggcctcccaaagtactgggattataggcatgagccaccgcgcccagccctaactttcttatttaaaatccaccatggtaagcagagttccaagatgaccctaaaagtacttgtcccttatttactcccatgttttcttatatagcacagttgactttatgaaaggaagttcttctgtaagcctgacctaatcaagtgaactattaacaggatgctgactttctggagtaagaaattaaactgatgggatctttcctttctataataaactgcttttttagaatataagttagataccataaaattcactcattgtaagggtacaagctaattaattttagtaaacttaaagagttatgcaatcatcaccatacaacattgccatcacctcagaaatttcccttgtgaccatttgcaaattggtagaatcttaaattcttgtgaaaaatcctgttagaacttggtgggctatactttaatatattattaaatttaatttgctgtgtttcttcagatttttgcagctttttaaattaggaaggtcatcctgtagtttcattttttgttttgtcaccagattttggcacaagttagctttccatattttttcatgttctggaacaaatgttgttaaatcttcttaaaaactttagactgcttaattatggttttgaaagtatcactgtagaatgtttacttctgtatttagaaatttatctgttttttattttgcttgccatctcttttatacttaaatgtgttagaggtgtatctcatatctttatgggttccccccagattatactatagtttactaactgtacaatattttaatttctaatgatgttcttctcatttttagaattctcttcctctgattttacctatacttgcctttttgtcttatttcttttttgttcatttcaatctttataattaggccatttatttctattctttcacatttaatagaaaatacattaagtccatgagttaacttctagcaaagattttacaacataagttttaaaatttatatatttataattttcattttcttaatttttaaatgttgtatgtgtgattttgtcttttacccagttgttaattgtagacagactttaaaaaaattctttaggtgatatggatattcaacataaaatactgttattactttttatcatagagaagtctgttcatataatttttacattttgaaatttattcttatattctttgttaccctggtacattttcagttggtggtaatgtcccatagatcctctaggtgtgtctctttaagttacccaatttactgtatattaactaagtcaaacttcattttttaacctctgcgtcctttttcattgttttgttttcttgttccttgattagtagaatgctaaaggctcccaccttcttttgctttcttttattatttagaatattttttactttgtatagttttgtataatggtttataacttagaagggtataaaaggtaaagactgtacctttcatcactataaaatgactttgacaggtgatttttttacctatttatttctaaccttttgtctttttccctctctctttttttaaatttaggagttctttgtaactaataaataatgggacatcaatctgttgattgatctgtatatctatccatctctctgtcttacccaacacaaaccagatttttatttttaaatgggagcttaatgtatttatattattatcagaacactttgttttacactttgctttcttgccacttttcttattttctttccctttctctattatgatttgagtcattttatatttggtaattatttggaaggcaaatatttttaacgtttaaattttactaatggttagcttcaagattatcaaattgttatttaaaacactttctctagctgttgtagatgataacaaaagaacctttgattctgtgatcccagaaaaattccttgccctgcccttgtgtccaaaatttgttaaaataattttagcttttattcacaacttggcactgtacacttaaagatacaatatagttttcttttttaaaaaatagtttttctatccaactttataattttacttattgtagttattttgtgtttgcttatttcgattcatcagcatttttcattaagttttttagtttggttcatgtacctgtcatctgaaatacgctttaaaacttaaagaataaaatagtacaaattctatccaatccatgatactttcccaatttggggacaattttatcttgaaaaataaaaatagtatttttcaagattaaatacttggctgctttgatggtagtgtagtctatgggtatattaaaattttcttgaaaaaggagaatcttttgagcttactgaaacattccccaaattttgcatagagttcatttacattcctacagaaaaactcagcagtctgaaaaaggatatgtgctactttgaggaatcaaatttgtggaaggagattccatttggacagtcttctacattgcctgcataattcgcatcattcctctcaaattccaggcatagatatattctccacataatttatccttctgtaaattttgtttgatggattaatgacacctactgggcaagtagcatctttttgaaactctccatatccaagctgaaaagaatgggatagcccagctcacaaatgccaagcagatgtgcacagaattgctataccttcatgcagtctagggtgatgggacttcgttacatgttcattagcagtgacataactgtggatcgttattttcctaattagccattaataacagttaacactgtaatgggatcacaatttcagaatttggagcatatattgttgacagtgaaatctaatgaaaaacaaactagcttcttatattttataaaagatgttaatctcattgatagaattactgccactcatgccagataccagctggctttcattttgcatattttgttctcattctggtgcccaaactattgaatatataatactctaatgggaagaagcttctcacaacagagagtgggttatagtaatttttaaataaacaaggtcctgaagtatgtaaaggctgatggtaagaaatcttactgtatcagttataggaaaagctttcttgtaatagctgccatggatgctcatacaaatcaatgcaagcagatcaatttttcttagctctttaaatgtttaagccagcatctggcctttgtgatgtttcttggttgtaggtaatagctgggaatttcaggtgaaggattacaacttctgagttagttatgctaccccaaacgatccattggatgtggctaaaatgctagtttgaaactatattcagctgggcgtggtgactcacacctgtaatcccagcactttgggaggccgaggtgggcagatcacctgaggttgggggtttgaaaccaacctgaccaacatggagaaaccccatctgtactaaaaatacaaaatcagctgggcgtggtggcacatgcctgtcatgcctgtaatcccagctactcaggaggctgaggcaggagaatcgcttgaaccggggaggcggaggttgcggtgagcagagatggcaccattgcactccagcctgggcaacaagagcaaaactccgtctcagaaaaaaaaaaaagaaagaaaatatattcatgggattggaaatgaatacttctttgcctgaaatcttgtggtttagctttagtacttactgtagtcagttcatttctttgaaatattgagctgtctgacagcttaaaatcctaagtttcctttaaacttgagcctggctttggaggagaagggggtggtgtaggggtggattttatgtaaggctctctgaagagaattcactgaagtgttttttgctggcagggcactgggaaggctagcaggctgcttcctctcagtccttcttgggttttgcccttagcctagatcaacatttagtcagataatttacgtcaggtccactgaagtctgtttttgtgccttggtaaagtcatcattttccttccgtgaagaagcatggaaaaggcccaggtgcaatgtccaggttttgttaagccagttggatattaggaaaagccttgacactctttatagtcttagttcccagctggatatgtatctctcatctaagttgggaactgagtttttattattagttttttaaatagagacggggtcttgttatgttttctgggctggtctcgaactcctgggctcaggtgatccccccgcttcagcctcccacagtgctgggattataggcatgagccactgtgctcagccataaaggtgttgatcaaatatcacctaacaagattattttctttgtgaacgtactatagtcaggtaccacatacaaatttagaacatattatgtggagagtactaatatgctgcagaatcattacttcatgtcaaatgtaaacatctaactgtgcactgagaattagttttttcatccataccttggaggtagttctacctgcccttacttaactcagaatcagtgggataagagtttgatactgcttatgaattggagggcccatgccacatgcaaactttattatcagtataactatgttataacaataggctttttgagcttgaaaaatgtgtcataatttaaaaaataaataatagaaagaaagagctcttcaaagaccataacagaggaggtaagatctgagctttaaaaaacatcttgacatcagaagcacagagaaggtaagggtgaacattccagagggaatatggtgtgaaaaaaatgcagagcaggaatggacaagaaacgttcagggaatggagacaaggcgatgttcattgtagattaaatctctcctttattatcaatataaaagtgaaaaatcgaagagaatgacaatattctgagcttttattccatagtaataacaaaagcctcatacaacttgcatctgaattaacttagaatgaggagctttagcgttgactgaggagaaaactaagtacttaagagctcaggaaggatacaaagtaaaattagcatcaattttctgggctcctttgcagaaggcttcccggagaaagggattttagaagaaagtgataaaggtgaatttctggaaaggatgatagcaaaaaagaatgccttgttttggagacttggggaaagctgactctgtgaatggtataaccaaaagtgaggtctgaactgtagtctttaaagactacaaggaatgttgattcagcctcactctattcatcttggtttcatcttcccctaggcaccatagccacttgaaatcctgcaggcaaaaatttcctacttattgcctcttctattctttgaagtttcctcctgtctagaaaaatggagcttatgtttagtttgagattttccacgttttcattcatgcacccagctctaatgtttcttattgtctccccaaaggaactctgtttcaaatgaaactgctgatcatttcccagcatgttgctttttctgtctttgctttctgcttttctcctcaatggagtatctttcactgtcctctcagccatatgagtttaatctacttttaaaatccaaggcttcagaaatcacttctctgaacctccctggctactttttggtttcattgaacatgtatttccttgtggtgttgtatttgcttatcttttactgcctttttcttgttatattggaaacattgtcaaggggctgtgacttgtaaccagtactacattgcttggtgtttctgaaaatgtgtttggtgatgatattgtagactagtactccatatatttatgacttagtcttatgtagactgatggttttcaattttatgtatttgttcatttttaatggaaaaccagagcttgttaaatgtgtggaaaccactagaacgtaaacttcatgagatgacttttgttttttttttttgtttttttttgtttttttttgtttttttttttggtgtagtaccatatcttcagcacttagttctagcccatatgtggcacttaatacattatttgttgaataagtgctgatttaatttacttaatctgtaggtcttcattggttcttttaaatatgtagtaagaaacctccaggatgttatctcaattaacaagatcattaggtgccatcccagtgtttgaaggataacatcacagcatctcatcattttttcctaggagaagaaaactttattttattttgctctgatttgtttctttttttgagacaagacagaagaaaaaaggtaagaaatcatagttggtgtaatctcactttagtttattcaacatttttggtcttttcattattgaaaaaaaattgcagtggaacagaagaaaaaatttgatggaaagactgctttctaatttatggaccttgaggtttggctttttaggtgtttatttaaggcttgcccactctgttctctacattgacatttcatggtgaatattttgcttattctaccctctgtattttttctatggcagcttgcctggcagtattcagaaactgagaagaatattaaagatcagaaccttaaattgttcactcttttttttttttttgtgagacggagtcttaacgctgtcgcccagtctggagtgcactggtgcaatctcagctcgctgcaacctccgcctcccaggttcaagcgattctcctgcctcagcctcctgagtagctgggattacaggcacatgccaccatgcccagctaatttttgcatttttagtagagacggggtttccacctcgttggtcaggctggtctcaaactcctaacctcgtgatcctcctacctctgcctccgaaagtgctgggattacaggcgtgagccaccgtgcctggctgttcactcttgacaaggatcaaaaacaggaactaagaagcagaccactaactttttccttttttctcttttcttttgcctttagctcaagccaggacagaacagctgcagggacagtgacagtgaaagtgccagtggagaatccaagggcttccaccggagcagctctcgggaaaggctcagtgatgtaagtttaagtaaaaaaaaaaaaaaaaaaaaaattaacgaaaaccactaggccacacacacaccattggttcaagtctgaattacataactttccctcatctttagaactttttgtctacccaagcattgcggttcacattatctttgtatacttatttgagcattgtagttatggtgtcattctaaaatgtcgtttgagcaaaaatgtattttgacaaatcattaggtaggaggaactatttgttaccttagaaacaacaaggccgggcacggtggctcacgcctgtaatcccagcactttgggaggctaaagcaggtggatcacctgaggttggaagtttgagaccagcctgaccagcatggagaaaccctatctctactaaaaatacaaaattagctgggcgtggcagtgcatgcctgtaatcccagctactcgggaagctgagacagaagaatctctgaacccagaaggcagaggttgtggtgagccgatattgtgccactgtactcagcctgggtgacagagcaagaccccatctcaaaataaataaataaattcccgttggatttctggaaggaaaaccttgtgagaatgcgtcatacctcttgagatatctgtttgccctctagatgtgattttcattgttctctagtctgcccaccaacagggcaggttccccctctattacttctgagaaccacctacccctctttggactctcttaccttctttactcatatgtcatatatcagcattttttttttttttttttgagatggagtctcactctgtcgccaggctggaatgcagtggcacgatctcggctcactgcaacctctgcctcccaggttcaagctattctcctgcctcatccttctgagtaggtgggactacgggtgcacgccaccatgcccagctaatttttgtgtttttagtagagacagggtttcaccgtgttggccaggattgtcttgatctctttacctcgtgatctgccttcttcggccttccaaagtgctgggattgtaggtgtgagccaccacgcccagccatatatcagcattcttaactcatctgtacctcaagagcaacacttggaaattcttttgtgaaatggatcaagtaaagagattttttttttttttttgagactgagtcttgctctgtcaccagactggagtgcagtggcctgatctcagctcactgcaaccttcgcctcccgagttcaagcgattctcctgcctcagcctcctgagtagcctggattacaggcgcgtgccaccccgcccagctaatttttgtattttcaatagagatggggtttcaccatattggccaggctggtcttgaactcctgacttcgtgatctgccacctcaacctcccaaagtgctgggattagagctgtgagccacctcgcctggcttaatttttgtatttttagtagagatggggtttctccatgttgaccaggatggtctagcattaacagaataagtgagagagtagcaccatgaaaaaaaagagatagcacttcagagtgtctgagtattaagaataaataaaggatatgtaataagaagcaaaatcttttattttctccattttatttttaaaaaacaccatactctaaagcagtgtgctgttcattatagagtgcaagatgattcattgagttccagaaagaaaatactagtactttttttcttaaaaaaagaaattaaactttactagtattcagtttaacgagcggggaataattgatgtctataatttttaaatacgtggatttaaggagtgtatactcaaaacttttttttactgagagatgtctactaacataaacggttggagaccactctagcacactgagcagttctctatgataataccacatccatctctccatcagccaaggtagacaattccgagatacaatcacatttctgcacctctcatgaaagtttgtgaggtttatgatgagatgttgtatgagatactgtattcttacaggaattaaatggaataaagtataattatttttatgttattttaatatattagttatagataataacctccccttcttctgtgatataatatcaaagttatataaataaagagtactaacagtattttactgtgtgtgtgtttctgtgtgtaagaatatgttttattgtgtgtccatgtgtctgattaattttgtgatggagctatacaaccataaaaccatgacaacttttcttatctaagttgttagcaataataattaatgtttaaatagctgtttttctgagatttttgttatacttttaatgtaagatctcattgactctagaaattattccagggttagtaggtcatatttttttcatagtgtagagaaatgaacgccatgttagtttaggggactagagctgccattggatcttttggcttgtttcctctaactcactttctgttagataaaaagaaattgacaaaagacattccatattcatgaatagaaagacagtattattaagatgtcagtactaccctaagctatttatagattcagtgcaatgtctatcataattccaacaatctttttttgcaaaaatggaaaagcagattctcaaatacatatgaaatggcataaggccttaataaccaacacagtctggaaaaagagcaaagttagaggactcacacttaccaacctcaaaactcactgcaaagctacagttaatcaaaacagtatggtgctggcctaatattagacatacagaccaatggagtagaatggagagcccagaagggagcccatacttatatgcctaaatgagttttaacaagagtgccaagacacttcaatggggaaagaattttctctttaacagatggtgttgagagaactggatttctatgtgcaaaagaatgaaattggactcctacatcgcactatgtacaaaaataaactcaaaatgaatcaatgaccaaaatataaatgtgaacaccataaaactcttagaagaaaatatacaggtaaatcttcatgaccttcaatttggcagtggcttattagatatgacaccaaaagcatgtacaatgaaagagaaaataaattggacttcatcaaaattaaaaacttctcacaccaaagagcattatcaagaaagtaaaaagacagcctacaaaatggggaaaagatttgcaaatcatataagtggtgtttactctacagaatgtgtaaagaactacaactcaataataaaaagataacctaaagcaaaaatgggcaaagaatttgagaaatatttctacaaagaagtacaaagaagaggtacttgaaaaatgctgaaaatcattaggtattagagaaatgcaaattaaaactgtaacgagattatcattttatacctagtaggatggttatgcttttaaaaagagaatgaaaaataagaagtgttggcaaggatgtggaaaagttggaatattcatacattactggtgggaatgtaaaatgacgcagccactgtagaaaacagcttggcagtcctcaaaaagctgaaacatataattaccatatgacccagcaatttcacttttaggtatataccccaaagaatggaaaacatgaacttaaacagagacttgtaagccagtgttcactgcagcattatttatggtagtcaaaaagtagaaacaacccatgtgtttctcaacaaatgaattgataaacaaaatgtgacagcttggctgataggcacacaatggaatatactcagccataaaaaagattggcattgtaatatatactacaatatggatgaactttaaaaatatgctaaataaaagcaagacaaagaaggacaaatattgtatgattccacttataagaggtatctagaataggcaaattcatagagacataaagtagaatagaacttaccaggaatttgggggatggagagtgggagggaggaaagctattgcttgttggttacagagtttctttttggggatgataacaatgttttggaaatagatagtcatgacagttgctcaatgttttgaatgtaattaatgccactgaattacacaattaaaaaatgatctgttaaaaaatgtaaaaataattagggctgtaataatgcttattctgctttcacttcattgaaaatatggaaaatagttataacttttaccagccttgtctactaattgtgtcacctgtgccatttctggtcctgtttctattggttgttttttctcttcattatgggtcatattttcctgcttctttgtatgcctggcagtttttcattggatgccagacattataaaatcctgtcagtcttatgtcaagccagtcaatgaaacacttccgattcatattgtttattatattttaaaattatgaaaaaaatttgtgggcatatagtaggcgtattgttcattaattattaaaattcacactttttgcaacattactgaaaaggaaagaaagaaaaatgacccaaaacgtggacatttactgaaatgttttgagatccctagtcacatttccctcactcatgtgcaggtctgaggttgcagagtcctgtgtcaagcactatggcaatctgaaatctgctgagatgaaagctttttttttttttttttttttttccgtgacacggagtttcgctcttgttgctcagcctggagtgcagcagcacaatcttggctcactgcagcctccacctcctgggttcaagcgattctcctgcctcagcctcctgagtagctgggattacaggcgcttgccaccacgcccagctaatttttcatatttttagtagagatgggcttcaccatgttggccaggctggtctcaaactcctgacctcaggtgatccatccaccttggccttccaaagcgctgggattacaggcgtgagccaccatgttcggccgagatgaaagcttttaacaaaccaacccacagaatggatcttttggataccaaagcaacacctacctgcacaatattttagagaataaagatgccccattttttcttgaaagagaattaacaattaatttatttttttacttttattttagttttgggggtacatgtgaaggtttgtaatataggtaaactcatgtcacagaggtttgttgtgacatgagtttcatcacccagtagtacccaatagttattatttcatcacccagaattatttcatcacccagtagtacccaatagttatcttttctactcctctccctcttaccacctttcaccctcaagcagaccctagtgtctgttgtttccctctctgtgttcataagttcttattatttagctcccacttataagtaaaaacatgcagtatttggttttctgttcctacattagtttgctgaagatagtagcctccagcactatctatgttcctgcaaaagacatgatcttgttgatttttatggcaatgtagtatttcgtggtttacatataccaaattttctttatccaatctgtcattgatgggcatttaggtgtagcccgtgtatttgctattgtgagtagtgctgcagtgaacatttgcatgcatgtgttgttatggtagaatgatttatattcttctgggtttatatccagtaatgggattgctgggtcaaatggtagttatgcttttagcttttgaggaatcatcatattgctttccagaatagttgaactaatgtacactcccaccgatagtttataattgttcccttttctctgccaccttgccagcatctgttgttttttgacattttaatattaataatagccatttgactggtgagatgatatctcattgtggtttttgatttgcatttctctgatgatcagtgatattgagctttttttgtataggcttgttggctgcatatatgtcttcttttgaaaagtatctcttcatgttctttgcccactttttaatggagttgtttggttttgtcttgtaaatttgtttagctccttatagatgctcgatattagacctttgtcagatgcatagtttgcaaatatttttctcccattctgtaggttgcctgtttactctgttgatagtttcttttgctgtgcagaagtgcttaagtttaattagatcccagttgtccattgttccctttgttgtgattgcttttgatgactttgtcatgaaatctttgccctttcctatgtgcagcatagtactgcctaggttgtcttccagggtttttatagttctgggttttacacttgtctttaatccatcttgagttggtttttgtatatggtgtaaggaaggggtccagcttcaatctttttttttttttcttttctgagatggtgtctcgctccgtcaccaggttggaatgcagtggcatgatcttggctcactgcaacctccgactccctggttcaagtgattcttctgcctcagtcccccgagtagctgggattacaggcatgtgccaccatgcccagctaattttcgtatttttagtagagacgatgttttaccatgttggccaggatggtctcaaactcctgacctcgtgatccgcccgccttggcctcccaaagtgctaggattgcaggcgtgagccaccgcgcccagcccagcttcagtcttctttaatgcctatcagagagtgaaaaggtagagtcaaagatgactactggtttttgtttttgttttttctttaaaaattccatattagttcttattatgcttattcttctttcacttcattgaacatatggaaaatagttattacagcttttactgtccttgtgtactaattttgtcacctgtgccatttctggacctgtttctattggttgttttttctcctcactatgggtcatattttcctgcttctttgtatgcctggcaattttttattgaatgccagacattataaaattttccttgttgggtactgggtatttctggtttctataaacattactcattttgggatacaattttgttatttggagatgtgtgtgtgtgtgtgtgtgtgtgtgtgtgtgtgtgtgtgtttttaatgtttgcttttgtactttcttggacaagaccagaacaacctttagtctaaagataatttttcccccattctgactgagtactttgcctaatgcctaacgtcttacaaggtttttccactgtagattgtgggaaaacaaactattccctgccttgtgtgggctttgtaagttcttcctcctccttcccagtggtggttttcctcgccttgggtattttctctcacagatgtgctgactagtcatcaggtagaaactagaggggaaccttctgcagctttcatgattctcgctttctgtgatgctgtctcctccttatcctctgccttggagttccagctgtctttgcctccccttattctcaactgtgtcttcaagactcagggattccacctgggtcacctcctacccggcaatcatgtggcatgaaaactctccaggcagtaaggtgggaaaattttaagggtcaccctacttttttctcttctctcaaatattattgtcctttactctgtcttacccaatttctaaaaactcctgtttcataccttttgtccagttttttagttgcttgaggtgggagaatacattcagtccctattagtccatcatgcccctgactcgtttttcagctaagatgaaaatttctgtcagcctttcacccattttagtgatatttttaggagctttggcagttgagacttactctcaagtgaggctaatcaaaatagtatattattctagctttgtttttttgaattggttaggccaaaagaataagaataaagaattccagtgtagctgtataatttgactcatgcgtaaagcttaaaaacaccaaatatgtggccaggcatggtggctcacgcctgcaatcccagcacttttggaggccgaggcaggcagatcacttgaggtcaggagttggagatcagcctggccaacatggtgaaaccccgtctctactaaaactacaaataaattagctggacgtggtggagcacaggtactcgggaggctgaggcaggagaatagcttgaacttgggaggcagaggttgcagtgagccgagattgtgccactgcactccagcctgggtgacagagtgagactctgtcttaaaaaaaagaagaaaaacccaaatatgctttgcttttctaaattatatattcccagaccatgttgcctggggggaataattggccacaaggactttcagattgtccacatcaaggagacatagtaacttgtttagattagtcactagggaagagttaaggggaataattgaatatatagttaataaatgtttatgatgagttattcacagggaaaatattgcttccaacttaaacagaattttgtaactgaggaaatttgtcaaaagttaggagcaaaacttacttaaaaacttttaataaacaagcctcaaattatgaaatgttaatgggcatttattataaacaggccaagatttaatagaagttctgctatttattgtgtgtgaccttaggcaaagaatgtgacctttcttccccgccaagatggagtcttgctgtgtcgcccaggctggagtggaatggagtggagtgcaatggtgcgatctcggctcactgcaacctccacctcctgggttcaagcaattctcctgcctcagcctcccaagtagctgagattacaggcatacaccaccacgcctggctaatttttgaatttttagtagagatggggttttaccatgttggccaggctgctctcgaactcctgacctcaggcaatccaccctcctcggacttccaaagtgctggattacaggcataagacactgcgcctggccttgttcgcactttcaaatcttcctacctttgcttattctttttatttatttaaaatgaattgcagtggcatgatcacagctcactgcaaccttgacctcctgggttcaaacttttcttgtgccccggcctcctgagtagctgggattatacacaagtgctaccatgcttggctaatttttgtatttttagtagaaatggggtttcgccatgttggccaggctggtctcgagctcctggcctcaggtaatccaccctcctcagccccctcccaaagccctgggattatacacatgagcctccacgcttggcctattttatttctgttcttttttctttctttgtttttcttttccttatgtcagcttcaacctcacttctaccaaacacttcccaacacactgtggaagtaaacttctttaatgctttatttaatgactatatgaatatgactcttttcacctttctctctgaaagaattttgggttgggttgttagttatgagaagacagaaaaatatttaacacctttcaagggttcagatcgttcaaggaattgaaacatctcagaaaataatgaaaatggatcaaagtcttatgagtctaatgctacacagttgtctactcttattattctggtagctatttacagttgagacattttttctgcttccttttgagataccccttctcctacttcaaatcttccctggtctttgggtttttattgatttgtctatcccacagtgccactgttcatccacccatgccagcatctgtcctattctttctttcttcctcccttccttctctccctccctccctccctctcttgaaatctttattgaggttttattccatgccaggttgtttgaccagctactgttaaggaggaaacagacttgagccactaccatgaatgagcttcccacattgttataattagattaggaaatctaatctcgacctgacaaggattcttggtgttttattcctctctttttaaaaaaatctgtgccacattttccttttccttaacagtttgcttatgcctttttccattcctgtcccatacatttatgaattctcctggatatgtcagtatttcagttgccaagaaatgtcaatcaaatttcttttattcatcaggtatagtctgggcatttgaggttgagtggagaacaagatgaaacctctgccctcatgaagtttccattctagtgggagagacaaatctattaagaaatagctacaattttttctaatagaatgttttctgacataaacaatatgaagggcgggagtttgttgctactttaactagtgtgattagataaggcctttctgtgtaggtgacattaaaactgaggcctaagtaaagaaaagaaggtagacaggtgaaggtctatgggaagaacattctgggcaacaggaacaacaagcttagaggccctatcagaagcatgttgtgttcgagggaaagaaaaatggcttgtgtggctacagtagagtgaagtagcacagtggctgaacacgtaacttctagcccatgctaaggaggctgggtgttgtattaatttcctgggctgctttaatgaatgaccacaaactgtatggctggaaacaacagaaatctattatctcacagttctggaggctagaaatttaacatcagtgtgtcttcagggctatgtaccctctgcaggctctagggaagaatcctttttttctcctggcctctggtgcctcccagtgatccttggtgttcctggcttatagatgcatcattccagtctcttctttagttttcacatggtttctacagcagccattggatttacagcccatcctaaatctgtatgaccttaattaggtacatctaaaaagaccgtatatccaaattatgtcattgtattagacttctccacagaaacagaaccacagcagaagataacagaaccagcagaacatgatttattatgagaaattggctcagttttggaggctgacaagtcccaagatctacaatcagcaagctagagacccaagagaacctatagtataactctagtctcaaggctggcaggtttgaaactcttgaagagctgatgtttttattgtgtctgaaagcacaataaagaactgatgtcccaggtcaaagccaggcaaaaggaattctctcttctctgggagagagtcagccttttgttcttttcagaccttcaactgattggataagtctcacccattttagggaggacaatccagtttactcagcatatcaatataaatgttcaactcatctaaaaacatcatcacagaaacacccagaatcatgtttgaccaaatatctgggcaccccgtggcccagtgaagttgcaacataaaattgaccaccacaatcacactctggggttcctggtagacataaacagggggacattgctcaatccatgacaggttattatcttaaaagccactggactatgttaaaaggattggagttgtagttcttactttaaaatgtttattttgcctttgatatgaggaactgtccatgaagacaagagcaagaatgaaatcagaggtagaagccagaaggctgagatgagagttggtgacaacctgacgtgggcataacagaaggttgaataattggtgttggaagtgacgtagcatttttcccacctgatgcttttatcaagttgttgctccatttttacttgatttcttccaacaactatatgcttatttctcaatcaaatatatatatatatattgtgtgtgtgtgtgtgtgtgtgtgtgtgtttggtcggctattagtaatcttatctccaaggtacgtttctttggattaagatttcaggtttttaaaacactactggaagatctgtgaatgagcttgttttgtgacctttgcaagaaatttacttgttcatgtgattcctggcatggtccttctcctttttactcccaagagagaaaagcataacatgaaggtgggtagccaggaatgttgaacacaattagcgatttggaagaatttaaaaatattcaatttaaattagccctagggtcagaacacacattctcacctaggggtggagtacacatgtgtcctgtctgtactcagggagctgtaacagtagccatggcctctctgtgtggatttataatgaatggagcacatctattttagatggataatcaattttgaaatcccttattgtaagtatgctgttaaaacagaaatgttaacttcatgagtttaatgagtagcttcgatgatagcttagtgaagagatggaaggaaaggcaagtggggggaaatgagaaaaggagaacaagtgtttaatgaatatctacttgcagacttgaatgtcagcagcaacattctccctcctggaaaatgtctttcaactgtgcatcccattatgttcctgcagcccgtggtagcatgaagattgagacaaagagagtgtttctaagaaagctctcctttacaatataatgagatggaggtgggtagtttgcagagattgctggagcagtggtcaaatatgaaaaaaaaaaatccagcagaatgaaaagaccatgttaaccaggagatggcttataatgagcccagaaattgcatatcagatagccagctggctagcatttcctcatatccctgtgttctcatgcaaactgctaaaatgttctcctactctattttctcagcctcttaatagttctcatttctacctactgcattgaaaatatgaatgaaatggcaactctaccacttgaagaaataagaatgaagcccttttcagcaaaagtatttgcctaaacatggatggatattatttcaaatgcttttgaaaccaaggaaacttctgtttctttccttaaaaaaacatcttaactttcaagtctcagtttgactcacagccttttcagtattctgtggcctcttttgctatatagtttggacagactttgcttgaagtctccaagcaaaaaaatggaagtcctcccttcttattggaaattgataggggaggcttggcacggcgcctcatgcctgtaatcccaacacttgggaagccgacacaagaggatcacttgaagccaggagtttgagaccagcctgggcaacatagtgagatgctatctctaggaaaaaaaaaatagctgggcacagtatcgcatgcctgtagtccagctactcaggaggctgaggcaggaggatcacttgagcccaggagcttgaggttgcagtgagtcatgatcttgatcattaaggaagagtcttgtgaaattgttcaatagttagggtattatcacctgtctactttcatggttctttaccttttggtgactgtctcttctttggtgactgtgtcttctaaaatgagaaagcagtaccaatccctaaatatacatctgtcaataacttacagcacatttgaaacaatattactgctgtttctaaacattccttttttttgtttttagcatgatctgttgttgcctgtgttcatataatttctgtcttggaaaattattgaagctaccaaatatttgcagctgtatttagatatagactttagattataaatatatgacagagactctttactgggccttttggatgcgagacctcagggatatatgatacgtgttgtgagcctcagctaaagtctgacttccctgtggctggtaacttctgttaccaatactttaatggtggggtcctgttggtgaccaggcgtaatatctcactgaatacaaggccgtagtcagaatcttggggttgtaggactagacaagcagaagtctctttatttaatagatgtcactcctgttaaaattctccagctatgactgaagggagttggcaagtagccaagaaaaatgtggtgaaaagggtttaagaggggaggaaatgtcaatgccatggacatttggcaaagtcgatcacaagagggtttttctacacatgtgttttctgctgatcctgaaatcaaaactgaataccatgcatcttttcccttaaaaaaaaaaaaaaaaaaaaaaaagagtacagtaggttggcacatgtgaatggctcctgatacgagactctgtatgctttctagcaaatgctgaaacaaattccagtggacctttaatgtatatggggatcttgtgtctgtgttccctcgtgtgtctgtgtttgtgtgtgcccgtgtctaggggaggggagttataaggcagggtgcttaaatgctttgttacattatgttaattcctcggcagtgcaatcaaattcatgtcgtaattaaagctgtcagttggaaggcaagccaatcgccatgaaaacacagcataacaaatgaagtgaaatgattctgcgtgtagctatacaatgcttcgccaggcatgaaattaaataagtaatttgatgttgacatcagaaattgaaatgatacccactgttccctcattcagtcagacctgcataaacaatagccagaacaaatatgcacaacaaagccctcttctccacccagctccctgagtaatgtacaatatatatgcaaaacgagcataacagagctttccgagacctgaaggatgtaattttctttggtatacgataagatgatatgtatgtgggggtagggaagtgggtttggtgggagtacttctctttctgggataaaatacatttgcaggaagggaaagaaatgaaataaacaaatcccatggtctctctgagtaattcatcctaaaatgagttcacttcccaggggcatgactccaagctggtggagacctaacttggcttttgctttcttctgctgctgcatggagggctgtgggtgctggaaacaggtgatgctgtcatatggctagtcactggtatgagaagttgtctccatgactactgtggatctccctccataccatttatgggattaagaatgcagcaggattttaaaaaactgagtgcagtgagcaggatcacacatctatggtgcttcattcccctgagcttgtgtgaaacgctgagatgaggaaagttttgctttgggagctgcatttaggaatgccttgaagcatactgttcttgtttgatgtagatatagttacagtaccatgtttcctcctcaaagagcttagcatcaagaagagtcaccatctgctgtatttttatagatgtcaaattctcctgagccatttttcttacacataatccatccattcatttatttatacattcattcaataagtccttattaaatgcatcctgtgtgcaagtcattgtgtgaagctctaagaagcaatgatgaaaaagccagctggttactgctgtctgaagtttccagagtagggggcaggacatgtaggcagaagagctagcagtgaacagagtaactgttgcatcagggcagaggtcattttgcttctgggaaagtataatacccaacccaagctcatcagggaagaagcctggctggtgcagggatgcttagctgagacctgcagacctattcagcatttgcttcaccttcatttcaagcttaatcacaaagaggaagaggatgctaaaaattaaataatttataaagagaggttttaggagaaaaaaagaaacaaaaatcagaatctcaggcaagtttaaaatacattttttgggggggcttcttttcccaaacaagtgatgccctgcattcctttcagaattaacatttttaaattccctgtgtgtcagaactatgacagcctaaactggtaattcttgtgacttaaacccttcagaaaaatggtgcttttcactgctcctcttggcccacacattctctgcattttagtctactaattacgtttacaaaatgtctcatttttgaaaagccctgtgtgtgtactaactgatgcctttagggaataaactggcaagtaggtcatacactggaaaagtcatccaaacccactgggctttttattttcaagtcaatctgggctttttcctcttgcctgcccctttgcggccacaaaactgagtagcttgagaccagggcattgaatgtcagcaagtcagggaggcaagctgatgcgtgtctgtttagtctcagtgcagggcgaaatgccatcattaattcattacccagctgcctgtcaaataaattggcaattacatccaccgcagaagcttggaattcagtaaatagcacgttagcatctctgagttgttgagagatgtaaaggggaaaattaagcaacacggtgtttgtatcagtagcagatgacaaggggcagcatacactggtgatgtgatgtggtgatgaaaagcctgcaaagggctggtaatgagctgtgtggattggaacgtgttaaaaaccattgctgattttccacttttgtctttatgctttattgcagagttcagctccttccagcttgggaacaggctacttcgtaagtctatctcaacttccacatatgtgccttgcattggcattgatttccttctataatgaatgctcattgggatatgaaaaaaaatctgagaatttctctctcagtcctaaagagcagactgatttccattctttattaggaattgttttatttttagaagacatagcctgctgggccctagggatcttaagtaagtccgaggtatatacctggttcctaacgcccaggacattaagctccttacctggccatgtaaggagatacagggaaccctgattagctcatgccaccatttctccacaattacttttttagtaagaagtgtcatgtgggggatggaattcagattatgcattgagataactgatttcttgaataacatctcttcatatacaatgagttgccttttttggtggggaggacggggaatggagatggtattttttaatgaatgttttccctcacagtctgggtagtttgcctttaggtttttctttcagcaataattaatatacttatttttgctaaaatgcaaagtttatttctgaaccttattctctgtcctttgggaaagatggcagtgaggtgacccttcagggattatcacaatattgtgataatcatgaatataaaattcattctcaaacagcagttgtcacttcattatatttatttatagtgaaattctcctttctggatttagtgacccttttcaagatacaaatgaaaaagagtgacaaataagcattatttgtacaataggataacatgtcaatgtaaaagtctgttgtgatgcttaaaggaatctgattggtgttctgagtgatgaacactgatacagtcatgcctcagtattttctgagaaaatagtgaaatcatgaaaatcaaataaagtggaaaataattactaattcactttagttgcttttaacttttctctccaatgctaattactctggttttcttctgcccacgtatttctctcgatacatttacattaaatttatggaaaccagcatcatttcattaataaatgagtattttccaagcttagcaaaagtggcattttctagatgttgacttttttttggtcttaatctgtaataggagaaaaagtataaggatgatttggacctgcttaatacagttagcacacttacccttgctcctacttattgtggctgaatattcatgctaacagaaacaagcaggatacattcagtatcctgcttcagcagtcgaaataacagacgtagccccatctggcatctcttcacaccaggctggatgtaggttgagatgctggaagtaaaatctggagactgcgatatctattctccatccaaaagctaaagcctccccctttgctttcttcagcagaaagaaggccaaagccactaccttagtccttgatcacttctgtactgaacattctagtattttttttttattgtcagtaggatcaccctgaaagaagaaagtcatttctagaaacattgagattttcattatgctttttgcagttatttttctctctagttccaagaatggttatttttattctctaataatatattcttatgatttaaagagtctttaattacatgtctattaataaaatggcttttacagaacattggatgagtataaaagttttctcttattttggtaaaattgctggtagacttactttgcttacataaaagtctgtcgtattattagcttacatggagaagatacataccagatgtgtattcagctttcaactgtgacaaaaatgccctgctaggatgtgtttccaataatgtgattgttatgttatcagagtgcaaaatccattgatattgttgcccagtcctcatgaaaagtatcttctatttcaactttctttccaatagtatcacatgtaataatttcagatactaacttccacactggtgagtttcatacttctaagtggaaatgatatgggcacaacttacattagttctttgccaacatattatttacactgtgctttgtgatttgtgctgtcataatagctttttacttaagcctgtaaagaaggctcagcttcaggtaagtgaaatggtaatttttcaagtctatccttactcctcttcagcatgtctttgaaatgtggatggagggaaatcacctgcagagtccatgagctattagcgcaattgaaccataacatgaattctggtgtaagaaagctgaaggcacttttaacaatctagaaccgttttcttgaacactgtcccaagccccaacttcacagacttcctttgtttctatttagagcttttgtcaacagaggtaagatgctgttcattgtgtttgttaataaaatagacacctgagtatatacatgtgcaggtgtgtgtgcatgcacacacacgcatacacacccttagccaaaaccagtatattttactttcagttcttttatctgtagtgatacattcaagggtttaaaggagaagcctttgtttttgatctggttgtatttgtttatatctccttggttttgtgttccaaagatgtctgcttaggtctgtcacttttccaatccgtttagaagcagaagatttgagaaatgagaacagcagctcaaatcagtatttacataagcatattgcaaagaattcttaaagtagacaaaatagagaaggattggaacaaactttctacatttttgggagcttttgaataatgtgggtgttatacacacagagagacacacatatatattcattacatactcatgcccagctcatattctaaatataaatgaaagtatagactagttggaatcgatttgctttttttttttcttttttggcaagaggactaaaacttgttagagtgtgtgtaggattttcttttttttttttgttttgaacgtcaatgcaatgaacacattttcttttcaatttaaacgttttaggctgtattttctccttaaacatgtatttgaggtttcaatttgcatagtgtataattaagaacttagaggcagaatgatcttttaagactacctgtatgaccttggtccggttattttatgtctctgagtctatttccttatcaatacctacctattagtgttgcaaatattaaatgagataagatattttaatgaacacagaatatcactctatactaccaaataataagtactgccttctgttattcacacaatcgtgtgtgatggagcaaagttggtctcatcaggtggctgtgcaatgttgtgcaaagtaggttttataatttgtacctgtaggatagtagtattttattcttattatattcttcttgtagctttctcaggagcacagcttttgtatttgatcagttatttacattttttctgtatgtgaacataaaacagggtattcatcctctgtgattctatatgaacatgacgatgttggaatgaactgttctattagctgtccacatattatggttgttctctgtaatttgtcagttaaagttacttgtgtattttcttcctcagaagcatttgaagtacttggagcttttaaagactgcttagcagcttttaggattgggctgagagggaaggtacacctgttcaatatattccacttttatgaacttgtatcacatttgctcctttctgacaagaaaaagaaaaattgatgccctagcatatatgaacacagtaactgaaatcagtagaatgaaaagaccagtgagaacatttcgtgttggccagtggtctggtatgtcatcacaggaaagatctggactcattctttatagcacttgactccatgtggagttgggagctacttttggggcaactaaccagccaggcagaacttgattcctgctgtaagggaagtacagccttacttttttccaagtgacatgttctgccttctctggataattttcagccctcttccaggtttgaatctaactgtcttagaaccacagcctcaaatagcttgtatcctgcttttgtaaactccataatttctcttaaggattctcaactaataattttcatcttcctcaattgggtcacatctagtaattgacatactttaaagttatcagggaaaacaactcacttctactcagtgattaaaactgccgcattatatagtaaaggggaattgtgtagtggtatacatcttcagacgggatttgtataattattgttttcctgtgcagttgaattacttaagttgtgtaggtagtgctggtaacaggcagtaggtgcaaaatattgacctgtagctttccatccagggttataaaggtcatagtgggaatattctttgcccctttctaagtttttgactataaacccttgaaatatctcctgttttcctttgctataattttgtataacttcttcttttttctttttgacagggtctcactgtgtcacccaggccatagtgcagtggtgtagtcacagctcactgcagcctcagcctttctgggctcgggtgatcctcccacctcagccttcccagtatctgggagtaaatgtgcatgccaccacacctgcctaatttttgtattttttgtagagatggggctctaccgtgttgccaaggctggtcttgaactcctgggctcaagctatctacccaccttggcctcccaaagtgctaagattacaggcgtgagccaccatgcctggctgtataacttctaaaactgatttggtattctgtctaaccatagttgctttttaaccattttcccatttccccagataatactcaccagtggtgcttgcggctgcaacatttatcttgatgtaactgccagaaaatatcttgcttttattattttcccattgctctagtatattgactttggaaacaaaagacgtcattctactcatagcattctattttcagtagtggtatttccatttataaaatatagtaatttttataaatgccaccatgcccagccacttttaaatatttctgacacattgtattcatttattttctgggggtgaattcttttattagaacattcaaattaataattttgtttggtttgcaagaaaactgatgccatcaaggaagatgaaaagttactacacaaatttcaacaaagatttctataatttataaatgagggctgggcacggtggctcatgcctataatccagcattttgggagactgaggcgggtggatcacttgaggtcaggagttcgagaccagcctggccaacatggtgaaaccccgtctctctaccaaaaatgccaaaattaactgggcgtggtggcatgcacctgtaatcccagctgctcgggaggctgaggcaggagaatcacttgaacctgggaggcagaggttgcagtgagacaggatggcgccattgcactccagcctgggtgacaagagcgagatctcaaaaaaaatttataaatgaggttgaaaattcattttttaatttaataatcccagtctcagatgccctttcattctttgaatttgcatatctctataatatttctctttcaaaattttctggttgtcttatatataataccttgtataagctgatctagcagtggctagataggatcagattcaggtttggattttggcaaggatgcctcatagatcatgttgtgtgcttcaattaggagccacatatttagttctttatttttattaatgttaacagccattgattagacccagtgttcgttaggagctgcaaaatggtgatattgcagttccatcattctgtaaagagaaacatctacattaactacaggtatttggttatcctgaggtacagttaacacactgtatttgaataagagggtttgagctctccagagaacctatcactatttataagatttcttaggggttttagtttcagaagtacagatacatcaacttggtgctgacggcagctccatccaaagcagaagaaactgtcttcttccccacttggcagtacttgctgtgatgctaggaaaggattttgtaattcaagtgttcattcatcacctgttaagtacttatatttaagataaataacattaagtattttaacacttccccccaaataaagaccctaatctttgtatttattagtaattaacactaggtaaattaatttttggccattatatattgacaaaaatctattataatggaaatatttttgaaaatctaaattttatctagaaatccatgaaggatatccagttattattagggcatttggactaattgataaggagttgagttggaaaactactctccagatggagatttcaattcattttaactcacaagtatgacttaaatatctactcttagttcttaagttgcataacgtgtaagcatggctctcaagtcaaagatatgtagctgaatttgaagcaaagcaaactgattggtctatgagaagtgtaagtagagcacttggaagtataaaggagggtcagttaaatgtagcaggcttaaattgtgcagagcttgatggatgtttagatagtcaacaggaaagaaagggtggaacaagtttgaggcagggggagcaacaaagacaagaatacagagaaattgcataatagtgtggattgaattgactgtatgatgtctctggagaaagacgggacttagattgtcagggaatgttggttgattacagggaatgtgggataaagccagggaggtagtcgggtgagtggggaagagatggtttgtagagaaggacgtcaagtaaaggatcaatgactacaatactcttacttggagttagtccccagaagaggagatttgaatgtaggaaaatggtgagtttggaagttagaatacgtagttagaaatttaagtgtgtatttaagtgtaacttaaaatctaggacattaccaatgcctttgaagctacctgtgtactgtgcagaaacatctgggcaaacgaaagttgttgctctcccttatggtgaaacattgtcacattttttaaatgtaaccttcaaaatactacccttaactgtgttttttcctcctagtaacaaaaccagaatctaaggtgcattctgacagactcctccacgtggcgcagataaactctctaatttcaagggccttagacagaaaatataattgtatttcccatgtctaattcttacccttttttggtcatgtttttgatctgttaacattttaattgagggaataggatcagtgagccaggagcagacacaccttgactaaatgaacagtacaagttaaactgtggtgagagacatttaaacatttgtagaatctctacaacaggatgacttttccagcacactctgtagaaattatcttctgcctacacactatgtttaacttcagcttcctcattcagtacaagggaactgagaaatttgacaaaaaataatcaggtgagaaaagatcaattggtgtttccagttgcaaccaataattttaaccctttcattttctcaacatttaaatgagggaataggctgggtatttttaaacatttgctgtctacaggaatctttgacattgctgttgcaaactctttaaggagataagcggaaaacttaggtgctactgatggatgtggggaaatagccctcagccgttatctctctgtcctcctaacccccatctctggcccctcagatttagagggaaaaaatgattttggagaacaaagatttaatgagccactaggcaagagagtggctaaaggaccttaatttctaatatttcaaaatttatgattccagctgccttacaactagatgtctgccatgtgcaaccattgcttgttgctggcctcactgcctttctttgctgtcctttgagccacaggaatgcaaggccatagtgctgcttagtgaacactgttcttcactgtcaacattgaaaggagtcctgatttcaacggagtggccgagtctgcttttgtttgaaagtaatgtattttaaaattcattatgaacaataatgcaattattcataatgaataatgttttatatttgcatcattcatttagggctagtacatagagatactgaagctgttggcttagcctgttccatagctagtagattgatcatagagatgaagcggtaaaggctttagcacagtgcattgacagtcccagagggaatggacaggtcattgccatggaattctgaaaataattttatcttcattttcatctttttttctgacattggctttaaggaaggttgtcttatccttgttggagatttccacattacagaaatttgttgcatttgttgatacaagctatgtaaaatgacccacaggcaatgtcaattccggaggtttactctgattacccacacaacccttattttgatagatttaactagcctggagttttattgactatcactcagaatctttcagatcagagaactcactcctttgcttaactacttaaaaaatatttttgctgaaattgtaaattagatgcctcccaatccattgcataagaaacttatagcttggtgaaacaccaagagtatcatttgaaaaagaggttaaaaaacacaactggggcttgttaaagaggaaaagtggtattttaactccaagtgtcacattttcctatagtcagctctagcagtaaacaagagttattggaggcttagatagtttgagacacttcacttatctcccagtacttgacttcagaagccaaacatttaaaatgtgttttgctcaggtaaaaatgtttatccatttaaaatacaatgtcattttaacaaaagcaccctggtgacaagctgtttagatatagcacagttgataaactgtcagatcctgtacacatacacttgaaaggaccagcgcagtaacacaaggattggcattataaatcactgttaacaaaccttaatttgcttagtaggctaatgaatgatctccaatttttcttcagtaattagcttcgctaacagccatgtcaaagggaccttccttatactgtatttaatctctgctctgaaatctttggtgtctagtttgcaggatgaataaaaacaaacaaaaaacatttcggtctccattggcgactccctggtaataaatccagatgtagggattgtggctgttttcaagtagaaacattgccaaaggtgatgactgtctattagggcttgtaaactgtaatataatcacagatttggaatggagtggtgaagccagataattgcagtgtttcctgtctaaatgtgctgctgtgcgtagtggcctctgattttaaggagctgttaaaaatgcagcaaggcataacagctgtggttcctagaatactcctaatatttcatatgttcatcacatctcataaaatcttgcccagaccaacaaatgactacttatctgtacagctggactgtcttagaaggaaattagagaaagtgtgaatcatgtaggttagcattacagagacccaccaagagctcatccaagcccgtgctgtgccatatttctcttactgctcctcagagttctccctttccatttttagtccccaaagagaacatttgcctcttaccatttgtgagcagatcttatcaataacttactttttcctacctttgtggaaaatagactcaactttgccaagagaacttagggttctggggcagagaaattcaggcgaagttaatatctcaacccaaaatcaaaaagagacaacaaatttagttctcttagaattttttaaaattaatttttaaaataactttgcaatagaactagctctgtgatatgaaaacctggtttttctgggaggaacattagtactaggacattctgggaagcaaaggaagctagtgaacccaaaatgttcttttaatcagatattaaacagctaagcatcatgaccaaatggaagccttaaactgcatttgtacagaggcataatagagtcacaagttgttttcgcctaattgtttctaaattgcccactttactaatttgataattacagtagacctattattttggttttacataggtccagagttacagaacctctaggtcagaagggacttcagaaatcaccttacccaatcaccaatctgagacatgactcaaaaagttatgtattattagagtaggctgacaatttggactgtgaccttgctcatcctggatcctgtccttcagttgttatagttgaaagtcacattaatttttctgccatgccacagtgttttcttgatgtcagtgactgttttcatatgtgatactgttacatcttttttatcaaaaagtctaatggattctgtcttaagaacgagcctttattgaaaaatctctgttgaagtttgtcatggtatacttagtatacttggcttattactttaacttatgtagattctgtcatgtcatatattgttgttgcttttagttccacactggtgaagatcatcaagtgctacaactgtctttgtggcagttaaatttcagtgctactagattttactcattgctcttcttgtaatgccccacgatttgatttacgctggctgagtattacaagtcctatgtatttctttccattggtgattcttatctggagctttaacagaaatcagacattgttcctctgttttggttatttatagatacatctggaaagagttttgagacaacctgtgggcatacttaacatactgtaccttttttctttgtagccatcgtgtacaactgctttaaaaaaattagctggacatggagaagtgtggaaaccattgttctgttacacaatggcaaaataattgaccattaaaatatacctgtgatagacttagttgtgatgtggatgcattcatggtaagcctctctgagttattctaatgtatgtgaacaagcagtattatgtaaaaatagaggaaaggatatgctataaaagaaatacagtttgatacagtatttatgttttaacagatatgcttgagtactttaaatagataaatgaaaaaactttctattatttgtagtaggtctatgttatacacagtagtgtcctgagaaattcttgagttgtgacatacatataaattttgaatacagaagggataagttcattttagaaattactgcaaattttgaattggtagagccatcaaatttgtaaagcttgggtcacatttacttctgtgcattgagtgtcattacattctgttttctttaattttcaaacaaagggttgtaccacgcttctctttgaagaggccttttggtttcagcacatctatgggtacgttgttaacactgtcatacctccagttaaggaatggtacacgtttagagactgctttttcaagtcaaggtgccaattatttcctgcctaagcactattttagtgaactcactttagtctaaaatcacttgttatttatctcagaatgttattaaacaaggataaaatcaatgcaaagccagcgatttatgtaaatcttataaaagtttgattttctttagatttttgtgactaacagcctctcagtcttccttggacaggggagtggttagagtttgggttccctaattctctcatcttacagcctaagctaagcctcaatggttgatactgaagttttgtgaccctcgttcaatgttcagaatctattattttagtacttttagtggggaaaaaaaattctgctttacttcttttcctgctgtgatgtgtacattgtgttatttttctactgggtgtgatttttgttatctttttcagcttcattgaccataattttacttattttaattaacatggatcttattaacagttttctctcctgtacgtttgtgtttgtgacatactcttcactacatacttgaattaagtaattttattatttttcatctttcagcagtatgcttattcttggttcatttactgttttgaagcaatggaattacttacatatttttatttttccttttctctcatcttctgttttccaacctctacctccatttggtcctataacatgataaaagtgcaaacatgagcctgaataataaaggattgcttcactgattgctaaacatatattatagtgctttaaaactcatttcaggtcatcgtggtggcaattagtttgattacaagcatttaagctgtcacatagaaagccttccacttcctagggcttagtttcaaatcatgaaaactgaatgctctatacttatctatgtacacagctcaattttattattttggaagaaagctatgcctgttacaaagatcactcataatttcagaacctggttaaagccagtgtgcaattttggagcagagacacaattttattaaaaaatttaaaatatgcatgtgtacatatatgtaggtagggactatcaaaagagatgtcaaaaccatctatttattctcatttttggatacagtacacattaccaagttgttacaatgtggttatttaaatatcatttgggccaggcacagtggtgcatgcttatagtcccagctgcttgggaggctgagttgggaagatcatttgagcccaggagatcagtgttggagtgtgctataatcatgcctgtaaacagccactgtactcccatctaggcaatatctcttaaaaaaaaaaaaagtaaaatcatgactctcatacattatacaatctacatgtttaaacattttatttaataatgacggaagtaggcagatgttataactttttcaaaggtaaaccaaaagaaaatccacagttatagatgaggaatattgaaatgagtgtgtagatggaggcagaactggcttcaaggaagtcagctgagtctctacctcacatgacagagtttacatgatgttagagaatgtttattttgcattgttatcacttacctacaacttccagacttgtaaaatagtttccatggaatcagaaattaattatgctggagagtgtgctatagacgatgcctagtgtttccttgaagcacatgttttcctatttgatgaaaaatagtcttaaaggaaggtttgtttatttaaatttggcctgatcatttacacgggtgtaccaagaatgttaatttagcatataagccttttaaactttgctttctctgatgtttttacaaaataaatctcctattgcacttttaaaagtattatttgctgtcctaagggtggaaagccaaacccaagaatcacggaaaggatcactgaaaggagtgatcaagcatgatcactgaatggcactctagaagtcttcactcagcccactggtctttctgtcaccggcagtacctgtaaatttgggtgaatttctttcttcttgatgttcccaaaatatcccaaagtaccctaccaagaagtgatctctctttccatctatgtggctggattctgtaaaccagctaccaggctagtttttctgggaggattggtactttatagagataaagtcacctttaattccctgtaagtgtttaatcatatctgattaaatgagcattactcacaaataggacattccagacaagatcttcaagatttttcatactcatcttggtaaataggaaggccaatttttactgaacccatgtaaataactgtgttgctatgaaaagtaagaagacttagagtttttggattctggggtgtcagaataagattccattttaaaacacttcatttcagtttataaaatcagaattgttatgagttataaatagcttaagaaaaaagagagcttccttatattctcagataatagaacactgacataagaccaacaatactcaaaacaatcatccttcatcatttcattgagtcctgtttaattaattcttgctgtactgaatcttgacttattaatctcatcaactcatctcatgaatttcttgactgaaagaagttctggaaatcttgactcagcccactggtctggtcaaagttatttaagcaatgacatcagaaacctgtacccaagagtctattctttgaagtcttaattattttaagtacctggtgcagttttttttttttattgtgggtgctctgaggttgtctttcttatttgaaaaccagaactctgttctactgtgttactgaatgcataactttcaaggaaacataaaagtaaaacaaaaaacggtgtaagtgacagactttacatggctgtggttaattttcacttacaacttttaaaagtgaaaaatatgatgagaatttataacaaaaataatgtaacgtatttgattatttctgtggcatgtaaaacaaagctagtaaagaatgttttacacaaaactatttaagcaaatgagctcatagaaactatgaagattttaacatatttcattacttttcagactcaggtattacaaagcaaggtaaataaaattcactttccatgttctgttctcattatgttctttcatattttggaacaaaataatactttacttcaagactattcatagggtgttccatgaggtcagaactacttccatagtatttctaagatgttattaccatgcagtatgctcattattgctagtttgaaatgaatcagcaagtcagcattttaaatttttttaagttccaatttttaatgttgtaaatatcaatagttaaaacccacacacactctcatagacacaaaataagctcattgaggtcctcaataagttttaggagataactgtaagcggtttggagaccaaaaatcttcagaaacattgcattaggacacaggtgttcttttccttgaaaaatggcagcatacacataattatatttcttagaaactgttgcttctagatatgatgtcaacttcttgcattagttttaatttttaaccaaattaactaacttctatttcacataaaaaaactgggggatagttacgatcttccttttccatatcagcattttagaggagatcatgaataaacataaccaactttctatagccacacacatctcttatgcaccttcataaattgacaacaatgaacacattcattaacttgacccaaagatagtcttctctgtagattataaaaataaaaagcaaaacgatgaaattttaaattatgattagtgctcagtgttttagtattctatcttaattagaaatggtgtaactatccaatgaatatctgttaattaatttaatatcagtctgaggtttcaaattacttaaaaatcttggaaattatgctcaagccaacatagtaagaagcataattactattgaagaaaagtttttgagaatattgatgcagtttggtcaaagaaaaataaagacaaacataaacataaaatagaaataatgctagcttatttggccaggaaaccagtatatttttaggtaaattatctagtgtagagttaaaatgtttactcatgtacttaaaactgataaagaagacttactgtttttattaagccaagatttattaaactaatcttatttggcaaagttacacgtaaattaagtgaacttgagttcataaaatgtttccgaggtaatgtatgcaagaatttattgtttaatttagtacatttaaatggttagagattcaattcttttctgtgaattttaggaatatttagtatatgtaagcacttacactgaataaggctattagaacaaaactcctttagtcttagagactttataatctcattattaataccatctgaggtaggaaaatattgtgcacacaatgaaaggtaaaggtacttttgaattgtagaccctcagatgtgtagaaagcatacagttccaattctagaatttcagccataggtcaagagtaaatacagaaacacaaaaagtttcactagtccaaattgcaaagagctattcctcttcccagtagacatgctgttcttaattatttgagctcaaaacagacacatagaccatcagaaaatactaacagactagaacttttttttctcaagtgttttaagtgatagaaatctaagcttactgtgtggcacatttcttaaagaagcttttctgtgtttaactgtacattttgtagttagcattttcattctcattgataaattcaacagacagcaggccagtcagcctgttttaggttctgtggatatagcagcagtaaataagacaaagtttctcttttcatgacactcatagttaatcaaattaatccctaatatgccaggtgataataggaatctaaagaaaaatattcatgaaaagagttgggctttcagtaaagaataacagggactgaatttattgttctattagaaacaaccaaaacaaaagataaaatacatgacacaatggtttgcatgacactggacataaggcagtaaggacagtgatccctgaaagaaagtaaacaaatgtagtcatctctttgagtgtcccagcttcctgccttgagagaattccaggcctccatgcagggcagagggaattcagaagtaccaagtggaactcagtagactttctgcattaggagaagatactgagagtccaggaagaacaaggtagcaaaaattcaaaggacagagtattaggggggaggggtgatgcacggagaaaggatcccagagatcttcagaggattgctttccgttattcattagagagttaattagctcatgcatttcaacaaacttcctgatgcctgggaaagaaccatccagaaggattagaggcaacagtgccttacattaacccatagccaggaacagtgctgattctcaccagcaggattggaaaaaccactagactcatggggcatagagtcaagtacatagtagggtcttgtctcagtattgagaaataatcagtcattgactgagcagtgctacagtttgccgtgacactttttattttttatctttttgagacagtttcattcttgttgcccaagctggagtgcaatggtactattgtggcccactgcaacctctgcctcctgggttcaagcgattctcctgcctcagcctcctgagtagctgagagctaatttttgtcatttttttagttgagatggggtttcaccatgttggcccggctggtcttgaactcctgacctcagatgatctacccaccttggcttcccaaagagctgggattacaggtgtgagccaccacaccctgccctcccagcacgtttaaaatgtgagttctgatagggtcaaactatttcaagtgacttaactgaattctaaaaccattttatggcattcaattacgaattaccagacattcaaggaaccaggagaataagacccataatgaagaggaaatcagtcaatcagaactgaatcagatgttagaattaacagagaatgatattttaaaaattatagtggtattccgtatgttcagacagttaagtagtataagagcaaaattgaacttctaatgtaaatactacaaggtatgaaataaaaaatatattatatgggattaacagcagattagacattgcaggagaaaagattagttaacttgaattcatagcaacagaaactagccaaaatgaaacatgaaaagattagagaatttgcagattgaacagagcatccgtgagctgtgtgaaaacttcatacagtctaatgcatgtaaattggagtctccagagagaggagggtgagaggacaaaagtaatttccaaatttgatgaaaatagtgcagaacatcagaaacataaagaaaattacaccaacacatattataatcagatttctcaaaaccaataagaaagggaaaatcttataaatagccaggaaatagtaaaaagacataaatgcagaggaacaaagactgacagcagatttttttttttctggaaaaaaaaaatgcactggagcaacatccttaaaagtactagaagaaaaaattgccaacctagaattgtatacccagtgaatataactttcaaaagacatggataagagaatgagatgataatccacaggctaggagaacagttttgcaaagtttgtatctgataaaggacttttatgcacaatatataaagagatcttaatattcagcattaagaaatcaaaaagcctagttgaaaaacgagcaaaagatttgaactgatgtgtcactaaaggcaatatacaaatggcaaataagcacatgaaaagatgctttacatctttaattattacataaaagcaaattaaaaccataataggtatatagtaatatattattacacacctattaaaatggctaaaatgaaaatgactgactacagcaagtgttggtgaggatattgaggaattgcaactcttttacacactagtgggaatataaaatgtacaaccataaactctagtttctctttagatcatgtaaatctttcccctttttaaagatacaaccaattgagagaacagtttgataatttattaaaatgttatatatgtatgtacaatatattctagccattccaatcctgggtttttacccaagagaaaagaaagcacatgtccatacaaatattttacatgaatgttcatagtagctttatttgtaatagccccaaattggaaattggccatatgttcattatcaacttaatgaatgaaaatttggtatattcatacaacagaatactacttagcattaaaaaggaacaatgtattgatacatgcaacaacatggattcatctcaaaataattatcctgagtaaaaaaagaagccacacaaaaaaggtacatattgtatggttccaatttatataaaatgctagaaaaagctgtttaatctacagtgacataaagtagatcagtggttgcttggagaggcaggcacagaattgggagggaggcattaccaaggggcaggagtaaacttttgtaggtgatgggtatgttcattatcatgactgtcaggatggctccacagatatatttataggtcaaaatttatcaaattttatcctttaaatatgtgcagtttattatatttcatttatacttcagtaaagctgttttaaaatgattataaaaactatttccctgctgttgttaacaccctgagatgtctgcctcttttcctatctttctgtgttttaaatacaccagcctactgcactttaatacctctctagctcagacagctacacacaaaacttactctgaagaatgtcaaaatgcatgttttcatcagagaaatatctcatggtcctttgttaaatgttcaaaaattcatgattgggctttataaggcaaatatgtcctgttttatagaattacgggagagaaaatgcatacaaaagagcccaatcctttttttggctggcttttatgtcagagctcaaaattgctctctgataaaatgtaggccaccagattgaattacttcattgaaccactgctgtcctctgttaatggtaattgcacagatatagcagtctttctcggcaacatctcagatatttacctcccactgtttttcaattcaaacctttgatgaaaatattcccagtacttctttaaagcagacatccaactgtctttcttgacaaaagcaaggtctctaaatcagatcctgacaatttgtgacacagcagtctatccaaatcaccttttacctatgtcactatgtcatttcctgaagaaaaaagtgtccatcagacaagcaatttctgtaggttttgggggctggaaggttggtatgccagcaaaaatgagagaggaaaagggaaaaataattttttcctttgacttgtgtggaaggaattcagtgaggggttgaccagatctaataagcaaaagaggggttttgtatatttaaaagatacatttttataaagagagatctatagatatttgttattttcaagatggtaacaattgaaacttgaatctagtgatttctgaaagctgctccctttaaggagacagggaaacaaggttagtttttttttaattcttaactttttctgttagactactttaatatgacaatatttagcagtttattttctcgtcagggattcagctcagtttctggtctacctcctgtcctgaactgagcagactacatttcctcacatgaaggttgtaggttgtacaaacaatgccactggcatgaaccatgatcagcgctctccacttgactcatggtgactttggaggctggagtgcagcacatggtaaccaggagatcagctggatcagcctcagagtgaaactcgctgctattatctctttggctatggttggttgggtgctttttttttcccttttagtattggaaggatataattgatacttgctttcttggatcaaattgtagcatcatatgtttgactgatgggttagttgtaggagctgtcagagcccccctgggacctgctttacaggtttggtgaatgagcagctgacagcacagcaagcacactttctgctgccagcctggttttgttcttcccaggtggatgtttcattataggaatgggcctcaaaataacatttgcccaggaatatttctagagagtggtcatctttggtggcactgttatggtggtatgttgctcatttagagtggtctcattcaagcaagacccatacatcatttggggagaacagtgaggaaaaccgtgggctgagctctggggagggttcgatctgggaataaggcatgtcctagaatctcagtcaggattctactttcaagagacagtgcaaggctcctaggaagttggggccaggaggtaattaaagaggtagaaagagaaaatcttttaaaatcaagtttctgactgcatgggctcttgaatgtggtctttactttgattgtggcctcaacatacaggtggtagcagagtccttgaagggcccttgacttttttttttttttcagagatcagggaatttgtaatttagaaggagaaaactggcactcttgtgccagtaaagcctctgctgatagctgtgtgccgtttgtttttaatcctttctcggtatccgtctctggccatccttatctttactagaaatcaaaggctgtgaagggaccaccagaaaaataaataattcatagcttttcaaagcctgagccccaaatactcaactttcaaagcatgagccccaaatatcccttcccttgggcttgaatttgctaaactggagcctgtgtttactctactagggtaaccaagtattcaagagctcagagaaaaaaggactggccactatacctctttggaggtaagagaggagcccgtgtgagttcatgtgtagaagaatcactttcacctggaatagaatgtcaatcccagaatctcactatctggcaggcaggaagtgataccagtttctggcttggaaaggacatctgaaggatcctgttggttttgttttgttttgttttgtttttttctcctgttggttttgtctgctgacacgtgggtagtgctgacccagtgtctgaccggattgtctccatccataacttcatctagccctgtttacaaaagaatgaacacaagtgacagcctcagtgaacctgcaccatgaggatgcccttacttctcccacactctcactttcttctcttcttggctcctcttcccctgtacttctctctgttgacatagaatatgcaaagtccaagagatgtggcaatgccagtaagagctaagttacttgcagctggcggtgccacctgtgcctatcaaatttcagccaaagcaattgctttcccagaatgccctgttttggggaattggaaagtgaatctgtaggggcggcaatggctgtatagaagagagcttttctctgggctcaaatatgaggacaaaattgtgaagtaggactgtagataatcccaaatccccacttttgcatcttcctgagctcagaggcaacccaagagatttccgagttaatcctttggactttaggtgaactctcagctagaaccatcgtttgcaagcagatctcctgtggaggtgacagttccataacctatcctggtggttgtatagttgagaatgtttgtgattccttctctctccacaagacctcaccacttccagttatgttcattttatttttgtttagtcatttttgtgcttagggaacaatttttcagctttgtactctcacctcataaaagtcctttgtatcattgtgaaaaagcaagtcaaggcctggcgtggtggctcatgcctataatcccagcactttgggaagccgaggcaggtggatcacgaggtcaggagtatgagaccagcctggccaacatagtgaaaccccatctctactaaaagtaaaaaaaaaaaaaaaaaaaaaaaaaaaaaaaaaaaattagctgggcgtggtggcaggcacctgtagtcccagctacttgggaggctgaggcaggagaatcgcttgaacctgggaggcagaggttgcagtgagccaagattgtgccatttcactccagcccgggtgacacagtgcaagactccgtcttaccaaaaaaaaaagcaagtgaaattgacattttaatttagtctgactgcatttttctataattttctaagaatttgtcactttttagtattttctcttttctgataaactgttccagcttttcatcactttttaatcagctttcatcagttttatcatactcaacctctggtatttttctttgtatgctctctttttctcctttttttgttttgttcatgagacaggtcttgctctgttgcccaggctggaatgcagtggtgtaatcttggctcattgcagcctcaaccacctgggcttaagcgatcctcctatctcagcctcccaaagtagttgggaccacaggcacatgccaccatgcctggctaattttttattgttttattatttatttatttgtttatttatttattttttctttaagagatgggggtctctccctatgttgcccagactggtgttgaactcctaggctcaagcaatcctcccaccttggcctcccaaagtgctaggaggcatgagccaccacacctggctcttttctgttgttcattctcttcacccttgtttagatcctaaagtgacccaggcacttcaggatctgaagatagctggatgatgatgagtcttcttaaaaggtagcattttatagcaaacatgatgtagagccactgaagggttttatagttgctgtcctcaggggctggatttttaaactggaatatccatggggactttgaaaattccacctgctggggctctacctcatttgagaaccactaccttaataagttcatggccttacaatgggagtgggaggagaggtgactttggagcagacaattacaatgtgagtgacagttatctctttcatgagtactgctgtacaaactgggaatgcctgatctggttcttggagagggagtggaggttaacctgatttatgtaaagttgtagtggtcatggcgggggaggaggttgcattccatgaagcaccatttggaaagacccaaagtgtggggcctggttatttggaggacctggagatgttgttggaatgcttagaaattacaggaatgaggataggaaggagccagatcccaagtggtcttgacaagtcttgttaaagagttttcatttcatagtgcaagtgatgtagagccactgaagggtttcatgttgtagaatttattagatgtgtgtgagagatagctcactcagttagttttgtggaagatggctgtgtaagcatgagattggaggcaagaacttcaggaaaaattatgatgatgactgggagagaaggtggacaattctagagatgtttagaacacaaaattgacaggacaaagtcaacgagtcaatgtggcagtgatttatagagaggcctcaaggataaccaagtatctgctttattcaaccaagtgagtgctggtacaattcactaagagaggcagtataggggagtgaataagagcacatatttgaatcctagacctgccactcgcctatgagttacattttgggtgtattcatttttaagacgtccatgggatgagcaaagaaagagatcctgtgggagtttgagtctggagctcagagaagcagcctggacctctggtgcacgtgatccatgcagtccatggatcagaactctttcaggaaaaaaaaaatgcggttattaggacaagtgttgagtatgtgtgatttttatttctttgtgatttagctggaggactatagagctgaccagaataaaggcaataaatatataaataatcatctacctatgatatactcaaggcaataaatatataaataatcatctacatatgatatgagtatatcattatctgctgtcattattattagtgaaggcatgttacatatttgtttggaccacagcatactttcaggaaactcttgataaacagctttcttttttatttattgccctgctttcttttgattgcttttgccgtagcatcaacctgcatcttattttaatcatctcctctctgaacattgatgattccgcagctttgttagaatacatcttgggagattccattttttaaaggctctttcaagggcatatggcattagatgattatgatatggcgcatttagaatatgccatgatttctctcctgctgaatccctcacacgtgtttgaagtaattattatcctctctgctagctcatgagacttgttagatcactatttgtgggtgtcataaaatgttggcaagaccccagtgtgaaacgcagtgtgaaatacatgtggttaaacttctctgattttgtatgtcaatcaaaacaaaatggcttaaaacagtagatgaatttcaaaagaaacttcaggattctagagcaaaaatgacacatggaactctttaggtctgtgttttgatatttaattcagggagtcatacacaggaggacgtatgcaatatagtagaatttagatgtgttatgattatatctgataatgttacaaatactgagcagctttttgttacatcatatttggtcccaaaatgtcatgccatgcaatgctgggggtgtttaaataccaaatttatgcatattttcaaggaagaagcagataatcttctaactatacagactgtgttacttatcagaaataatagtttatgaattgtcaaacagtgaaaattttaaaccatgtatccctgataatacttttatgtcttcattaagcatcactaatactgaatatgagtatctatctgatgaggaccttagaatcttattatagttagatataacaagattttatttattgtttttatcatggtgaagggtatataatgtcagcatgatctctcctttagttttacctcttctggtgttttgcagtcttaaatgggtgtctttaggaatatcccttatttctagttttagagctcttacttctagttttagagcttctacctaataaaggtataattagattggtcttttctgcatttattaatcaaagactattcttttacatgtgactttttagcaacatccataatttaagtgatatttgcccaaatattatctgtactcccacctttacaagaggatttaataacttaatagagtatgttatagtaatgagttggatgaccaaatatatttcaactaatagaaagaccatgatgtagctgctgaaatacctgagaaaggtagcttaccatataaagaaagacagctaggattttgatcaccttcttgctttagtgaatgatgctagatcttcctccaacgtaaatctttctgctcactttaattctagatgtgtgaattcttgacttgaggactttgatgtcagatttcacctacttgaaggcccattggaagaataacttctaactcattaaacaattccccatttagccaaagttagtctcatagatgtctgtgatggcttgttaggtggcacagtgactaaatttgatgctcagaaaagatggtcttaacaaagagttctttcttttcacacaagtgtaagctttctgacagttatcacccaaaatgcatcttgttattgttgtcttttctactcatggctgtgagtgtcagacactgtgcttccattcactaacatgaagacatttgtgaaagggccttcatcaatatctgacactggtgaattgaagaataatatactagctacataaaactgtgtttattcttcctaaaccaatcattgctttttgcagcatttccaatgaaattgtgattttttagcagattcttctttgatggagctgtgatttgcaataatcttgtcatgccaggctcaaaatactactaaatgaagacatttgtggaagggaatgattgtaaattgcatgcaaatttcaactcggctggaattaatcaatatggaaacagaacttgtgcgttcctgatataatgatgctgaaactaatcccatggagttctatttccgtgggaattaggcagttattttgctttaaatctatctctctctctcctttttttacccttgaagacaaagtcctgtttttgagttttttaaaagtaacttctttggggatttagagaggttataaaggaaacaggagtaaaatcaagcatctgacttcccctgtggggacatctgacatttcctatttaatttgctgtgcttgtttaatgaatctttcccccaatttttcttgctagtttttttttttcactgaaaattctaaggcttatgagatagtaggtgatgcaatctttattctatgttaaatatgcgacactggtctctaaatgggatgttctttcttttacaccagtttcttagggtgatcccagcttatccttgatgaaagctttttgtttttgttttttaagtcgcttttggaggaacaggtcaccaaccttgactttttaatgcctgcttacattcaaatttctcattttctttgattggcaagattaggtttatggccttttattcttacacttggcaactagatcggttaaccttagattatttgttccccaccttttcttcagctgtttaggtcacaaatttgtagaaaggtcttatcattggcatattttgtaccaccagtgcatcagtgctatactcatatatccttagaggctgacaacttacttcccagcccctttggagtactttaagaatccctttatttatagcccagcttaagccccagtgggtaacactccataaacctgcagtgacatccagtggcctcgtggtgtaattttttacaaacttttctaaaaggaattacaggggcagtatttcctgtcaaagaaaaatactgttggagttattgaagggggtttcctaaatacatttatgtacaatagttactggcatactccttgataggattactaggagaatgattattcattttttggtttttgagtgaaggattaacggcctctgatgaaatcagctttattccaagatcagataaaaaatataaaattgaggacaatatttttaagaggacaatttttaattaaaaaaaatcaacagtgtagaatttcctattctggatagatttaagaaataaaggagaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaaaaaaaaaaaaaagaagtaaaggagaacctttagtttgtgcaactgatcatgaagtttaaaattctatgttgttccccttcttggttcttgtgcagtcaatgtctttgagagtcttcttccactgtgttaactctttaattttctcaaaccacctaagactgctactataaatcagagccaagagattcccaatctgattactgtctttaattgtattattaaacgaaaacatatttttataaaaatgatgccccattattataaaatatttacgtggtagaaaaatgtacgaagaaaatgtgagcacatcagtgcaaatcttacccttttcacagaaataaccagcgttaacatttggtaaacctctttgaaaatgctctctatatgctcttttatattctttccatgcatatatattgatagaacgataaataaattggaagctaagaaataatttcatgatactgaattgaacgacttataacggctgtgtttatttggtttgtaattaccgcaaaatgttatactaggtggggagaggaccaggaagaggtttgctttttttaaaagagatgactttgcctttcttgtgacagggagggctggctaggcaggatcaggtttgggagagggtcaatagagaggagtggtgtgcagccacctcatggctgccagctatgaggtttggtttagataagttaactgaggctggaatgggacagcatagttcatatgtttaaacacccaggacgagatgttcccagagctcagagagttcatacgagtaagtctagcatgtagaaactaagccagtagaatgttccaaactgatgctaggcacattcataccaaagatgagtgttaggttgtggtggtggggggggggggggcagagggggagggagaaggagagggagagatctttagatatctttagcaattgatactgaaccagaaatttgaaatttagatttcgctctgtcatgcccattccccagacacttctcagatacaatgcaaaagccatatgctactgggagagaggcaagaaacctgtttgccattctagtcctaacaaagattagctgctgtgggggaaggactatgaatctccccctgctttgcaaagaaatggggcaaacgtcgtttgcagttgagagagatcattttgcccatgattctgcactaatgcactgatcctctacctctggtagaggaacaggaaactttctcatgcccaagatattccaccaatacaaggcaaaacttggcttccccgtgggagggatgtggggaagaaaactgattgtatttcataccctgaactgagtaggaagcagagattacatgtcattggggtggaggaagaaatgctaagaaagtcatgtacttgagtcccagatgtgcagggctaggctaagactgtgcttggagcaggagaactgagaaattctccttcccccctccaagagccttcaaccataacaaagaaacagtaacaggcttgcagtctactgctagaggagtggcaagagcatgggaagaaacgcagacaccctgcaatgcttatgtgcaggtcctacttaggtcctactgtaagtttagggtggatcctgaacactgagaaaacctttttgacagcaaaaaataaaataaactttcatttctatatagatttagattacaaagttatgcaggtagaattctcgtataaaatcaatctagttttccctgttgttacatcttacacttgtaagatgtagttgttataagtagatgtaattgttataagatgtaattgttataagtagtaaaccaatattgctacattattattaaatgaagtacatactttattcaaattttcttagtttatactttactgatctttttctgttgtagtatcctatctaaagtaggatactatgttgtatgtttagtcattatatctcctcaggtgcctgtaagactgtgacagtttctcagatagtttttctttttgatgatagttttaaggagtactggtcaggtattttagagaatgttcttcgattggttggattaaaaaatttttttgatgtttttctcatgattagaccctcagttggcctctgttttgaatcttctagactcacaaaagactatgtcacagcagtctatcagaggaggaatttttatcctgtggtgcatcaacactagttatagcaacagtaaaatacagacacaattcaactactgagtagatttattcagtccccccatgctaacagcttgaaagaagtagttacccatttccaggtagaaatattatttacctgagtttcttttatacataaagtttgggttcaattaaaaaaattatgacatagacacactcacgtaagataaaaaaaaaaggtgactgttcaagatgtaaaatagtcaacaaaatctgacatgcaaacttcagacagggaccttgaaataactatgattactgtattaaaaggtttaatggaaaaggtggacaatatacataaatcgtgatgtggaattttagtagagtgatggaatctgtaagagtcagaaaaaaatgctagaaatgaaaaacacaatatcatatatgaaaaaattttctgtgggtttatcaacagacttgatacgatagaggaaagaataagtgaccttgaggataggctaataaagcctttcaactgaaatagagcaaaaagagtggaaataaaaaatggagcattgccatagaaaatttcctgaccgcctaacatacttcaagagagagaaaataggctagaagaaacgctagaagagataatggctgagaattttccaaaatgaaagatagccaaccacagactcagaataaatatgaagaaaagcatacctacgtacactgaagtcagactgctgaaaatcaaagataaagaagtcttgaagacagagaaaaaaataaatattcatgcagaggtataatagataaaagctcagtacattttatgtcagaaattatgttagtgaaaagagttggagtgacatctttaaaaaactgaaagaacaaataccctcaacctagaattctgtatccaggaaaaatatattgcaaaacggaaagtaaattaagtcttcgtcagatgaagcaagagaagttttgctagcagaacaggtctatctgaagagcttacaggaagctcttcagacagtaggaaaactcttcagatagcaggagtacgctgctctatagaaagaacattttgttctacacaaaggaatgatggacaccagaaatataaaaatatgaataaacagacaagacattttttcttctaatcttttgaaatgagattagagtatgggttgacaatgagcctggtatggtttgactctgtgtctccacccaaatctcatttcaaattgtaatccccacgtgttggaggaagggcctggtgggaggtgattggatcatgggggcagttccccactgctgttctcatgatagcgagtgagttctcatgagatctggtggtttaaaagtgtgtgacaattcctgcttgcttgctctctcctgctcccctatggtaagacgtgcttgtttccccttcaccttctgccatgattataagtttcctgaggcctctcagtcataatttctgttaaggctgtggaaccatgagtcgattaaacctcttttctttgtaaattacccagtctcaggtagttttttatagcagtgtgagaatggaccaatatgagtcaaatctaacatcaggcttgttttgtgcagcccatgagcaaataatttattttaagggttgtaaaaaatttttttaaatatagaataattaatgcatatgcaacaaagagcatatatggcttgcaaagtctaaattatttactatctggtgctggtttaaagcaaaaataataattctatattatggggtttataacatgttaaaataaaattttggcaataataccttaaaggatgggagggaggaaatggaaatatactgttgtaaggtttaaatggaaatatactgttgtaaggtttctgtacaatacatgaaatagtataataacatttcaaagtagactatgataagttaagaacgtatattgtgaattttagagcagccattggggaaaaagataaagtacaagatataattaacaagccaataaaatgaaatcataaaaatgctcagctaatacaaaagaaggcaaaaaaattaagaaaaaaagggaacaaaagaacagatgactttttttaaagtataatagtacatagataccatatcatccttagcaataattacactaaatataattggtcagttaaaaagcagagattataaaattggatagaaagtaaaacccaattttgtgctgcctgcaaaaaacccattttaaatacagagccatgactattttaaagcaaagaggatggaaaacagtatgtcatgcaaaccctaatcaaaagaaaactggagtggtctgggcttatgcttataatctgagcactttagaagtcggctggatcacttgagttcaggtgtttgagaccagcctggccaacatggtgaaaccctgtctctgctgaaagtataaaaattagccaggtgtggtggctcatgcctgtaatcccagctactctggaggctgaggcaggggaatcacttgaacctgggaggtagaggttgcagtgagccatgattgcaccactgcactccagcctggatgacagagggagactctcaacaaaaacaaacaaacaaaacaaaacaaaaacagaagtggttttgttaatatcaatacagtagacttcacaatattaccaagtataaagcatggtatcacacacaatatagtgataaagggatcagtccatcaagaaaacaagaattcatcaagaaaaaggcctatgtacacaataacagagcttcagaatacataaagcaaaaactaatagaattataggaagaatagacaaatctactaataaagtttgagatttcattgctcatccctcacattgatagaacaagttaacacagattaggaaggacaccaaaaacttgagcaacactaccggtcaccttgactcaatcaacatttatagaatgtgcccttcaacagcaaaatacagttttttgtccaaatgcacatgccatactcattgtagacatattttgagctattaagtaaatttcaataagtgtaaaagcattgaaatgatgcaaattatgttcactgaccacaacagacttaaactagaactcagtaacagaaggatacccggaatgtcctcaaatttttggaaattcgataacatacttttaaataacccatatcaaagagtaagtctcaaatctaatttgatttttacagtttacatgcctcttttttctaggcatttaaaaaatatacagaagtacagtctagactgcacatgtgtatataattgatgacagtgacattctctcggaatttatattaatgtagtgcacaatatatttgaagtacatttggcataaggacgtactaagtcacaagacttgtttggggaatgtgatttctttggataaaattaaattccttgaacttgacaactaatcaggctgaaaaaatacacttgaagctttctgatacattattaaggaagttacagaatatccatgaatttagttagctttacactccagtggtactcctgagtattttgtaattgaactcgttgatcttcagatgtgaattggttcttcagatctgtgaccatcagtctgtctacaaacatttatgcaggctctctgagcaagatgcctttcctcacggtggtttctaaactctcccaatattttcagctgcctgggtaggaagcattagggcagacgcccaggctggaatgcagtggcgtgatcttggctcactgcaatctctgcctcccaggttcaagagattctcctgcctcagcctcccgagtagctgggactacaggcgctgccaccacacctggctaatttttgtatttttagtagagacagggtttcaccatgttgactgggttggtcttgtactcctgaacctgaggtgacctgcccgccttggcttccctaagtgctggaattacaggtgtgagccagtgcacctggcctgctctgcttttaaagaagcagaatttgtctagatgtttttgaagaacattatgtaataaaatagcagtaagagtatgaattctcgatatgtattgaaaattagagtctttaaaagtcttggtgtttagaaattaatattagttttaatatgactctttaataatgaagaatataaagttctctgtgtgctggtgagaggactttttatttttactcctggaaatacatgatttgtaccagtcacttgtgtggccataatatttttgccctaaatattaggtcatcatttcctctttattgttaggtaacccagaatgctaggtattctctaacagaagaaaaaaaaattggtttgcagtcctggtaagctgttggagattttaataatcccaataaaatatttccatttttcaaatgtgtttagatgtccttggcagatttagattagttacatgagatggatagaaaacaggctcagggcttagggtttattttgatgatttttaaaatttgttgaaataagagttgttttatttaaggaaaaaataatatttctggattaagtatttcaaatgcgttatttttggagagatgctacagagcttatgtcaaatgattattaatatatatatattttttttgagacggcatctcactgtgtcacccaggctgaagtgcagtgtcgcgatcttggctcactgcaagctctgcttcctgagttcacgccattctcttgcctcagcctcccgagtagctgcggctacagacacgtgtcaccacacctagctaatttttttgtatttttagtagagacggggtttcactgtgttagccaggacgcttttgatctcccgacctcatgatctgcctgcgtctacctcccaaagtgctgggattacaggcatgagccaccgcatacggcctattaattcttaaaaacaattgtgaccatgatattagcacctaaagcactattccttttcttagccttgggaagacttcatggtcatgaatactattaatttgattttttaaaattatgagtgccatatggctgtagaatgcagaggtttcatgaaatatattcagtgagaaccagaagtgatttactaatgcctcaaactcatttaaatatctaccaattcaacatataaaattgtcttcacgagaaacattacggggtatgattttgtatttgatcataatgcttgctaattatttcctgttagtattactggtaaaatgggggttggcaaattctagatagtgatgccacatatgtgtggtgtgggttccttacaaaactttatttgctgcttaattttgtaacattgcatcattccctaaatagcctcaagatccaaatacaattgcagtaatacttgctgaaaattggaaactattaaaaacattcatttgctgggaatcaggagaggggagggaatttcaaataatagaggtttttttttattaaaaaaaaaaactcacaaaatctttgatccactgtctctcaaaaggcaatttgatagctaaatgcaagtattttttttttttttttttgagacagggtcttacttcttcgcccaggctggagtgcagtggcatgatctcagctcactgcaatctctacctcctgggctcaagcgatcctcccacctcagcctcccaagtagctgggtctacaggcatataccaccgctaatttttgtatttttgtagtgttggggcttcaccgtgttgtcaaggctggtcttgaactcctgagctcaagcaatccgcctgccttggccttcctggtgggattacagggattacagccactgcgcctagcctaaatatattaataagttttaaagttttatattatttccatttctattttggtagtaaaggtaaatgaacaagcattatagatcacagacatttaggttaaaaggtccaagctctttgagatgggatatactagggacacgttatcttttttttttttttttttgagatgaagtcttgctcttgtcccccaggctggagtgcggtggtgcgatctcagctcactgcaacctcactgcaacctccacctcccgggttcaagcgattctcctacctcaccttgccgagtagctgagattacaggtgcctgccaccacgcgtggctaatttttgtatttttagtagagacagggtttcaccattttggccaggctggtcttgaactcctgacctcgtgatccaccttcctcggcctcctagagtgctgggattacaggtgtgagccaccgcccccggccggggcacattgcctttataactctatttaattcccttgcttgcacgttgaatagatctaaatgactgggggaaaagtaaaaacatagtctttagtccctttcattgtggtaaattcactgaatgatagacggaaatttcagccttcttgggtctactgccaggttctgtagttatttgtatgtctcatggagaaatcctcattgattacactgtatggctaaactgacttaaaacagataactgagcctatttcaaaattgaaaattctttaaaatggaaagttagtactctattgttcccaaactgttggattgcatgccattttcccaaactcacagacgttgataagatttcaggcaaggggaacaaggaaggggtcacagtggaagcgaattcttcccctttttctgactgtgtttgcccacctgtcctttacccttcgcagttctattctgagaggtatgtgaggaagatgggagccactgctgctagattgttgccattaaccagctttcatggcttttgtgggagcctccttttcattagtatttgcaacatgttcaccagcaaaatgattatgttaggcagagacatcacatcacttacatttcatagctcagtgcaattttcataaactgcgaggcaacatccaaaaaaaacatgactcagaattagagtttcagaagattattatatagacattatttccctcaggtcacgggctttagtcaaatttggaggagaatgaaattgccaacagtgaaaagcagacagaaaggtatgagttcatgagcagagaaataacattttcatttgttccttccccatgggaaagattcagcattccggtaaatggagacggttataagaaatgaatttttgtcagcagggatgtgattttaaggctcacttatccattggcaatctagatttctaaccccaggaatctgggaaattgctacagaatgtagtctttattataaacaagtttttttttttgggggggggtagtttttccctccttcttttcttggtcagagctttttaagacgaaggactacatttctttctgcatttctggggtcagatgattgcagatttcccatctgccctgagtttctctccattgctgttgctttgtgatggaaaccctttctttcctcctcaccaagcttccctcactctgtcgttgcttttcctaacccccctgtgtttatccagcacgacactgacaatattgaaagctgcaaacttcctatatggccatggagtggtggatctatggcctgatctctctgttccccagcatttacaggatgtcttgtgctgctgctgattctatatcctcagttcttttgtgtctgtggacctgaaagagcaaggcaggaaatacagctttccaggtagctctcattttaccaggtataaagagcgaggatttgcaaggtttctgtaaggtaatcccagacaaccttcttcgtaattaaagaacgttctttcatgggaaattttattttccttcttcgatttcatcagatgcttctcagcccatcactcattcagattctatgcaatggttctttttctagctagagtacatccttgagagtagaaaatatttcatataatctaaacccttcatttctagagatgcagatagattctgtaacattaatctcacctttatattttttcaatttttaataacttgaaaatatgtatatctaatgccttctttccctatgcacttttgcttattttaatatttctcaacaccataagctatttgcccagctgcatccttattagacagtgctattgcctgccaaagctttttgagagcaaattgcattgccttcattattattatgtctacaatataatgattatgaaacatcattattatagttgattaataaatgataattgatgactctcagttcataggatttggcccatgaaattcatcacaatttgtaaacttttctccaaaccttcaaggattctaaaaggattgattttgctgcaaagtatatgcgattacattttttgatacctagtaagtagtagtggttgaggattcactggcctggccagagtgagggtgtatactaaatgtctgtggggtttcaatttcttcctattgaattcttttaaaatgtagagtctcttaccactgggagtttggggaacttcgcacagtggctcatgcctgtaatcccagtactttgggaggccgaggtaggtggatcacgaggtcaggagatcgagaccatcctggctaacacagtgaaaccctgtctctactaaaaatgcaaaaaattagccaggtatggtggtgggtgcctgtagtctgaggcaggagaatggcgtgaacccgggaggcggagcttgcagtgagccgaggtcgtgccactgtactccagcctgggcaacagagcgggaccccgtctcaaaaaaaaaaaaaaagaaagagagaaagaaaatgttgacggaaggcattctatctcagtctctgcaatgagccattcgcattttgtggaatcctttctggcattaattgggggacagaaacagcatctggcatatttacatgacagtagcatgtacttctcttttatatgtcattcattcgtacttccaataagttcttttctaatatgagcatacattgctttattgtgcttggcagatactgtattttttacaaattaaagttttgtgtaaaccttacatcaagcaagtctgtcagcaccgtttttccaacagcatatgctcacttcatgtctctgtgtgacattttggtaattcttgcactatttcaaacttttttattataattataactgttgtggtgatctgtgatcagtgatctttgatgttactattttagttattttggagtgacataaacctcgctatataagaacagtgtgtgttctgtttcaccaacctgcctttcctctctctctctctccttccctggccttcctattccctgagacacaacaatattgaaattaggtcagttaataacactacactggactctaagtgtttgagtgaaaaaagagtctcatgtcactcacttgaataaatcaaactctagaaatgatttagcttagtaaggaaggcatgttgaaagccaagatgggctgaaagctaagtctcttgcacctgttggccaagttgtgaatgcaaaggaaaagtgattaaaggaaataataggtgctactccagtgaacacatgagtgataagaaagtgaaacagcccttttgctgatatggagaaattttaggagtcttgatgggagatgaaaccagttacaacattcccttaagccaaaacctaatccatacaaggctctctgttcaattctgtggagagtgagagaggcaaggaagctgcagaagaaaagctggaagctatcagagtgtggtttaagaggtttaaggaaaggaactatctctagaacagaaaactgcagggtgaaacacaagtgctgatggagtagctgtggcatgttacccagaagatctagctaagatcattgataaaggtggccacgttgaataacagagttttactgtagacaaaacagccttctattagaagaagatgccacctatgactttcaaagctagaaaggagaagtcccatgcctagcttcaaaggacaggctgactcttcgtaggaggctaatgtagctggtgactttaagttgaaaccattgcttattttatcattccaaaaattgtagggcacttaaaaattatgccaaatctgccctgtgctctagaaataaaacaacaaagctgggatgacagcacatctgtttacgacatggtttactaaatattttaagcccgctattgagacctactgcttggaaaaaaagattccttttaaagtattactattcattgataatgtacatgatcacccaagggctctgatggagttgtacaaggagataaatgttgttttcatgcctggtgacagaacatttattttaccattcatggatcaagaagtaatttcaactttcaagtctcattatttaagaaatgcatttcataaggctttagccaccgtaattagtgatttcctctgatggatctgggcaaagtcaattgaaacctttagcaaaggattccccattctagatgccattaagaacattcatgacatataggaggaaatcaaaataccaacatgaacaggaatttggaagaagtttattccaaacttaatggatgtctttgaggtgttcaaggcttcagtagaggaaattgctgcagatgcatggaaatatcaagagaactagcattagaattggggccttgaaggtgttactgaatttctgcaatctcatcaccaaaattgaacagatgaggagttgcttctttatggatgaacaaagaaagtgttttcttgagatggagtctactcctggtgaagatgctgtgaatgttgttgaaactacagcaaagaatttagaatattccataaactcagttgataaatcagtggcggtatttgaggattgacttcactttttaaagaagttctatgtgggtaatatgctatcaaacagcttcccatgctacagagaaatctttcatgaaaggaagagtcagttgatggagcaaacttcattggtgtcttactgcaagaaattgccacagccacccaaccttcagcaaccaccagtctgatcagtcagcaaccatcaacatgtatgcaagaccctccaccagcaaaaagattatgacttgccaaaggatacctgcaaaaatccatccaccagactcaggtgtttgttagcatatttttagcaataaagcatttttaaaattaaggtaactacattgaatttttagacataatgctattatacacatatagcctaatatgtctattagttttagacataatgctatcaattatgttaataacttaacataatttttgtgttcactgggaaaccaaaagttcatgggacttgctttattgcaatattcattttattgtggtggtttggaaccaaatctacaatgtcttaggtattcctgtattttcattaagaagtagtatgactatctcacataaaggctgataacctggaagacacttagatttcaatatagtttggaacctgtctggattccatgtattacttcaacaggagtgaagaatcccatagtctgatgaatttttgcaggtattctcttcaccataatgaggtttcattagggttactgctagaataggattgtttgttattagtttccaatgaaggatggaatattctcaatgtaggaattcatagtacgtacaagaaagctatagatattgttagtataataattatacaatagtagtagtataataaaatattcaagcaatcacttaataattacttcaagtctcactgtctgccctccagaatcaggagcaggatgtctgaactcctcattctttacacttttactcaaaagctcttaactctagagacagtctttaactttttggtatttggtttcttcttttgtgcaatggcaatgattctgcctgtgcaaacaactgtcaactgtttttctcagcagtgctagtgtaaatgaagttgaatattaggaataattaaccttccttgcttacatatgccatttgataatgctcaatcttctttgttaagaaaacaatgcagtaaaatctttgttaattgagatgaagtgttgtttatttaaatttggatcattctgaaaaatatatttgttccaacaggcttattcctgaaaatctttctaaaatatgttcagtgtctgtctgccttagaatggtccccaaatataattgaatctctctctggtgatgggttgtcttgcacagcctaggacccatcatactggagtgcttttctctctgaatcaagcagcagataacggaatttggactgctttgatctcagatcataccctggaagttgtgttttaataagtaaatttcttatatgaattgttttcttagtgttgtacctcattcttcataaaagtaaaaagtatattagcaagttacagaacaagaagtatcatgttgcctaatcaatgcaaaatatcatcatttcctagacaacttcacaggagacatagcatgattagaaggtcagacttgattaaatcccgtgctttgcccttagttttttgaaatttcaaaggaggcaatctctctgtcaataaattttcaaattttataaataatagtaatcctgatgccagcaagcagttattgagctttgtgtgccaagtactgttctaagcatgtttcaagtaataactcacttcttcacaatgagcctttcaaggaggtactgttattgacatcatttttctagtgaggagcctgaggcttagattcagaaacctgtgagtcgccatatagctagtagctggccgagccatgatttgaacttagctgtgctcaaaaccaccacaccatgatacctcagagatgaatgtgtgcgtggtggttatgggagaagagaaccacatttacttattttttgtctgggtcttgcatggtgttttagatcatttcatttctgttatttcattttgaaacatttctactataattattatccatattttacatatagggaatctagtctcagaaaaactgaagcttataaccaatattttacagctagtgataatgagggagcagacatttgaacttgacaacctaaattcaggttctggctaggggtttcgttaaggaaaggaaaaattccctccaacaaaggtcatttttatgatgtgtaagtgatttaagctttctgtataccaccccaccccttacaaagatttgtgttttcatttttaattaaatctgtctgttctgcattctcattgtttggacttttttcaaatcattgctaatacactggttcttcttcctgttagtggtttgtggttgactggttcatcttctaccgttaacataattctgttttttttttttttttgaggtggagtcttgcgctgtcaccaggctggagtgcagtggcatgatcttggctcactgcaacctctgcctcccgggttcaagcgattctcctgcctcagcctcccgagtagctggggctacaggtgtgtgccaccacacccagctaatttttgtattttttgtagagacagggtttcatcattgttcttatttttatttgtcattcctggaaattaattttgctttgagtttgggacccctaacatgatgtcctttagccccgtgaagagtgaatgtccctgtggtgccattagccacttgtacagtgtcctgagaatattttaagagaaatatgaatggcagtaccacttggataccaattaaaaatacttttttttttcagtgaaatacgtctttaaacctgcaagacacagagggttggttctcttggtttccttagtcattattgacatcatctataactttctgttgaaataacaaggatttttatggaaagctgtttttgttcctgttcctgttgccagttttcacatccttatatattattaaagatacagaatgggcttttaatagatcctacaggccaggcacagtggctcatgcctgtaatcccagccctttgggaggctgaggcgggtggatcccatgaggtcaggagtttgagaccagcctggccaacatgacgaatccccgtctctactaaaaatacaaaaattagctgggcgtggtggcaggtgcctgtagtttcagctgttcaggaggctgaggcatgagaatcgcttgaacccagtagatggaggttgcagtgagctgagatggtgctgctcactccaacctgggcgacagagggagactgtctaaaaaaaaaaatgtaggtcttatggagtcacagagtcttaatgaatctccattgttatatgacagggtcttatggatgtcttttggaatgcccagcagcaagtgggcagcttcttaacaacccactgtgactcatgaggaagtgtgtctttgtgttgtttatgactgtgtttttatgggtaggacttcccactgtctcactttcctggcttgccttctcttctgtttaccctggccccacctttggctcagctgggcactacgggttttaccagagtcagttggaatgcaagtgcatcacaccagctctccatctccctgtggcattttatggctcagagaggattggaactaaaccttgggtggctcatgatcggttgtacccagccaagtctggagaaatggagaaaatgcctgggtttgttagtctacatgtccttcacattcttacagacacgtcttttgagtccagagaaatgtaaatcttttcctttttgtttttagtggtttatttctcaggccctgaagcatgagttttggtcacccctacagcaggggagatttcttcaaaaacagctgtgattatccgaaggtgttacattgtgcttttcttttcatgcatttttagcacctgcacatcatagttttcccgggaacctccagcagtgtcacctgctaacttggcagactggagagactctcaaagccatgtctgacttctgtgtccatctggattatttctgtcacatgatgatttggcagatgttttctgcagatctctagctctggtaaacaatggtgaactgggcccatatactcaacttgtaaagagtgatttccccaaaaacaggagacagacatttagcaagataggggctccttcatgtgaaagttgatctctaaggttagtataaattttctgatctagagggaattataggactctgaggcccacccttactagcttgccaccaggcttggtataaccttcattgcaaatgctaggattcatgctttggttgtacatgaaggggattatttctgggtggtattttatctcctactctcagactctttcagatctagctggatgttcaacataagccttttgtgtaattcccatgggctgtagctctgtggcttgagtagtggtcacaggagctctaatgccagaataaatgatgctgctaacagaaaaaagtagggctcatttctctgcaaaatgctgcacaaagaagactttctttgcttcttctggtacatgtggtaagcgtagaaatagtttattatggaagtctttcagccacaggtctttctaaggcaaaattgtatcctccagggaaactaaaataaataccagcctaataaacttcagattttaaaaaataagttatcatattgcatttctgtaagaagaaaaatatgaaaggttgatgtgtgtttttattccactttgatttacttcccaagctgtcctgtcccaattcaatcttaaaatggaagaaaatactttatcatttgaagaaggatgaatgtagtacagaattcaatttttaagaattcaaggtaggggaagtaaattttgatgccaactttcaagtttttaaagaataaaataaaataaacacatacacacacagttggctttgtgttggaagttaatgatagatgtcttctcggtattctttgcaaaggaagtcttccatccaggctttccctcatttgtttttaattacagtcatggtctacctggccttctcactagcactagctccctatgccttttgctttgctcttaggccgggcttttggtccctccctcctcatctctggttctctcgctattccttggctcctcttgtcttgctgcccagtttggctcaggtacatgaactgcaacctacattctgccatccctgcagctgcacaagcctgtcgttttccatactattgtattttcaggtctaacatgtcccctttttactgccctttctcagtctactttagtggttattatcttgtcatcaatctctttaaatatggctaggctccgaagattcctctattgactattgtgtttgctttattttataaaatttattattaaataaagctaggaaatgtaatataataggcttccatttacccaccacccagcttgaaaagcaattctgaatttgctatttatgttactaatttctttatatatttttcacatatgcaaatcaacaaatatatagtatgcttatattttggaaaattgtatcttattctttatgtgcttttttaactttttaaatggaagatgatgcttgtgagattaattcaggttgctatgttttgctcttccactactgcatagtattctattttaagcctatgccaccatttattctatttatgagcattcagattgttttcatttttgttattacgaacaatgtttctgtgaacatgcttgtacagatctccttgcacttctgtcaatttattatttcagcatattttattgagcacctattagtgcttggcgtgattgatacaagactgctaaaacaagtcgtatcttgaagccatatgctttagagagacaaacaggcaaattctgttgtaggagtcttctcacctatcttcttatttttatttcactcctcctttgtcatatttcacagttctgctaaagttaacttttttttttctttttttttttgagatggagttttgctcttgttgcccaggctggagtgcagtggcgccatctcggctcactgtaacctctgcttcctgggttcaaggattctcctgcctcagcctcctgagtagctgagattgcaggcactcgccaccacacccagctaatttttttgtatttttaatagagacggggtttcaccatgttggccaagctggtctggaactcctgacctcaggtgatccgcccccctcggcctcccaaagtgctgggattacaggcgtgagccaccaagcccagctgagctaactttttttttttttttttttgagatggagtctctctctgtcacccaggctggagtgcagtggaatgatcttggctcactgcaagctccacctcccaggttcacgccattctcctgcctcagcctcccgagtagctgggattacaggcacccgccaccacgcctggctaatttttttgtatttttagtagagacggtatttcatcgtgttagccaggatggtctcgatcgatctcctgacctcatgatccgcccatctcggcctcccaaagtgctgggattacaggcgtgagccaccacgcccagctgagctaactttttaaacatagttttaatcattactgttattgtcaaaaacattcaaagtctccctgttgcttatgtgataaagttgatactcctcagcttgccattcaagaaccatcctagcttaaccttttctcctgtttacatctcacccatacacctttcagatgccagtgtcatttccctttcatgcctctcagtgatatttctttacccttagctatcttgcctgttttgaactttatccaggatgttgaggctttactcagttttcaagatccaaatgaaatagtttattattcctcttatacccttcgtctaagtgtttattgcagatagtgggatatgcatttgtttagctgactaggagcaggaaccatatggtaattgcctccaacatagtaggacctcattaattaaaataataatttataatcaaatcgaactgaatggatcatttggttctcagctttgctgttaaaactctttaatggtcctaatgggaggagggagtagaaatagagtgaatgttttagttttctgttgcttttcaaatgtttctgactctcaataagtgcttgtagcttactaaccgagcaaccattctaagcgggatccttaccacatcaaagtgggataggttgagaagaaaactggctttagtaagagagacagattcttcataaaaaaaaaaaaaagaccatattctcaccttagtaggattgaactaaagcatacttaaaccagcttccattctcatctcttggtcacctcctttctgccttttgggtggcaatacacgttgatggcctgtcacctatcatgcccttctacttatctccagtccccagggtagaaggcagatgtggctgcatgtgaataaggggaagcccgagtccactgtgtccgcgtttccattttgaaggaaaatgggagaaatgaggccagtggtttgataaattatatcaaaaatagtcccttcatgctaatggagtgcgaagaagctgatgtactggagatgatctataatatttcatatttctctgaggagaaaaatgataaacttgatgatgtgcaatttattcatgtttcttcagatgagaaaaaaaaatcctcaagtcaactaactgcctgtttctcactcctggaagctggcatgtggattttacactgggattggaggctgggcttgtttagagaaatgcctagagagactttgattaatcaccagacctttggcagttggttgggagagggtaattacgctagcattgccactattttatcatcgctattttatggctctacaccgccaggtgacaaatgtgttaattattgcatttcttatcctggacttctcttgcctgccccctcccctcatggttttggcccttagtccttctctgcagctcagccctggacggcagtaacttgtgcaatcaaagagctgttctttgggagccatgctgagagggacagggctatcagccctgctgtgtgcagacgctaaccacggggagctggttaattccctttcctcttccttctgcccatcaccctttgggtcaagtgctgctcagagccagaagctccactggcttctttaataactgaaaatagcacccctggactgggccatttcactctaaatagccccctggaggaggttagaaacagaggttgtcttaggcaaagagatttaggaggtaaaattgtcctttttctgtctttttcttttttttttttttttgttgccccttctgtctttctgttacccagagaaagcttcacaagcatgcctgtaatttagttgcaccattttattacagctgaaagaattgaatgtaaagaaggaagtttaatagaacatataattcagcagatttattgatggggaggtatctattgtagtttggccagtgaaggcaggtcatagaggaaaatttaggtaagtcggattttctttaaaaagaggcccaagagttagtacctcaggattttgttttcttctgttccttgggcatgctggaaatttgttagctcttaaatcaacaacttgttattgacagtcatctttttgctggagaacgtattaaaataagtataattatggtgcctgacctcaaaaagaaaaccagttggttatataactctaaaaagatgagtagccacagagtgtagaaagccacagagaagagcaaatgccattgttgggaagcagagcctatgctgggtaaagtttcctgggagtttcatcctccaagaacaagaatttcttcttctgaccctccaccttctctggaaatggggtgccacatcttttgccttctggctaaatttttgtttattatatgcctctttcactagaatgcaagaacatgactacttggttatgttcttgcttgtaatccttgtttttagaacaagacctgacaactcgattatggtcagtatatatattttttggatgtatgaatgaataaatgaaatgagatcttaacatgtaactatcttcttttagactacacagggttttgactataattgaaatttttaggcttcttcagctctctcttttttgggtccaaaggatgtctcaaaccaaataagaaattccttcttattgatctagtggttacagacaagagacgccagccttctttgtcttttggaagttaggagtgtgtccctgaggaaactatgccctgggaaggttctttatttataatacaaaatttcttttttgtggttgagctagatacagatatttttcaatttttcctttcttcgaaggctatattttggcttaatctgtacttacagcataactattcatgctaattataattcatatatgaaaatgcaccaaatatgactattagaagcttttgaaatactgtttgatactttgcaatatagttatttatgcatatctgcatttgattttaaacttcttgaagtaatgttttatttatttttgtatctccattgctcagcaaagggtggcacatagtaggtccttcatgaactaatattcactagagcactgtgggaacttatttgcaacacccttggcatctctcttatccattggggatagcaagtaatttgaactgtcaaaaccagtggtgttgctttgggcctaaatgacattaaactttttttttttttttttttttttttttaagaaacgaggatcttcctatgttgcgctcgctagtggtcttcaacctctggcctcaagtgatcctcctaccttggcctcccaaagtgctgggattacagttgtgagccaccgcacctggccccaacattcaactgttttttctgacagtaactaagaatgggataaatgcctctctgaggcctttcccagtttgtgaggccacttgtcttattatttgtgattgcaggaggacatgcatcatattcatctaaaggttgaatacatttatttaattgtggcttgtgaagaaagaagagctaatatgtggtcacgttttatgctatttaggatcgaaaatcagtcagtcatgaagccatttcttttcattctacttttggagatcatattatgataagcttttcagaagcattaataacctagactcaagcctatgtagtttggaccttcatgtctttacatgtgtagaatcaaagagcaataggagttggtgtatatgtgacttgagaagcctcacatcattcttggaatatgttgtcactagtgtcatcagtggggcctacgtgccctgcctgccaactcaggaaaggcgtgagattgagggatctagatttagcatttattgaggaaaaagtgttgtataaactattgaaattttacataaaaaacaaatagatctgttttgggaaatgaagattttcaaaagaaatatggtccattttgaaagagataattgcaggatatattttagtgtggcctggagcttaccaatcagaatgatattttgacattcatggtgtcaaaaggtaatttctttttgccttgaatcttatgcttgaagtatgttattcatgtagctatatataatgggattacattttaggggaacttcgggatgatatgtaaaaatcctgaagaagttgtctttgtgttttaaaacaagaaaaacttgacacaaactggcttacaggaatgtgtttcttgcaggtttcccttagaagccacacaggaggcagttttcattggctgatgatgtttatgggtataaaaaagaaactttgggaggatttgataaagtctcttttcagcttaagataacatcattttactcacgttagagcgtttgtgtgtgattggagttttgatggtggttatatttttggctttttttaatgtttgttgcttactgccattcctgaaccaaaagataagttgttcagataattgcaaagacagattatggtaatagtgatactaatatctaacatactacattaaatatgtggaatttaatttaattttttgagatggagtctcactctgtcacccgggctggagtgcagtggcgtgatgtcagctcactgcaacctccgcctcctgggttgaaggattctcctgcctcagccttctgagtagctggaattacaggcgcccgccaccatgtcccagttaatttttgcatttttagtagagatgaggtttcacctgttggccaggctggtcctgaactcctgacctcaggtgatccacctgcctcagcctcccaaagtgctggcattataggcatgagccaccgtgcccagccaatatgtgtaattttaattatttagcacttatagcaattttataagatgggtactttgtttatccctattttttagataaggaaactgaggcagcagaggttaaagaaacttgcccaaagttaggtagctaataagtagtagaagcaggattcaaactgaggtattctggctctgtaatccatgctcttctatgcactgcctttgcaaatctaatttcaacttgaaatgagttcagtggattgatagtagattagtaggggagccattccaaagagtttcttataattaagtgaacttgagaatgtaactggcaacagtgaagagattcccactctatttcatctgtaactttctgatcttaccgtggtggtcacatttgttgtaagaatatttatggtggtgtttaggataagtttaaggaaatgttgatcactttttgtttgatctgagatattgatagatatttatatactttataaataggtaattaggtatatatgtaaatatgtaagatatatacctattaattacctattaaatcattcatgctggcctctgggtatttacatgaatttttttcagtaagtcttgcctttcagatatatataaactagattatgcttaaatatttatttggacaagtgttttcctctttagttaagaggccatcttctgaaaaattagactgcagtaaagcagtaattccgcctcagttttccatgagggaagatttgtcatggctactcctacttttggcattataatcacgtgaacttattattcaaattaatggcttcttggcataattttcagaggtctctactgcaaatctcagacatctacaaatcagtacatgtcataataaaaggaagaatacagactgtcagacatactcaactagtcttctttttttttttttttttttttgagacggagtcactagtcttcttttggaatcacatcaggaaagggaagttgttagtgcttatgccaggtagctggaagacatctttgtgatatttatgaagatcagccctgttgggcaatcgttgcctctgccagaatgacttacccatttatctaataaagggaaacatctaaattcttgaacatgtaataattcacttgataaaattcaggtttttataaacaaatcatattaaaaccccaaaagttaattaacaggtgataaaccttgcttttacttccttgtcccatcacattcattcatagtcataatacactgacaattattgagtgcctttgatgtgccaaaagcacttgctaaatgctttgtttggaaagggatgtttgttaattggggtggtacctcccaaataatgaaacatacacacttttgttttattgaggatagggttttatcattccacagctgttccttgagtaagatccgggcttgaaaggccaagttcttctacaggggcggatctttgaggaggaagaggcaggtagctaggaagggctaggaggctacagaggttaaaagtggtctgagattagggagaatggctaaaagtgagtgagattttctctcgtgtgtgaataattgtaggaagagattctggacaacatatgcagaggaacaaatggagggatggtctttagtcagtggaagtggaaatccattggatcatccatgagcccatctgaaatcagcagcccgttaggtagaagcttgaaaaaaagaactgttgtgtttggtgaatatatcacgattttggagaatgatgagggcagaatcctgcatcctttctagctttcttgagaactttgtacgagagtcactcttaccatcatctaaatataagtgatgtgtcctgctgttaaggaattccaccatttgctagctagtggacataaatgggcatcttgttttcttttctttctttctttcttttttttttttttgagacggagttgcgctctgtcgcccaggctggagtgcagtggcctcccaaagtgctgagattgcaggtgtgagccaccgcaaccggctgcatctttttttctttattaattatttatatgtctggaagtctagatatatatttgtcttcgggaatggaaaggtaccaataggaaattttgagtaagccagagtattctagcaaatataggaattacgccaagaacagccagaattgcccagcactagtgataacctggtgaaaagaaagaccatcaatttatgtgttccaaaaatgatgtcagcattgcaagaggagagctgactgcgtaggctcatcctcatttctcaggagagtgtgcctgtaaatgaccaaccaattacaagcagatgataatgaagcaaaatgatgtaaatcaagatctgaggagtgacatttatggccaagacttgataaatatggaattggagaaagaagataggaaacaccagaggaggacagcaaggactgtagttttttttactgtggataagcccaactccctactgtggcattgaatcttggccaggcaatagtttgattgctgatttccttagaagggaaggattcttgtgtaggattaaagtaaaagtaattccatgacaacttgttactgaggaagacagccaaatacatatttcatgagtaagcaacagtcattttggtggaatatggtgtgttacgtaaagcttggtgctagattaatgcccaggtgaccacttggaggacaatcagtgtagccctgtgaaagatacaaagtattgcctgcctaagtctcagtttctttgtctgtaaaatgtgtgtttaagtggagctgtgagacaatgagaatatatgtaaggtgcctggcacttaacagttgttcagtttctctctcttgagcatcctcaaagctccttttattgatttctttgatgctgaaagaaagagaataaattttgactgcacgatgagcttcattttttgaaggtgctgattctcacccccatttccagctacattgactatcgttagccacttgttacccatctagtgaagccatcttctatagtgcagtgtgtgttagtaggaaaggcttatttggccttgaagggctcgtttggccttgatccggtactgattgtggtttgaggttgagcatgttaaggatgaatagtagctggaatggtccatgatgtgtgcttagtatccttcagaatgtttacatagtcatatttagattgcttctgagaacaagagaatacagaacaaaatgttatgttccaaataaagatcacaataagaagaaatattgcccttctagcttggcatcctttttctgccatgatttccctttgcattttcttcccataccttagctttagccaaggatacagcagtaagtgttgcttggtatttaatcaaattaaaacctgtgctaggtaatgcctcatagattttattttgccaagatagatgtttgaacggaaaaagaaatagtgtatattaaggactaaagggggtactcttgttttctttcaaatatgataattagtataaaactgtctttttcctgccagttggctcatctcatctcctagcagctgttttaaattccttaattgtctattgcttactcagctatcatttcacaaatttcctcactgccgcattttcgttgaagcaaattctgacagtgggggatgctcacctcacaggctgggttgagctgagttctagttatcctctttgagtaacaggattaactatcattagacagtgcattcgggtaaggtgatggttccctaggtctctttggagttgattactatagaaatgggcatctggtggagcctcaggttgccaattgcattactcttcattttactgatgtttcaattctgtttaacccaacgtagacttttttttatgcttataaagtaataggagtttcctagaggatttgcagcgtacactattgtataatctcattgcttataattttttttcagaatgaaggaagtgggtattttaaccatagcattttcattccagtatcattaaccatttaaatacactttgttaaatctatcacattttctgttaaaataatgtaaaattctagtagaaattttaacagtatcttactgtaaaaatactgtaggtaatagaccctgagataagacagtctgctgctttcagaagcatcaacacagagcattcctcaagcatttgatttaagtaaatattattgaagccttactaaattcaatttcagatattgtgctctttgatagcacaatgacagcttacatatgatgctttcaaatgtcatccacttatttctttttttttttttttttttttttttgagacagagtctcctctgttgcccaggctggagtgcagtggcgcaatctcggctcactgcaagctctgcctcccgggtttacaccattctcccacctcagcctccctagtagctgggactacaggtgctcgccaccatgcctggctaattttgtttttgtatttttagtagagacggggtttaaccatattagccaggatggtctcggtctcctgacctcatgatcctcccaccttggcctcccaaagtgctgggattataggcgtgagccaccacacccagcccacttatttcttaatgatgggaaaactggtaatacaagaccaaatttttgtttatacatcaaattatcaactttcatgtcttatttcatagtcatgcattgcaggaatgtgcgtactgcataaagtgacttgctttatcaggtttgaaattcataatacagtcagaagatgattaacagatttgttcaaatttttatgctacgatatgttcttgtccccatgtgaataaatgcaacagattgtttgtaaccattttaattgctctgattttacatggacaatagttttgtataagaaaagacaaaaaaggccaggcccggtggctcacaactgtaatcctagcactttgggaggccgaggtgggtggatcacttggggttaggagtttaaaaccagcctggctaacatggtaaaatcctgtctctactaaaaatacaaaaaaaaaaattagctaggcgtggtggtgggtgcctataatcccagctattcaggaggctgaggcaggggagaaagaaaaaaaaaaagaaaagagaaaagtagtcacttggtttaaatgcctggattttgaaacctaactccttgttttacctctgtagttttaggcaaatcacttaacttgattgaatctcagttactctcactataaaaatgggaccagtaataccttcttcaatgtgatcttgagaagattcactggaataatggtgaaagtaccctatcacagaatttatagtaggtgctaaaaatgttgtgtaccttcctttccttcccttagaaagacagtctcttttatttattgattgtacttttgccaccacagggggaaaaaaatccctgtttcttataaaactttctaggaaattcatgaatttagtgtgggccctctaattctgacaaatacaatattgattttgagtttgttgctttaaatttgccaaatgaaacgaaagttttacggttttccttttaagtcacttctgatatgtggagcaaacaagtctgtatttaatagtaagtagtttgctaattgcaaagcactaccaacttaacacaacttaaaatgagaagctgagagggggccagagcatgaaataagtaagtaggttaagaactgccacacagtccatcatgcttgcagagaagaatgtgagactgtccgaggctacagtgctggtcaccttagcctgtgtaaactctcactttctcagttatcagtggaagacaggggttaatccttattagtctgaacacatcacattgcaatgatctgaaagctaaagacatggcataaaggaactctgaagaaaccacctccactgagactgctgatgcttcgaatggaatttgggcagatggaatgctcatttaaggagcaaatgacatggacggggggagtcaaaatgataaagggagcctccttgcatttgttgtatcttacttctgtgtgagttctggcaaaaagcaagcatgactagaaccctagaaaaacaaccattaggtagatactagttatagtcaatcagagaaagccagtatgtgcgaagagagaagagaagaaaaccacatggtaaaaatgtaatcaaccagtgggattcttttagttcataattgtaatcatagatggcattccactacctttgtcttccatctggaccaagtatggctgtgtctagaggttctgttgtactatttctgtggtccttgaactctgatggcaacctaccttgacaaggccaaaaacctacacaactctgagcctttcttggtagtggcattatctaaacgtatgcatttgtaccttatcaggcttaatgagggaaaagaaacggcttttgaagacactaatgggaaattattataagtcaatgaagtaaaaatgcaaatagatttgtatcttaaaacaggaatactgctagaagctaaaactgagtaagatcttgctctgtgccaagcacatgctattttgcattaaaagagacccctgccttctacatagtatcctcattttacgggtagaaatcttgaggtttagagacgtaaagtaaagtaactcacctaaagttacatagctcatgagcaatgtggcagatgtttaaggacacctcgtctgatttcagcgcctaaatgaagagccttttacaaggatgatgatttttgcagcaacaagacaaagatgtccagcaataggaaaaagattgtaaagaaatgttaatccctgtagagggcactgttcagatttaactcatccaacataattttctaacatgataaagcagacctgcgccagctcctgactgtttcagataggtttgcctctggggaagaaagtgcagtgattcgtgtaacctactgtcagtgttatttaaatctcagacctaatctagaatttactttaataatcttttattattttcctgtatattcttatgatttctcccttctcaatgaataatgaatttagcataatgaattcagttagttctaggcttcttcatatctatatttaatattcaaagcactttcttctcttttattcctgatttaccaaaatctgtgattgtgccatgaaaagatgataaaggagaccatctcttggatctggaaagtgctgcgtgttagtttataactgggcaaatgtaagcataacgtttggccagggttgggtgcggtggctcacgcctgtaatcccagcactttgggaggtcaagatgggtagatctctttaggtcaggcatttgagaccagcctggccaacatggtgaaaccctgtctctactaaaaatacaaaaattagctggatgtggtgacagacacctgtaattccagctactcaggaggctgaggcaagagaatcacttgaacctgggaggcagaggtggcagtgaaccgagagtggcactgcactctaacctgggcgacagagcgagaccctgtctcaaaaataaataaataaataaaaaataaaaaaagtttgaccagaggactacctccattgtctttcttttctacaatccagtttagatactttctggactaaccataacttacatgcttgtccaggagtattggccagagttagagtggtcacattaattctaggcaagggtgaagatgaaggagtagagccatgtttccttgaaggacagtgatgatgctttttagagcttattacgtgtttgctatctctcccatcccaagcagtcaggggttttaactttgaagataataataactgtcttcagtgggtgaatttacatctgttttgacccaaaagataatttaggatgacttatggaatctgaagctaaatgtcaaatgtaattaaatgttactgttgtgtcttgccttaagaagagagctggtgagttctagcagggtttgggaactatttggattaactgctttgattctttcccacattatataagaggtgttatctcagacagcacagaaattgtccctgggggacagggaggcatcacatttcagaagtacctataatatttcttcagcatgtctttgggcctggctttctcaatatttctaccttttcttgaaatctccacttggatatggctctggaagatggcagaaacgccatcttaaaatatacataatatttttaagaaatcagttttgaaaaacaagaagtctcttttcctgacggtccttcctcaatatgcttaaattattgaataggaaagcttcagtaagacacaactattaacataagtgctaaggattaagaaaaagatctgtcacaaattatgtctgtctgtaggaaggtaaagttgtgcctttgatatgacacctacccctggaaatcatattcttttccaagatataaacccaaatcagaatagggagtgagctgttaatatgaatactgaatctggacaggcacggtggctcacgcctgtaatcccagcactttgggaggctgaggtgggcatatcccttgaggtcaggagttcaagaccagcctggccaacatggtgaaaccctgtctctactaaaaatacaaaagaaaattagtcgggcactgtgctgtgtatcagtagtcccggctacttgggaagctgaggcacaaaaatcgcttgaacttgggaggcagaggttgcagtgacccgagattgtgccgctgcactccagcctgcacgacacagtgaaattctgtctcaaagaacaaaacaaaaccaaaagaattctaaatctgctctgaatagtagaagacaatgggagacatttatctttggtagcaacatattccaaagacttaagagtttaaagaaatcatcattttcctatcgcttccttcctttctctctcaatcctaaaatactctctgggcaatcaatttcggaattctttcaaggaaaggaaaccttgattcgtctgcctgttaactactacaaaatgtgtagattcctgctcttccatgttactactcagagtaataacgaaacacctattattgtcattatctggagaaaagaagctcctatactggattaaatgatgttgctgtgcccataagaaaggcaggtattgggcagtaatgaaggtatggcagcaggaatttatactttgtctctttcatcagagtagctcccccctcccctttttatcctgtaggaggaaattgtggagtgagagaagaggtctgatctgtttggggaaaaagtatcacagcctattagttagaagcaatgaaattgagacagctttgggactccattaagtgtgtggtgtttaggcagactgtgtccctgggtaaagtgtgctgttgaagaggatagtacacaatgaaataattgggcttgggaaatcaactgggcttcagcagcctcatatctccttgtggggaatgggtgagggagctacagctttccctcccttcttttagcataaaagctataccgaataaaatagaagggaatttcttgctgagtagatggactgtgaatatattttgaataacacaaacaatggagataattaaattttgtctggcacaggaaggattcagagcatgtcacttggaaccccctcatgccatgttcttctctaggcgtctggatatatggttgcagcaactgaataaaaataactcagatttgatcagtaatggcagcatctatagggacatgttttaatgcactgatgtgtatgaaattaggttcttaaataaaacattattcctggatattttcatttcaaaggataagctgaaattcacgaacagtgtgaactagactgacttttcccactgagatttactgataggcaaacttttgtgcacattgtggacactggttgagggtaggctcactagttttggtactattaatggtcagttgcctgtagaacttgtgaagtaagaaaaggtatatctatagcaagttcaaggttcagataattgttgttctctcttaagaaaaaggttttgagcggttgtcttctttacacttagtgtatgtaatgatagtttggctaaatatgaagaagaaagagaaatagcattactactgtttattaataacttttctttgtgccacacatttagctattcaggcactttgtgtttgtgtgtatacatatacattctcttatatacatttgcgacatgtggtaaaaggccctactttttggagtcagaaattgtgctcatttctgtatctgccaccttgtagctgttggctcttgaacaacaactaagcctctactttgaacatcaattttctcagtaaaatgagggaactagactaaatagttgccaaaattcttagtccacacacacacacacacacacacacccattttgtacttctaaagacactggaaagaagtttacggatggaggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaatagataaaaccacaaagatggggaaaaaacagaacagaaaaactggaaactctaaaacgcagagcgcctctcctcctccaaaggaacgcagttcctcaccagcaacagaacaaagctggatggagaatgattttgacaagctgagagaagaaggcttcagacgatcaaattactctgagctacgggataacattcaaaccaaaggcaaagaagttgaaaactttgaaaaaaatttagaagaatgtataactagaataaccaatacagagaagtgcttaaaggagctgatggagctgaaaaccaaggctcgagaactaagtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacaccacaaagatactcctcgagaagagcaactccaagacacataattgtcagattcaccaaagttgaaatgaaggaaaaaatgttaagggcaaccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatattctttgaaaccaacgagaacaaagacaccacataccagaatctctgggatgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaactcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagacatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatctctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaagaagtttacggataaaagaatgagaagtagactgacattgtacttttcattaacgtgttgaatgcctaaagaatggaaggaaaataagcttaaaattttgaatctatgataaagaaaactattgattaaccatatgcatatttgacattaaaataattcataattaggactaacagatttctggcttaaaaaatctaacaattactttaagaagcaaaagacatttccagaataaagtagggggatatatagaaaagttggtaccttttttaaacagagtcttcttttgtaaggaagtagaatttattcatcaaaggagatttatgaaaagtatggtggtatagtgagtggcctcactagttttaatgattgatatttgaatatagcttagtcttataacaactccccaaataaaaatttaaaattcatttgtatccctttgattttcagtgctaaaaactagattgtgaatgtcaaggaaatatttaagttatttctgaactaatgtatttgtagagagaagaagggagtgtgcacgtgatcgagaattatgttttgaaaataaatgaatgattggctattaaaaaaatttttaagccttaaaaaaaaaaaaaaaagacactgtataaatgttagttgtttgagcatttttgtatatacgtgtatgtccacacacatatacacaacattttaaaataacatcagttattttccctcttttatgtttttattttcctaataattcataccagtgatgtaagatagtggtacccagaccccataatctaagaggaatttgttgccatttgaacaaggaatgtgttgcctcattcatattttcaaaaggatataaatacattgttgtatatctttaggggaaatatatattcagtattttaaccagagttctcactgctgtgttcccacattgttaatatcaggtagtttgcctagatgttcacagtagaagtacagggatgtagaaacatggtctttcttcccaaagaagtcatttttctttaaaatttgtgaaataaatgaattaattgagtcagcctttaacatagtaatccattttgcattattcagctttgattgaaagagacagagaaaatatgttttgtcggggggtggggagaatgggagatagagatttctcagaattaacagggtgctctatagctcaataagaggccctgtatatacagcaggatagatttgtagttagttaaggaaatcttaagtctaaaggttgtaattcccttagaattcctgtaagttaattgtttttcccccactgtaatgcatacccttgaaaggcaggaaccttctgtttatcattgtatcccaagggcctatcataagcacctggtaaccaataaatgttgaactgatatatgaaattttcctgatcttagagattaagtattatcctcatggtctaggggaataaaacatccacacgtccaaaccatagtaattctgtttccatattctgctatctatgggtttcattattttaagtattctaaacttacagagagcaagactaatactttaaaattttattttggtctatagggaaaaaaaaaggttatttgagtttggtgactgtgtccatcactttggtttaccactgaattcacagcagatactaagaagtatctgcattgttttgtttggtttggttgggtttttaaaacagggtcttgctgtgtcacccaggctggagtgcagtggcatgatcatagcccactgcaacctcaaacccagagtgaatggatcttcctgcctcagcctcccaagaagctgggacttcaggaatgcaccatttgtgcctggctaatttttatttttttattttttgtagacatgggatctcactgtattgcccaggctggtcttgaactcttagcctcaggtgaccctcctgcctctgtctcctgagtagctgcaatcacttaatcctttaatagtcccaccaatctattattatctctgtttgacaacttatgaaactgaggtcagatagggcaaatgcagtcatgcaccatataacaacgtgtcagtcaacaacagaccacatatatagtggagatccaataaattataataacatatttttacagtacttttctgtatttagacacacaaatacttgccattatgttacagtactgtactacataggcaactatgctattcagtacagtaacatgctgtagaggtttgtagcctaggagcaataggctataccatagagcctaggtgtatagcagactgtacaatctaggtttttgtaagtatactctatgaagtttgcacagcaacgagatcacttaacaatacatttctcagaacgtatgcccattgttaagcaaagcgagactgtaattgacctaaggtcacacagttaacaagtagtgaggttttaaactaaggcctttgaccagtgctcttgatcattacagagtggtaccaacatggtagcataagctttaagaggagggaaaacttggttcccgtggctttatcagggaagacttcttagaggaggtagcagttaagctagcccttaaagaataagtcttatcttgaactgaatgtatgctagagtcagaattatagaggattagattcagaataaaaggccatctgtttcaagttcctaatttgcagaggagaaaactgggatctgtgaggttaaataacttgttgtaggacatatggctaattaagtggcattagaactgttctcttccctcctctatcctgtgttattccctgtccccctccgttaatgcacactagctcatgttaagtctgttttttcatcaacactttctaataagagttcctaaaaacattttacagcttgaaagtggaggctttcttgtgtatctatgtatggtgatgaggttaaaccaggaaagggtcagggcaggcatggaaggagatactagagatacgtggagacatggagagacagaccttttctatctgttttttgtttttttttcctagcattttactttattgttacatctgtttccttccataagtatagataattgagtgttgagagaaaggggacaaatgaaattctaatgagaaaaaaatgatttaaaattccacaaaatctatggaatttcagcctcttaagtaacctgggatgtttttaactttcactaatgtttattagccagtgtccttcctgccacccacctacaaggatgtctcaaggatgaaatgaggtcatatatgtgaatacacacttaggatacaactgccatgtattggcagtcttgtctgttccctgggcctacactgttccttgcctcaaaatgtagtactatcaggtagtgttgatgtttcattagccaagtggttatatcagatttatgtactgctaaacaattgatctgggacttgggtaaatactcattggaaaaacatttgttgtattctgagtgctccctgttaatcttctcctcctcagatagcaagctagatctgggacttaaggtggatttttttccttatttttttttcctttgttttacccaatgattgaaaatataaaactaaacctttttcagtaaagtctgaatcagcagatacttacattactttggcataggctttttatagactagctagaagaatacagtaattagcatatgcatttcctcattaaaatgtcattagtgaaggctttgttcttttaaggtccttcaaataaggtttattgcattgcattccatcactaatattttaccaggagtcagatatcttacttaggtgtgttgaagcaagggttactttggactttctatagggtaatgacctaagagcagacctggacacacataaatctctatgcttacattgggtgggccctactttatgtactagtaataattaccagtctcttctcacactgtccattcagaatcctttggatatatagacatttagcaaacctagacttgtttgaaagaataaactgttatctgcactaaactgttttccttggttatcttggtaggatttgatttgaaaaaaatgtatgaagaattagaagaaaagaaatttataatgtactataatcatttgagatacagtattatgcaggagtaagaatacaggctttagaatcagaccattgaggattcaaattcttgcttcatcatttactggttgtgtaactttgtgatacttagcctttataaacctcaattgtctgaatgtaatacggaaatatgagtggtccataccttataggaatgtttgagaattcagttagattatgcatgtaaagtatttagcactgctgcctggaatatatgatctattattacattaccggctgggcatggtggctcacgcctgtattcccagcactttgggaggccgaggagggtggatcacctgagctcaagggtttgagaccagcctgaccaacatggtgaaaccccatctctactaaatataaaaaattagccgggcatggtggtgcatgcctgtaatcccagatacttgggaggctgaggcaggagaatcgcttgaacccaggaggcagaggttgtagggagtcgagattgcgccattgcactccagcctgggcaacaagagtgaaactccatctcaaaaaaaaaaaaaaaaaaaaaaaccaacaaaaaattatctttataatagaaaaaaggagtgtgtgtattttcatatgtattgtatctgctttctacacatctttgacttaagaaatcctaacatgaaatttcaaaacaagtaagaaggtatttaaggagtggtcattaatatcattaattggcttaaggcaaactttctttaaaaagtcacacacatggtgtattcaaaataaactacttcacttaatcattttaacatttctgctatgcagcgtgactagcaacttgaaggagcaagttaggaaatgcctttgatgaccccatgacatcactatgttattaaataactggaaataaactgaaaattatgggatagtctttaaggctttcatgacatttcagcattttagggttgcagtattccaaggacttttagagtaattgcatgtcatcctttgtgtgttgtgggcaaatttgggttagctaaaagttggtcagttaaaaaaaatttatattaagcatctactctgagccaggcattgttcttttttgctgtgaatatagtgctgaacaagaacagaagccttgctgtcaaagacgtaacattccagggtaagaaaatagataactcataaagaaggaaatgattaattcagatacttgtgaggctatggagaagataacctaggctaacgtgatagagatgggtggtgaggatgtgagttaaggggaggccttttgcaggttgttgggaggagatgcaagtgttccaagcagaagaaagaagaagtacaaagtccctgatacactaacaatcttggtgtgttcaagggacaggaaaaaggccggtgtggctggaatttggtgttcaaagcaagagaggagagataaaggaagatgagtcatgcagagccttttgaaggctgtgggtaaaatgtatgttatacggaacttagttctaaatctagttgcagtggattaacctggagagtgatgcaaactgagttttactctggaaaaacactgtgactgttgtgtggagaatatgctcccaagtgtagaaactagatcaccttgcatgggccaagagagatggtggtagtttaagactaggattgtagcagtgaaatgtaaagtggttgcattcggacatattttggatagagatttgacaggaggtaggtggattggacatgggatgtaaagtaaaaagaggaagcaaggatgacttccaggagtttagcttgagcagctggatggctgatatcatgtgtaggcatagggaaaggttgtatgaggaagaatttatagggtgtgagggtgtgaagcagggaataattttgttttgacatgttatgaaagaaatgccaattgacggctaagaaaagatgtcatctgggcaggtaaagaatctaggagattgggaaaatgtccagcgtggaggtataaatgtgaaaaccatcagcatatgggattgaaagctatggggctgtttggattccctaggaagagaatataaataaagaagggggctgagaacagagtctcatttataatatcctgataaggaagaagacccagtgaaggagatgaagaaggagaagccagtgatgtaacacaagcatggatcatggcaaaagagaaaaaggtgtttcataaacaaggatgcttggtatggccacctgtgtcagtactgtgaagttgaatatgatcaggacaaataatattaattggggctttatatttctcctttactacaaccgattaatgaaacaaaaaattaacctagcacccaaggtgtttcttatagttggtctctccagtctgttttagtatcatttgttagttatttccccaaactaatgtttagcttctttctccaaaaagaatatattttttttcctggttctgcttgttggaatccccccctccaccatgatataaaagtaatggggcttattgtaagaaaacagaaaatacaagaaaataagggacaagatttttaaaaatggattcaattctgggaacaacaaatgacattggggtataggaattaaaccgtgtgcattctgtctctcaccccaattttatagtcatttgctggggaccttttctccccagggtacttgcatagcttttgtcaagaataacccttctcacttccccacctccttcttctacatgcagatgcagcacttttctgggtaaagttttagcaatgccttccttctaaaatgaaagcattttctcctcacgattagcatctgtttatagaatagttcgtattttcgtaattagatcctgcatagaaatgcaaaggctgctgtgtaaaaggataatgaatctttattgcacagttgaaatcagatttgtgcaaaaggcactttgaaaacagtaataagcagagacatgtattaaatcacccagataaggcacccactttatattttctatttataaatggaaattatgactacccagtggattccatatgacatttcctattaccagcaaaggtttttagctttgaccataaaagttatctaaattcaaaagcctctgtggattcatggctctaagaatacttctggaaggggccaagacagagtggaaagggtcctttgtctttttcttttgtgtgtgtatgcactctgcagaggggaaggttagcaagtggtagaagaaagaagccatttgaaataaccatgataagatctaatcaggaaacccagtgtccattacacacatgtggtaacattttaagactcttctggttgggctccttgagaaccaagctcgtgttcttataagctcatccttatattttcccattgtatgcatcgttgcatggcaaacacaggatttattcccaagctaaacctgtctcttggggtttcttatcttttacctccttggtgagcctcgggaagctagagcattgctctatggagaaaggagggtggcattgggaggaagggtaggaaaaacattattgggaagcagagaaagtcaatgtcaaatgaactgccaaggatgaatattatggctgctgggagcctcggagagtatcgtgtgtcttatgtgtctatttcacagtcggtgcttcatgtgagatggcagtctcgcctggaccgtgcttagtatcgatttactctcaggcatgccagaccattttagcattgctgaaggaaggaaatcctatgtatttccccttataaacagacatatcaaaagtgtatcttttaaacctttttctttctgtcttcttactgttctttctgtcttactgtaactcctcctccctccctgatttaaaagaatttttttttttttttttaaaagaaaaaagactttctggccgggcgcggtggttcacgcctataatcccagcactttgggaggcagaagcgggcggatcacgaggtcaggagattaagaccatcctgattaacatggtgaaaccccgtctctactaaaaatacaaaaaattagccggatgtggtggtgggcgcctgtagtcccagctactcggaaggctgaggcaggagaatggcgtcaacctgggaggcggaggttgcagtgagccgagatcgcgccactgcactccagcctgggtgacagagcgagactctgtctcaaagaaaaaaaaagaaaaaaagaaaaaagactttcttattaagagagcattatacaggccaggcgcggtggctcatgcctgtaatctcagcactttgggaggccgaggcaggtggatcacgaggtcaggagatcgagaccatcctggctaacatggtgaaatcccgtctctactaaaaatacaaaaaattagcggggcgtgatggcgggcgtctgtagtcccagctactcgggcggctgaggcaggagaatggagtgagcctgggaggcggagcttgcagcgagctgagatctcaccactgcactccagcctgggcaacagagcgagactccgtctcaaagagagagagagacagcattatacagagaacaaattgagtagacttttttagaatgatagagtgtcagtaactactcatacctgtgggggaaagaaaaaggcttcaaactttgcacacttctagcccttccatgaaaatagaaggaccttatttgaggctagttttgtggtggtgggatctgagcactgctgagtgttaacaaaagggaataaattgatgccaaatttagagaccaaaaatgccatcattttcacctgcctgaactcttctgttgttttccctagttgctgccttgcgctttttccgcagtacagggagagaaatcagttgtctggctgtctaaactcacggcatctgcttagcagtttcaccagctcatagttgggactcatccctctgtcagaatcctttgctccattagaagggagactgggaccacgttcctgaattgatttgcatacttctacgttacctagctcagacaacatatggccatgtggagcacttggatttatttctgtttcctcaaattaaattcctaaaaaattggataactccacagtttgtttggtgttacaaaaaattttagttccttttttggtcggcaaagcaacacaattttggcattaaaaaaaaatctctggattactttaaaaagagtgttgatttgatttgcttcccctcttctcttacccctttcaggaaaaaaaaaaatgtatgttgaatcttaaaacactgcatcatgttgcaaaatgtccatttaggcacactgaatagaaagtatcatcgagtcatttttattcttgtaattcagtaatcttgtatcttttgcctttttctttttccttaatgttaattgtgtaactaaatgtctcaaacttgggacttttcactttacacatccatgtgtaaaaatacatagatacatacagtcagatagaagaaataagactcagtgttaatagatcagtggttggggtgggggaactatacttaacaatagtatgttgtacatttcacagtagccaaaagagaacaattcaaatgttcttaacataaagaaaagataaatatatcaggtgataggcattctaattactctgatttgatcttcccacattatataaatgtatcaaattatcacgtactccccattaataatactgtatatcaacgaatttttttaaaaaaagaaatagatatcatacaatgaataactggattaatgtgaaatgatagaaaaagttaccattttaggctggatgtggtgacccacgcctgtaataccagtactttgtgagtctgaggcagtaggattgcttgaggccaggagtttgagaccagcctggttaacgatacaagaccccctttctaaaaaaaaaaaaaaaaaagccaagtgcagcagcatatgcctgtagtcccaactactgagggcatagaggtaggaggatcatggatcactggatcacttgaggagtttgaagttgcaggaagctatgatcctatcactgcactccagccgaggtgacagagcagcaagaccctgtctcaaaaaaaaaaaaaaaagttactattttaaatgcacttcaactttgaacagtactaatgtatgaaaatcatcttgtcttctttaggaaattctttgttgcctaaattagggataggtatcatacactggaatgagctctaaaacgatggctcttgctatgggaaacagttttatttgggtactcatgtcttctctcttaagggatcttaggaagaggctacatggtaaagaagaaatagcatgggctttagagtcaagaggcctgagttttaattctcaggctttatttgtccttctgcagtggccttagcaaatattataacctccctaaagttagagttattgtaattgtcgtacatacaatgttatcataagaaaacagtgagataacagatatcaaagtacctgggcagtgtttgacacttggtggtctataaatataaatatcatttcattcctgaaggtaactgcagcacttttgaaaggctggtttgatgctaacacaggaggattagacctaattatatatttctaaggtcttagaaatggggagctaggtttttcagacaatatactgtattttgtttttcctcccttttgctttaaaacagaaggcaatttgtttcaaactctgtgctccaaactggtggcttaattaggcaagtttattgactgtcacagaggctgtggttaaaaactggcaaatatcatgtgactatattagtatctctgagcaaataaagggaaaagacaggattccacccaaccacatttttttctttctcttttctcccaagctcattcttgcactgcaacattccacttataatctgttaattaaatcatttcactccattttatataatttttaatttagcattcattttcaacttagcttttggcttcatttactgataataaacagtgttgcatacaacacatgttccacaaaacactcagtcacacacatacagatgccaataattttttccagtatgtcaggcatattaaaattaaaggcagcatctcccctcaccctttccattactgaatgtgcaccctgtttgaataatacatactccccgacagccagcagtggtctaatgtgtaaaaattatgtgtagcgtgtcactagtacctttttttaaattcgtggttttctcagacatgctctgtggaaggtttctggaatggtcacttcgataccttggatctgtatatttggcttaatgtatacaaacagtaatattttctagacttattactttatgggtttatagctatgtgatagttattgagaaagaaaactctagtgtagcattcaaattacttttcttgtagcttattttttgaatcatagtctgaattctaaatatatgaatatctttaaccgtagatgatatccagaagtttccaagactgcaagctcaggggtttatggaccacttttaaaagatagatactaagccaggcacagtggctcacgccagtaatgccagcactttgagcaagcaagatggactgatcccttgaggccaggagttcaagactagcctgggcaacatactgagaccccgtctctacaaaaagtacaaaaattagctaggtgcggtgacatcttttagtcctagctactcaggaggctgagaggagaatcactggagtccaggagtttgaggctgcagtgaggtatgatcatgccactgcagtccagcctgggtaacagagtaagaccctttctctaaagaaaataaaaataaaacatagatacctgtgttgttgttatagctgttcatatccttagaattaatttaccttgtctgctcctgcatattatttgtctcctcataattagcaaagttccacagggccagatatcaccaaatatgaatagtagattttattctaaggtcagtgagaactgaagaatgttaggggctgactcaatcagatttgtttgtatttatatttggaaaaatattactctccggagaatgttttggaatgtttggcagggtggttggagagacatactacaggaaagaaatgatggtaacttagttggcagtgggaaaagtgagtagtgaattactcagagctctttgggggtgaaatggactggacttatatcagttgaacttgagaaaaggagaagcatcaaggatgatgtaacttttaggtttctggcttgagcagttgtgtaggtggtagtaatttttcatggtgaagatgatgaaatactttttgtacctgtctcatgattgctttctgtacatcaaggtcagaggtcataagctcataaaatgcttggtattagaattcttacataaaggatgtcttctgttttagtttagtaatacaatttggcttaaatcacagactttctctaatctttgttttgattgtcatctgccgagagcttaagacagcaactcacaggttggcccattgagaatctgacaaatgaaaaattataaaaaaaattcagaatccctatattgtagcccaactttctttagcacttctatccttgaatgctagggcagtgttgtatactgtgaagatctttgtagatttttctactctgtaacattttaatagttccattttggggtattacagctgttcagtcctccccatacctcaaattatagttagtctccttcaagtcccaaatttccagtgtacatatgtttcatcttatgtttaatctggacagagtgttggaacgaaatatggaccctgaaaggtgtatgacgggcttgaagtctcagccctactacttgcttaatgtttgatttgctaatccaaacaattataatctgttaattaaatcatttcactccatttcatataatttttaatttagcattcattttcaacttagcagatgctcctggtgtcccacccatacccctctttcccttccactttagttcacaatggccctccttcctcccgctaggccttatattcattcatcttcagggtttgtctagtcaatgaattctgctttgcctaaggagtaggcaggaagtaggtgaaatgaactgctacctgagcaacccacagtcaatgactaatgagagttgttgtataaatacaccagcttccttgcttcttaagtgggataactttgaggtatacattctacactggcttccggagtcctcccagtggcatttgcttctagttgcccatagtggtagttggctgaataattacataccctttattccctgtctgctgtcatgatcttactttcccagtctcctgctattgtttacctcctaaataaacttctcattgtctgcttctgggagaaccccagactaagacaaccactgcgaacattggtttcctcatctttatttattattactgttttttgagacagaatcttgcgctgtcacccaggctggagtgcagtggcacgatctcagctcactgtgacctccacctcccaggttcaagcaattttcgtgtttctgtgggacgtcttacataggcgtattttttttttccggctactaccactatttggactaattattctgaaattttacttgccaagtttcagcttttattagcaagaaaaaatgttatgtccacagtttagaataaaatcacagagaagaaaagttggatgaggatattggtttgcagtcttctgtctgtgtttctgtcttctgagcattcacagatgttcctatccttctttccactggtgttcacataacctgggatcttgtgttgtatgcagtcactctcaaggtaggaactggaagataaagtatgtgggtgacatggactacttagaaggaaactgaagtttacatgttgagcccaattagaagcagctgaagagaggagagaaaaaattaactgagaagtttaataggcacttagagcatggcgaataaagctgagtggcacccacttttcatttcctagttcattctagttgtgcttttttaactgcaaagactaaaaaacgaaagcctttatttcccagtctgtcttgcagctaggattctgggtgtgaatcaggtatatttgctcaagatttggaaggtcgacatgaggtaaaggttattcatcttcagctttagctctttttatctgattagccagggcaggagaagtatgatttttctgtggtgatgtttcagttttcaactcagcttcctagatgttgaaaggcagttatgatgcgatttcctgatcccaggttgcagcttcgctagtgcatttgtagctgggctgctgcaacaatggacttctgtttatggcagaagaaaggccatactttaaccttgtctagtgattttttgtaagaggttggttctctgtattaaatcacttcctacagaaaatttcttaagtgttttctggtttttgtttgtttgtttgtttgtttttaccagaaccctaactgatatagatggttgaagcaaactttatgctgtaaaggtccagacccagataaaaacgagagacaggaaagatgcagcaagatggtctgcaggcctgcccatgcatacactactccatgatctggtgtctgcaagaaaacaaagcaactgctcattaagtaacagggcagctaatgctttagctcttgaggccctgtgtcatataacttctaattcctctaattcatccaccaagggggcagtgaggcagttctctgtttgaatgctacatcgtttctgacttagtgctttgaagtggatgacatcttacttttttttcttatcttagagataaggtgaacagaggaaaaggagaatgatttgcccaacctttggctaaaggagaaaggaaagatttagagtccagtgcttctgacttccctctgatgcggtaacaaggataatatgagtatctaatatgctggggcacagtaagatggctctgaaggtatgcacagtagagaaagccatggtccttgccctcagggtctgtgatcggccactgaggcacacatttccacttcctgtgttccattaattatgctaattttccaacaagccccagccccacctctgtcaattatttttgtctcagccttctaattacaacattatatgaccattcagactggtactaattaaatcattacttaattcacaaagtgtgcgataatgctaatgcttcttgtcagctgaaattacaacatggcacctactttcttcattcttggtagatggggccagggggttgctcttttaccaaacatcttttgcttaccctctgatagccacctgaccatcagccagaacctaccttcttccagaactgggaaaacagtgcagtagacctagcgatatgtacctgtaattcatcactatcatatgaaatcatcatcccagttttgtttgtggagtaaatcttgatactcaagaaaaaaaaatagtagtaagatttagagtactatttgctacattttttgtcatttgttctgcgtattatttttaacagagtaaacagtagcttgtctctttttctcatttctaaaacagatttgttttccactcaattagacttgtgatcacgagaacacaaagtagtatttttctccttctggagagagacataccgtatgatgggcaaattgtcaggaataattataccaaatgatggaataaaatccaatggaaaacatctctctcattgctagtgatacatttttatttaagacacaatgagcatcaagcacatttatgacaaggtgaaattgacaagtggccctctgccatgattttatttttaattgctagtaaactaattagccagaacaacatgttgtataatccacaaaactgtcgctcatgcgttctccaataaaagcaagatatatgatgtggaaaagttctctaagagctagccaaaaaaaaaattatttcagaattttgagtgtatagacatcacagtaaaagatgtctcctcaccagtggaagaacatttgtatataacatttgttttgagatctgaacagaaattaaggacaaacagtaaatttttttcttttccttttttttttttttttgagagagagtctcgctctgttgcctaggctggagtgcagtggcatgatcttggctcactgcagcctctgcctcccgggttcaagcgattctcctaccgcagcctctcaaatagctgggattacaggtgcttaccaccatacccagctaatttttgtatttttagtagagacagggtttcaccacattggtcaggctgatctcgaactcctgacctcttgatccacccgcctcggcctcccaaagtgctgggattacaggtgtgagccactgtacccagcctgttttttccctttttaagatcaaagtatgcatcaaaatagccaaccactttcttacatgtaattaagttttatgtagttgagtcacattaagtctaagacatacattctaggactaagactttacagtcattcagtagttacttatttgtgcaaggcttggcaaccttttcctttaaagggacagataatacatatttttgtctttgtgggctgttcagtctttgccacaaccactcagctctgatgtagagcagccgcagtcatagataacgcaaaaataaatgtggcagtgttccaataaaactttatttatggacacaaaaatttgattttatgtaatttttatttgtcacaaaagataattctttgatttttttcaatcatttaaaaatataaaagccattcttagctcatgggttatacaaaaggcaggggtgtggatttggcctacaggctgtagttgccaacctttcctctgtacctgctgcatgccagcgtcactcctcattctttagtatcagacgtgtgttaggcagggtgctaagcatcgagggatattcagagatagagcaaagtcccttccctgatgaagcttacagttaagctagaaaggaaccatagatgggacagagacacataatattagatgttaaatggtgtccctctgtgacaaaagccaccattgctttacaagtttaagagagagggaagtcacttcagctgatttaggtgatctgctaagtaagacatgacctggctagctacggatgcatggaaatgatgggatatcagctggatcctgaagaaaaaggctgtggacctttgaaaaggtaacagggcataatgcctccttttagaggaagggggaactgaggatggcgaaaatgtcaaccatgagtcacttattcctatcatttttcccccaattctttctttcatgtcttctcatgaaaatttcaaacatatagcagttttaaagaatgttacagttaatacccaaatactcaccatatagattctaccattactattttgctatactgttttattgtatatctatcctatcctcttttgttttagaattctggtctcgctctgtcacccaggctggagtgcagtggtcactacagcctgcaactgctgggctctgcctcctgagtggccaggaccctatgtgtgtttcaccaccatgtttggctaattgtaaataatgttttgtagagatgaagtctcactatgttgcccagagtggtctcaaactcctgggctcaagctgtccccctgtctcagcctcctgcattgttgggattacaggcatgagccaccacacctggctgctttattatatatctgtccttctgtctattcattaatccattttatttttggtttattttaaattaaatttcagacatcaagatacattttcataaatatttaagcatgcatatcattaactaaaatttaatgttggcttatagtttttcttcttttggtgtaaaatttatatacaattaatcgtaccaacattaaatgtacattctctgagatttggaaaggctgatccttttgtagcctaaattggaagatacataaagttttcatcacctcaggaagttccttctgtcagtccttgcccccagcctacccctggaggaaccactactctaattttctctgctttaggttagtttgcctgttctagaatttcagagaaatggaatcatacagaacctatcattcggtgactcacgcctgtattcccagtactttgggaggctgaggtgggcagatcacctgaggtcaggagtttgaggccagcttggccaacatggcgaaacctcgcctctactaaaaatataaaaattagccgagcgtggtggtgggcatctgtaatcccagctactcgggaggctgaggccggagaattacttgaacctgggaggcagggattgcagtgagccgaaatcatgccattgcactccagcctaggtgacaagagcagaactgtgtctcaaaaaaataataataaataaagaatctatcatttgggtttggctttttatcatcatatattttgtctttacttgcttagtatctagcaagaatataaatgcaattattttgccagagaaaagtatatgtttgattaaggaaaacataaaatacaactttgtttaaatatctgtatgtatattcttaaattattgtaaaattaaattacctatggattaaatttttcacattaacattacttagtctattatgctccagcattttacatatttatgttatttaattaaaatctttgcagtagatatttcccattttgaagaagaggaaactaagacagcgaataaaataataaacaatattatttcttacctcttactgttgccacttcagtgtcagggaggaagagggatagcaaatgtaggaagggtgtttgcaaggtgagtgaaggtgaagctgctttgttacaagttttcttatcaagaaatggatagaacataggagtagagaagttcaataggaacatgcaaaatttgtctattgtaaaagaaggaagaaaactggagaatttaaggactattttttaacatctatgattaaaatattatgaaacaatatctttttaaaaagtgatatttttcctctagtataacacaagttgttagaaactaaggaatcaccctatcttctttagtaaaagcctacaactggtagagtttttttttttttaaggatctcaagatacttcatgaacctcaaaagactttaagttctctgcaatgttaggaaatgacttcatgaatatcacagttcaaggttctgctactgcttttagaagcccccaaagtgtgaagacatctagtacagtatacagtaagaggagaactggcttttattgctcacaataggaatgttcccatctatctgtttgcaaaccaactcataaaatatttgaatattcttcactctgctttatgataatatttcttggcttggaaatttgctttttttttttttttttgagacaaagtctcgccctgtcacccaggctggagtgcaatggcgtgatctcagctcactgcaacctctgcctcttgggttcaggcggttctcctgcctcagtctcctgagtagctgggattacaggtgcccgccaccacacccggctaattttttgtatttttagtagagacggggtttcaccatgttggccaggctggtcttgaattcctaaccttgtgatcctcctgccttggcctcccaaagtgctgtgattacaggtgtgagccactgcgcctggctgaaatttgcattttcattaatagatcatccttatttaacaatgaacttcctatgtgtttgtgacacatggaaaataagtaggcagcatttaatgtcatttgggaagcagtgcttatagtagttcggtttacattcctcatacagccatgtgccgtatagtgatgtttccatcaatgactgcatatgcaacagagtcccacgagattataatggagctgaaaaattcctattgcctcatgacatcatagcctggtaaggttatagtgcaacaaattactctcacttctgtgctgatgctggtgtaaacaaacctactgcgctgccagttgtataaaagtacagcatatacagttatatacggtatataatacttgatagtaaaagactatgttactggtttatgtatttactatactgtaattttacacttattttagtgtagtccttctactagttaaaaagaaaaaagttaactttagaacatctcaggcaggttcttcaggaagtatttcagaagaggcattgttatcataggggatggtagctccatgcatgttattgcccctgaagaccttgcagtgtgacaagatgtgcagctggaagacagtgttattgatgatcctgttcctgtgtagtcctcggctagtgtgcatgtttgtatctttgtttttttttttttttggttggtttgtttcttagaaggggtcttgctattttgcccaggctagtcttgaactcctgggctcagtggtcctcttacctcagcctcccaagtatctgggattacccacatgcaccactgcacctgtctgtgtcatagtttttaacaaaaacatttataaagtaggccatgtgcagtggctcacgcctgtaatcccaacattttaagaggctgaggcaggtggatcacttgagcccaggagttcaagatcagcctgtgcaatgtggtgaaatcttgtctctacaaaaaatacaaaaattaagtgggcatgatggtgtgtgcctgtagactcagctactctggaagctgaggtgtgaggatcacttgagctcaggaagtagaggctgcagtgaactgagatagtgccactgctatccagagtgaagccctgtctcaaagtataatacaatacaatacagtacagtacaatacaatacaatacaatacaatacaatacaatacaatacaatacaatacaatacaatacaatacaatataataccatacaatacaatttaataaaagaaaggttatagaatatggatataaaggaagaaagtatttttatacagctgtacatttttaagctaaatgttattaaaaaggattcaaaatttgaacaatatataaagtaaaaaacattacagtaggctaaggttaatttgttattgaagaaagaaatttttaaataattttagtgtaaccaacatgtacaatgtttataacatctacagtagtatacaataatgtcctaggccttcacattcatgcactgctcactcactcactcacctagagctacttccagtcctgtaagctccattcatggtaagtgccctatacaggtgtaccattttttaatcttttatactatatttttattacgtcttttctgagtttagatatgtttagatacacaaatacttgccatcaggttacagttgcctacagtattcagtacagtcacatgcaagtttatagcctaggagcaataggttatgctatgttgcctaggtgtatagtaggctataccatttaggtttgtcgaagtgtattctatgagttcatacaatgacagaatcatctaatgacacatttctcagaacatattcccatcgttaagcaacacatgactgtgcttagtcttctacacaggcttagtcttccttgttaattgaaactctatgtttcttctcagtttaagaagcttatttcaggactaattttcccccttttagaataagtttcccacatcacttggttacatgacaaaacaagttaaatcactgtccctttttgggtttaatatgtccagatgcaaattaaagaaataaaatcccttagatttttctgtatcttgtctcccttcctcattttctgcagaacagtttttaaaagttaatttaggaaatctccaaaatattagattagcatgacttcagagctataaggttcctgaaaagtttatgtagaaatgttgtttttagtgctttaatttctcttatagcatcttgatgggtagtcattctgcctaaaggagaactgaactcatcctgtgtcccaggagctttgtcatatgaaaagttgtaatccattctggtgcttcagatgttgaaggcccagtgaaattctacaagatggctgccacttgagctttggccttgcaagtggttaggaagatgttggtcctttaatctctgtacaggggttcagaagtagttgatagtttactaatgaaaaatgttatatgtagcaaaacacaagcaaaaaaatcaaaaacactgatgacttatataaattattaacttaaggaagattatggtacttgaaaaattattttacaaaaaaagattgtattaggaattttttctgctcttttttctcaagttagtaccaatgtaacatggctgtgttcatgtaatttcttttctcaatttggttcaagatttgtgtagctcccagtggtagattttgcggttgtattgcatgattaaagtgtccatcaaaatcttacagttggtaaacagtattaaaaatccatctccagcctctgtaaactgtacagagagctatgaatactagaagaaatggaagtattttaattaacccaagtaggactaatcaaagcagagcaaccagtttattcaattgaacatgtaaatgtctattcattcttgacatggcagaacatttatgtcatctattaaaagctattctgttgcttgtatgattataagctattgttcaacggggaactgaatcttgtaaaggcttccccaccccactttttgtttttttgagagggagtctcactctgtcacccagtctggagtacagtagagcaatcttggctcactgcaagctccacctcccaggttcatgccattctcttgcctcagcctcagcctcccaagtagctgggactacaggcgcccaccaccatgcccggctaattttttttttttttttttgtattttcagtagagatggggtttcactgtgttactcaggatggtctcaatctcctgaccttgtgatccgccctccttggcctgctgaagtgctgggattagagtcgtgagccaccatacctggcccccccttttaataattacatattacagattattttttaacatgctttttgctgtattcaggccacttcagataacccagcttcttgcatgaaagaatacagacttgggtaacttggttcagctaccctgccatcacctctttccttcaaagggttttctcttcttcatttcttcataataattcttagtaaatatctactacatgctgggtacatgtattctaagcatgttatatgcagtatatcatttaatttttgcaactatattgttattttttccattgtatgatgaagacatggaggaagagtgttgcatagtgctgtaagtggtagaaataggatatgaacacaaatctcagaagatccattgtgttgaaatgaatttgagttgtaccaaaggtgattgacattagacaccaggaagaaatttttgaaatgagtggatgctctaaggagccttttaagtgagtacagctaaaaggggttggggtgaaggtagtttcctgggattttttattaccattaagacacgtaaaaacagtttgtataaaatcccatttttcatgaattagttacattcttaccttgagccaggaagttaaactagatggctgtctgaagacccgggtaatacatttaatacagtcttatatgtgtataaaaagtggaaacaatgattcttttaacttttaaatatgaatttttattgcaacaacaattagaaaatataaataatacttacacccctgccattctaatgtaacacttagttttgggcctacttttttctggtcacttttctcatgcatttaaaaaaaaaaaaacaacctttttaaaggttttaaaaacgtttcttaaaatgtagtgtattatatttatgcccaaaaatctatccatgttaagcatataattcaatgagttttagtaaatttgcagagatttgtaaccatcaccacaatatgatacagaacatttgcatcattccagaaaggttcatgagcagtctctcttcttctccattctttgatttcttaaggtggaagtgtctgttactggtttactgtttcttcctttccaacataggtgtttatggaacttctttagctgaagtcatgaaaatttgtatattctatttttatttctattccgttcaaaatatcttctgatcgctcatgtgattcattctcttaactcattggctatttagaagtctattgacatatttcaaaatatttgtgaatttcccagattttcttgttgtttgtttctaatttaattagcaatacagaaaatatactttatgtgatattagtcattttaaatttatagatagttatggcctagcatatgatctattttgatgatgtaccatgtgtgcttaaaaggagtatgtactatactcatttggggtggagtgttcttaggtcagtttgtttgatagtgttggtcaagtctactatattcttgttggttttctatctaggtgtcctgtttattatttagagtggtatatcacagtctccagttatttttgcattgtttgtgtctccctttagttccgttagattttgctccatctgtttcggggtttgtagttaggtatatccatgtatatcattgtatcttcttggtgggtagacccttttatcattataaaatctctttgtctctagtaacagttttgctttaaagtctgttttgtcggacagtattctctctcccctttattattaaactacatttaatttgtattaaactacatttattgttcacatactgtttttcaatcttttttaaacttatttttgcatttgtatgtaaaatgtatcgcttttagaaagcatatcattgggtctcttttgaaaaaaatccagtctaacaatctcttttttttgaattttaaatttatttatagttaatattattattgatttgattggatttatgtctccattttgattttcatctttttttgttcagttgattttcctttactgcttcttttgtaactaaataggtgtgttttagtgtatcatttttattacttagttcatttttgctctatgaaaatatttttttctgaatgggttagggtttatacatgcattctaccttaacacagtctattttagtttaatactgactttgtattaaactttgtcagtttaataatgactttgtattaaagtctgtgcagtagtatgcacaaactttgcttcactatagatccatgtcaccatcttttatagctattattatcacatacatctatatatcttatatacccaacaatgcagtattgtaattattgctttgtataacctatgcttaaagaagttaagacaaagacaagaaaatagaaaaatgtatgtatgatttctttcaacatataaaaacctatatgcttactgtttccattactcttcattttttaaatgtggaattgatttatggcttggtagcatttctttggcacacataactatattctttctctctttctttgtgctactattattatatatattaatctttctatattatatgtcctacaacacaattttacaagtactgatttatgtagctcttttttaaatcgttagagacaagaaaagacaaaaattatatagcctcctatagttacctacatagttacctttaacaatgtttatttttcttcatgtggatttgaattaaggtctgttgtcattttgtttaatcctaatgaactttatgttttgtaaagcaggtgtgctaacagtgaattctttcagtctttaataggggatttcttaattttgccttcattttgaggaatatttttgctagatacagaaattttggttgacatctatttgtttctttgagcacttgaagacatcctcccactgtcttctgccttccattatttctgattggaagttggctgttcatcttattttgggtgccttgtacatagtgagtcatttttacccttgatactttctagatctcctctttttctttgcctttcaacagttatatatgaaatgtgtagatgtggatctctttgtgtttatcctacttagaattatttgataattttggaagtttagattaatgtttttcattaaattgggggaggtttttaccattatttcttcaaatactttttcagaacctttttctcctcttcttggaatctccattatgtgtgtgtttgttatatttgaggtgtgctacaggtctgttatgttctgtttattttcttcattttttccccctgttcttcagatttacaacctggatcaatctgtgttgaaatgcactgattctttcttctgccgttcaaatctcctggtgaggttctctagtgaattttttatttgttactgtactttcagatttcagaatgtccaattggttctatttaagaatttctacccttttattgctattctctatttgatgaattatgacatcatgcttcccattaaatctccaaactttttcggaaggggatctttgaatgtgtttataacagctgatttgaagtctttttctgttgagtccatcatgtaggctccctcagagatagtatctattgacttttttttccttttggaatggtaaaattttaattttttgcatgcctaatatttttgctgaaaactgaacattttagataatatattgtagcaactgtataatctgatttccccatctcttccctcacacatacctagagttaatggttgtttcttttttgttttttgtttttgcttgttttgggtttattactttagtttcttactggaatggttctgtgcagcatgtttccctcataatgtgtggctgctgttgtctctactccattgagtttgccaccacccttaccacttatataagcctagctttctagggaccacccctgaaatcaaaatagttgagtgctcagttaaagattggctagagattgtatctaaacacttagaacccctaaatcactgccttctgcttttatgatggatccataaatgatttggggaatgaatcagcagtcagcctatttaccagtctggcccaaatcttaatttttgtgttgtaaggcctcatgctcagcagaaataagtagcttactaaggctttctgcaggctctctgagcaagtgtgcagctttgtgcatatgcacagctttccaggccatcagagataagtaggatcgcatcaatgccctctttcagttcctggatctgcctattaattttctgactggcctactggtttgttgcttgcttcagtcagttatgagatttcagggtagctgcagtgttgtcctttcctgattgtttgcattaagatcactattgtttttgacaataccctttgtcatagaattttccacataaaatcagtcatttctaggatcagagccttcatcttcacagcacacccaccccgacagcacttctgcatcaggaagcaggggtggaactagggagtgggagtagcaccgcactaaagtgctatagactctcactgttgtcaatgaggttcggtgagttttcttgaagaaacacttctcagtttattgcatgcctttggtcaatttccagtgtcctttagagattgtttttgacaattttgttctgtttcattgtttatttttgtggcaaggatttgccaacctcctcactcagccattttggaaggtctgctgtcttgggtatgttgttgttgtttagaaacatacatgctacaaagtacactcttgagtatacagctaaagatttcttacatgtgaaaacacactcgtaatcaccacccagattaagatacaggacatgtccagcacccgttaatctttccttcctagccttctagtttcatcccagagttaaccactgtcctgacctctgtcattacagattactttttgtaatctgtgtggtttttttgttttttgttttttgtttttgagacagagtctcactctgtcgcccaggctggagtgcagtggcacgatcttggctcactgcaagctccacctcacaggttcacaccattctcctgcctcagcctcccgagtagctgggactacaggcgcccaccaccatgtccaactaatttttttgtatttttagtagacacagcgtttcgccatgttagccaggatgatctcaatctcctgacctcgtgatctgcccgcctcagcgtccaaagtgctaggattacaggtgtgagccaccacacctggcctagatatgaggtttttttgtttgtttgtttgtttgttttgttttttttcttgagacagagcattgctctgtagccaggctggagtgcagtggcgcgatcttggctcactgcaacctccacctcccaagttcaagcgattctcctgcctcagcttcccgagtagctgggagtacaagcatgtgccaccatgcctggctaatttttttgtattttagtagagacagggtttcaccatggtagccaggatggtctcaatctcctgacctcatgatccgcccacctcagcctccctaagtgctgagattacaggcatgagccactgcatccagcctataatctgtgtgtggtttttaaacttcatttgaatgaatatttaaaatatgtcctctttttcctctagcttcttttactcaacatagtaacttttgaaatttatccatgttttaggtgtagcagggatttttaattttttaattgttgtataatactttattaatagatatgccacagtttccttattgtgggacatttgggttatttccagtttgtggctattattaatgaagctgctatgaacatcctcctctttgtctttctatgagcatacatacgtacagttttaacgtggtcagcaacataatgcatgtgtaatttaggctcttgctcttttttttttttgagagacagagtcccactctgtcacgcaggctggagtgcagtggcacgatcttggtgcactgcaacttcccccttccaggttcaaatgattctcgaacctcagactccccagtagctgggactacaggcgcataccaccatgcccagctaatttttgtatccttagtagaggtggtcttgaactcctgacctcaggtgatccgcttgcctcggcctctcaaagtgttgaggattacaggtgtgagccactgcgcccagcctggggtcttgcttttttaaacttagcattatatcaagtgtttttccttatctctgtcattgtcatgacaagagtcattattttttcaggtaggtataccgaaagctatttccatttctatttttagaaaaagtcaaaggcctgtatttaataattactcttgacaacacaggtagcagttgatgctcaattcaataaatatttgttttcaacttttaaagaaaaactccagaatcgtatgctttttaaaaatagtatttgattgaagattaaacaaaacttactgctttttctgccccttgaaatgttccataactctatgcaattcacatattagtagtatcactttttaaatgtacaaaagcagacattactgagagccttggcctcaaaacattcatttgattgcctttctttaaaaacatatttcatactgggttatggaaaactcagcatttggttttggatataaataaagccatatgacctttcatatttaggagctgaatccctcttgtagaaacttgtgatgttgctttgcccactttcctaccctccctaccacgtcatccaacacatgtgcacttatgctcattcacatacacctcgcaggctctctgtgtcctgggacctacacttcacatagtacttggaaatattttctcttgaggaaatggatattagagttgcaatggtataggaactgtatacgtttttcctatctatactgtggtttttcttttcaaacattgtcgagatttctgatggataacagtagttgtgaaagacacaaggagaatgggagggaaaggaattgcttaatggacctcacataattgtgactatgactccaggtctgctgcgtttagaaatggaattgcgggcagatacatttgtcaaatttaacttaatcccttggcttttatctgatgtatatttttccattaacacagtatacctttcatctctactttcacacagtcaaacagcgtctaatttttggtggactttcttttcttcttttttgatgctaacattatccccgtagggtcctaatcaggttttagactatggagagaagaccataagaatcaccaaagcggaatttcccattgctggtaaagagatgcccaagatgcagaaggcttgaaataaatcgggcatgaaataagtggcgttacagccctatactggctttaccgcaagggttaaatttgctcagtgtctgcaatttcacctttcctgattgtcatacagagtgagatcattgtccaaaggttgatcatgtggaggatgtatgtgcttttgaagtgatcaaactaaaagagaaaacaaagctcatggctgaagtcatcacacctgaataccatcttgtgatgtcatggttttattggtatgaattctaaccaagctgtgggcatttaagtcatatttgtggatcagaagccatagatatttgcgcttctcataggctgtgcttttctgatactttgatcattattatatggtaactaacatatattaatatattaatgtattatatcatatttatttagaccccagtatggatactaaatgggataaagcatatgccaagattttttaggtcttgggattatttaatttttttagaactggcgttcattgattgtcattcacgtttctcttcacttccttatgaaaagtttctcaactcttctctcagtattttcttttcccctgtgagatatgtttccttttacactttttcattcctctaccaaatagtaataattgcaaacatttattgcatgtttatgtgtgtaccaggtgctatgccagttgtttttatgtgtattttctcagttgctgtcttaacggctctgtggtatttttatccttggtttacagatgaggagactgagcctcttttggtctctttccccctttaaagataaactcctcctatctccttaaactgagcttgtaacctggacctctgattcaacagcccacaccccaatttgtatttggctatttgtattgggctatttgggtggtggtcctttgaatgttgttgtgctaatggaggcctaaacgttgaatcccgtgaatggaaacctcttcacatctttactgcttgtcctgggatcttcacacctggaatattgatcttcaccgagtaatttgggaaaaacagaggcagaggctggaagctgctcaccgtcctatggcagggcaggtaatgtccttaatgagatgggcttattccagtggagcagtggtggggaagcaaaagcttggtgttctctcctcatggttgcgaaaatattcacataaaagattcactagctactgttaataattgaaggactttcctcaaaatccatgtattataacggtttaatatactaaaatgatttggaggaaatcggcctcagcattggtgaatgtgttgacatatgaagctattatttttataattcttattttagagatggagtctcactgtctcacccagcctagagtgtgttggcaagatcatagctcactgtaacctggaactcctgggctcaagtggtccttctgcttcagcctcctgattagctgggactgtagtcacatgctaccacccatggctaattaaaaaaaaaaaaatgtgtggagacaggatctgactatattgcccaggctggtcttgaactccgggcctcaagtgatcctccagccttgtccttccaaagtgctgagattacaagtgtgagccaccccacccaacctaaagttgttttaagcttattgtgtgcatgttggttgtgtcaccagccgggaggggcttataggctgcaacactgttttctttcctatactacctttattatcacgtaataactaaaatacgtactatctgtttttaggtggatgctctgcttctcttgatagatatgaaagcaggatacctatcttccacccctgtgtttttcttttttcttttcttttctttttttttttgagacagagtctcacactgttgcctgggctggagtgcaatggtatgatttcggctcactccaacctctgcctcccaggttcaagtgattctcctgcctcagcccaccatgtagctgggagtacgggcacccaccaccatgccgggctaattttttgtgtttttagtagagacgggggacgtgatttcactgtgttggccaggcttgtctcgaactcctgacctcgtggtccgcccaccttgggctcccatctactcagatgtcctgtcttcacaggggccctctttgaccaccctctgtaaaactgtactcatattattcactattctttaccttgaccctgtattttcttagcacttatcactattcgatataacattttatattcttcaccaccaacccagactagaatgtcaggtccctgaaagtgaggtatgtgccatactcaccactttctccccagtatccagagtggtgtgtggtacatagcgaaactcagtaagtattattgaatgaatgaatgaacacagatgactagaaaaatttctagaaaattttaaaacatgggcatattagccatgaatttaatttatagttttgttgttttcttttgggtattcaaaaatataatttcatttgtttatatctctaatgagatagtacagtatttgtgattcttctagtgtgatggcatgtacagtttcattggtgagtatatgtgacctactgtgccaggtggaaatggagtgaatgaacattttggggggaactaaaaagcaattttcaacctttttgataagctaggttaatactgtcttctcaataaaaagtactttttcttcctcttataatgttcatggtcttcatctgtatgtgtatattgccgatttaggaactaaagccgaaatggatctcagactatttcccacagactggtagctgtatcccctctgtcagcaagtatttgatatcttcagtgaaaattgtttctttttccacttttagcttctgtttagttttacaagtctaaacaatttttggcaagtgctaggggctcacctgatgcactttttaatgcattccactcctcgttgttattttctctgtccagtacacatggtgctccttccccctcattgccatcccactttggcagaaagcattatggatgctgtgtatgtagactcatcacccaagccagcatgcatgggagagggggcctctagaataataattgttacttggtgttctctgtactactctgtttaatctccctgcttaccacttactgccttcgtaaagtaagctcaatacaattatttattgcaatttgtgtagaatgtcagatgtggaacagactttgcacactcatcagatccagcccctttgttatttagatacaaagactgagccctcagagaggagtcttgcactagactctagacctcccttgggcaggggactttcttgttcactgttgattcctgcttgtctaatacagtgtctccatgtaataggtgctcaataaaaaatattgcatttttcaaagtctcatatgtaagtagtgatggcagggccagaacttgaaccttgcatctcctagttatttgttcattgtcactgccacaattatctcattgtagtttaaagagagtcagcttccagtcttttaaaatacaattacctttaattcatctgtggtaaacaaacagcagctgtctctcattggcatggccgcagttccaccactgagcaattctagaaactgacactattaaccattctgctaaaaaggactcttctactcatatgatatcctggctgtgtccaaagtgtaatatttaattgcattttcttaatctttaccactgtattgctaagctttctaataccttcaaaataccaaatctcaggcttatcctaattaaagaatctcaatttaatccataatgcatgacaattcaatttgttgattgctttttctccccctctttgtgaaattcccgtcaaatgtattaattcaacatgatgaatcctgtattcaacccactggagtgaataattaaaattagctgataaaactttcagcagaattactttgtgaaattgctgaacagatgtgtcattttaatgaaaatccacagacaagctccttctccccctcggcaggataaaaatattatcccctcggcacatacttaatttggtggtaaatacactcggagcgattgctggaagggaagaaaaagcaacttgtcacacttagtaacttgatttttccccagcatgcagtaacagctatctacagtaattcatagtgctctattgttgctgcaagtcccaaagagaacttattaaaatgcaataatctcctatttaaacagaaacaataaccattaaatttcctgtggatccaaaattgagcacaagccccatctggtaagagtgattagaggcctgatgagggaatttaatttgcaacattcaaagactaaatctgagcagatcttgtcacctgggactcgagtgctgcttgctgtcttcttaaaaatctcgacctaaactgaaaatggaatgtagaagtgaaaatgttacccaggggccacccccaacagtattgtgtttcattatgtctccagcaggcctagtgagcagaggggattttagtgctgtccgctttagctttgccggcaaggccttttgacaggaccaacactaatgctgtcatttcctctactgccctgtgcatctgtcatgtggctgcccctcttagatcgtggactgcctgctccctcccttcttatttactttcctcttttagcttagcaagtcctctctctaactttaagagttctctagatctcaccagtctccctttcctgtccaaggagtcagatgctttcagcaggctactttgagcaccactgtatcatgctttacattttatgtctcctccttgcctatagacagtaccccctctgagtttattattagtgttttttttttaactgtaggaggactaagatttattgcatgttattagtaaatacaaattgtcattttcctcctcttcttagcttttctcttacaatcccccaccttatttatattacttctgagctccagagaaacaagatatgcgtgcactcatcatcagagagatgtgtttctgtgtatgtgtgtttgtgtgtgtgtgtgtacatgcacttgtttgtgtgtggttataggcctgatcagacagatgtcagtttatcaattagtagaactccctaattaagtatttgctttgagcaatagagctcttattggttgtgaggtaacttggcaggagggaggcagttaccgatgtaatagagatgcctgagcagatagtttcgttgagcagatactatttgatgtcctttaatcatcagactcctccacttttccttcttctgggctcctgatttatccctaaacaatcagagcctctcctccataattttatgaactacaaaatttacaaaaatgttttacaaaccctctgcctccccagtatcttctccagcccccatgtcttggggcaggccacatcaggtctctctggctgcttcctttcccaggccctactacctactctggcccatcatatgtcttttgagaagatgatttttcagttcttttctttagtttagaaaatcagaattaattgattaatttttaaccccttctacctttctcctcccctaccatatgaattcatgcagagccagccctgcaacctaattttttttgttttgtttttgagacagagtttccctctttttgcccaggctggagtgcaatggtgcgatcttggctcactgcaacctctacctccggagttcaagggattctcctgcctaagcctcctgagtagctgaaattacaggcacccaccaccatgcctggctaattttgtatttttagtagagacagggtttccccatgttggccaggctggtcttgaactcctgacctcaggtgatctgcccacctgggactcccaaagtgttgggattacaggcgtgagccaccatacccggcccctgcaacctaatttttaaggagaggtggtaaggttcattccatgaatcataccacttggaattcttgaaaaattaattgcatttattgcacacctactctctgtaaggcaatgtacataagaatggaggagatactaagaaaattgagtcccactcctattgccgatcgggaaagtacggcataagcacatgaatatttagaggtcctgtggtttaagtaacggtaggtaaggaatcattgggccagatgggatcagtgactcactgaatattataatcagagatgtgagtgcagaataaggaggagatatgactggggactggtgtagttcttagaggttgcctgagctggctagcgtgacattcctactaagcaatgagcctagcaaccagaatctcccagccccggtagccaaggagcacaggtggtaggctatagaaggagatttaatgcaacacagctgggttcaatatggtgcctctttcagagccctggctacaattgatgtaacctggtaactagtagctttgactttgatgtcagacacatctggttgtgaatattccctgaaccactcttaagagtttctcaactctttgagtctgagttttcttgattgtaaaatggtgtttgataatacatatgtggttttcatggggattttgtaaagtgcctggcatatggaaggagctgggtaaatgatggtagtacacttataatcttaagggcagaaggaatgaattaaatacagagtgaggcctagggactcttgctatgctccctcctgactccggtctagtattactaacatctttccagaaaccattcttctttatgttggttttggccctttgtgtccccatctctagccctttattcagttggtctgctcaaggcttgcatgccatttttggcattgaacatgtgatcctctagtttaatatagcatgtgcaatatggtaatttaagaaaataaatgtctgtatgcatagaaaacacagcatcctcctttaattcatgggtttatgggagattacagttttcttttagtttaagcctacaaagtgtttatagtaaaaaagtttcaatgaaatgatttccaatttatatttccttttcactcaccaccacaagtcagaaatcaaatcttatgcttagaagaaagcaactccaggactgtatccacttcgggttttgaataacaacagtaaggtggtctgactccaagattaggtccttgttgtttggacatatctaacaaggaactccatccccaagtgctggagaatccatgaagtcagtggtgtcttatgaagcttgagcaattgggaagccttcccagtcagctttttggcctcctctaggtcttaattacaaagcggattcatggtcctgcctgaaatctgattgagacatagactcctctatcccaaatgatatcattatcaacattggttccctgtggtacacatttgtcatattcattatgatttgtacctaagattccaggccacaataatagggtaagagtgtataatgggaaaaataacacaaatcgttttgattttctttaaggaaattcattgccttaacattacatacttgcctttgttttaaaactcactctatgccttatctaagaggagtcaatataaaagattttaattttagccccatatgctgtagctatatataaatgttctgtaaaatatatcccctagataaaagtacttactacttttttgaagttttttttaaaacctttcttttggtaaataaaagtctttttagctttgatgtgactattacacccttggtttgggttctttctccattccttcatccctagcccctgtgggacccctgtaagaaaaatgggaggggagagaagcatgaattccttaataagtcccaaaggtaatcaaaagaaagaaatgcagtatgaacaaactcacaaaatattcttgtgcttctttggggaatacttaatgcacataaggtcaggcctttgtaatgttaatttgagagtgttaggaagaaagccatcattttacaggcaatgttgctctctgaaaaaagctttgatttacagagaaatgctgttctaacacacctgcattaaaccagtgcctgccgactttgagaggcctgagttgcttgagcagaggaaatgcttcattgaggatgcttagggcatttggctgaagtggtaggaagtttgccagaggtcctattttcctgtggtcaaaacaacctgttcagtttggatatggtacagcccctattctttagacatgtgcagagtgacagcacaattccgcaatggcctcctttccaagattggccttagggagggaagtcttaccagacacagtggcaacatagttagtataggtatcttggttatagaggttagacatgaatagcctggtttccacctcaggtggttgcccgtgccttctcatcaacttgtaaacctccatactgtgtagaggagattgtgtggctagaaggaatggattcatcccaaacccccaaaacaggattcggataagtgaccatccagcctgcaccagagcattgccagagactggccattaattatcttcagaggcctctcagttcatctttggctctcctctctcatccatttctgtttcttccttcttccatccatacttcccctgctctttcctcctgccttttatattggtctgtattctacttttgggtgttatacaaatcagaaaacatttttatgttaaaacaaattaaatatgaatactctttgtgaagtgcctgacatgcagtaggcactcaattacttcctctcttccatcctactgtgtgataactcttctagtaattgagattatgttatcatgagactacatgaaaatattatcatgccccttctgagttaatcttattcaacctggtttctcatcccttcatcttcttagtctccctgccctcaaatagtccactgtgtgtgcacgtgcgcacatgtgagtgtatcttaaagtacagttttcaaaactagctgcacttccctatgttgggtctgatttgccaattttttatgaaggaataagcaaaaagaaagagagcaagagaggaagaggggagaaatgccgtgcttttctagaggagcaaatatatggaaattacccttgtttcttctctaaagtagtaaaggtcacagcagtagttgcaaaacccgtaggccgcctactgccttccacacattcagcattactattcttgcctattttacccttaggcatcctttatttcttgcacagatggtctcactcaggcctaacaaaatgttttaagctttgcataaattaaaacgaggtctctgagtacaaaagtgcaacttgttttttacttgaaaacaactatgctggcatcttttacaaaattacagcctcaagccaggtttccataatcagttttcctttaaaaaatagagaggaaagaatgtatccttgtgtgtgtgtgtgtgtgtgtgtgtgtgtgtgtgtgtgtgtgtgtgtgtatgagtatatatataatatatgtatgtataccaaacacaaatggtcctaatcaatgggattatggcttttatgatgttctgtgttcctttgaaggttgatcaggcatgagtggtggatgattcagtttgaataaatagatttggaaatattattttgggggtccaggatttctgagtttcttcattagtttagtacatgataacaactgttgagacatttcagtgtgcggagactccctcctagaactctttactatgtaccttataacagggttttactcaggctaaccttgactgtgctcaattgaaagaaagtgatgagtcagctcaaagagaaatagtctgtttctcccaactctgcgataatgtgtcccaaagtagtgacacatggcatattccattcttaagataactggcagacaatttgtacaatcttctagacacattgcttccctttgattcacacatcatcaccaaaagggtaatgctacaaatcttttctctattcatgactactcttaacagggatatggcttgtaaagaagcttattgatgtgctttgcttgaaatagaatcattagactgggcctgccctctcatttttaccttgacagtaatagtaagagtatgggagatactcttactcttattattactataactataatagtaatactattacagtatagtaatactattacagtaatagtaagagtatgggagatactcctattcttactgttactgtcaaggtaaaaatgagagggtactgtgtgagttattttttatatattgtcatcttttaataaccctatgtgcccactatagagaagttggaaaatatagaatagaaagaagaaaaagttatttttttattttccacagttaatattttcacatattatttcattatgtttatttcctcacacactagtgatcatactttcaacagatcatactgtagatattactgtagatgttatattcatttgttcacttaaactaataatttgaatatactttactattattaagaactctttgttaaagatcaaattgttttaaaacttaagttagagaggcatttatagcattagataatgccagccaggacatatacactatctttaaaaatgaatctaacccttaaatgaaatccagcagccaatctaatgtttctttgtaataagcaaaatatttttctgtgttattgcatctcacaggaatctattcctaaaggattcaatagtaaagatgctcagtaatcatgctctagagtttctcatccctctaaagaacacacagcagttctgtgaatgactaaggatcagcaggaatggatgtcaggtgaatgttggcactactggatacaattgatatgctttatggattttttgtttcaatgtgattctgcatagatggcacctgtaattatgaccatttggatcatgtgaaaaatgataaattttcggtgaaagggaatggtgcttgatccttttctttgtctttgaactgtttagaaacactaaacttaactgataaaagtaagtgcaagatggccgggtgcggcggttcacacctataatcccagcactttgggaggctgagacaggtggatcacttaaggtgaggagtttgtgaccagtctggccaacatggtaaaaccccgtctctactaaaaatacaaaaattagctgggtgtggtggcgcatgcctgtaatcccagctacttgggaggctgaggcaggagaatcacttgaacccaggagatgaaggttgcagtgagccaaggttgcaccactgcactccagcctgggtgacagagtgagatcctgcctcaaaaaaaaaaaaaagtgtgtgtgtgtatatatatatatatatatatatataaaaaataaaaaataaacaaaaattaaaaagtaagtgcaagacatcttagaagtattgcagttttttaaagctcttgacagagtaactttattcatgcaggtaaattctagctcttttgagcaatatgttaataagtcactgctaatggcctaatagtttttaacttacaattaaagacccatgatggaaactggcagcaatttcataacccaccagtctaattgtttcacagtgaacaattatttgccttgcgaatacttacagtaaacatttctgtaaagtttatctttgtttcctaaacagtgatatttgttttgtacattctgtagatggaatatattctgcagtttggtttttctgctgcttagttgctgagaattgactgtgttgttgcacatagctgtaatgcattcattttcactgccctgtagtgttccattgtatgaatatactatggtttacatataccttgtattgatggacagtggacatacaggttgtttccatttttgatttgttagaaatagtgctgtatgactgttcttttatgtgtctcctggcacatatccttgaaatttacttagcattagaattgcttgggtttagggtatgcacataaggaacattactagataacgctaagttgatttcaaaattaattgtaccaatttccactctaactagcagtgtagaattgttgccatcgtttccacattttcatgaatactcttatcatacttcatatgaaataatcttgtgcacatgtgtatgtgtgtgtgttcaacagcctcattgtggttttaatttgaatttttctgccctggtttcctcttctgagcatgttcttttgggttttttaatctatgtctttattttaatgttgaactttttcttattcagttataagagtgctttatatattttgatcactattcctttgtgaataatgtgtgttccaaaacatttcctaagttatggtttatcagcgcattctgtttatggtgtcttgtgataaaaagttcttaatgatagaatagttgagtttatcaaacttttcctgtatagtttgagtcttgttttgagaattcatccctactctgaggtcataaaagcattcttacatgttgttttctaaaagtgttctagttttatcttttacacttaattcattgctttatctggaattaatcttcatgtatgatgtgaggtaaggtaagggttcaactttatttttctccatatggacaagcaactataataccattaccataatatattttaaaagtttcttcatctctcagtgatctgatggaccaactgtcataaattatgcctccaaatttgcctaggtttatttctgagttttctctttcatttgtttgctaatttatataacaacacaacactgttgaaattattacaacttttaattattgcttgatattttaaaattcagtctccctcccccacctcttattatttttcaggtacacattggtgactcttgtcttactactcttccgtgtaaattttagaatcaactcatcaagtttcatattctcaaaaaagtgaaattttcattggaattgcattgtttattggataatttagaaggaattggcatctttatgatattgattcttctagtccttgaatataatatttatctttatttatttaaatcttttttctccttccggaaaattttatggtttttctctatatgttttttttattacctatttgcaaatttctattagatttgttcccaggtacttgattttttttggtcctattataaatggtgtcttgaaaaaccatgttagcagcagttctcgttcttcgtatatacccaaaatcattcatagcagggactcaaacagatatttgttcaccaatgttcatagcagcactattcagaatagtcaaaaggtagaaataactcacatatccattgactgataaaaggataaacaaaatgtagtatatttatacaatggaatattattcagccttagaaaggaaggaaatgttgacccatgctacaatatagatgaactttgaagacattatggtaagtgacacaagtcagtcactaaaagaatactgtataatttcacttatatccagtgcctaccactgtcaaagtcatagagacagaaagtagaatggtgattgtcagaggctggtgggaagagggaatgggctcttattgtttaacaggtatgaggtttcagtttgggaagatgaaaaaatttctggagctggatggtggtgataattgaacaatattatgatataattaatactattaagctacacacttaatggttaaaatggtaaatttcattttaatgtatattttaccacaataaaaattatgtgttctaaaatttactgctggtgtatagaaatacacttgatttttgtatattgattttgaatctagcaaccttgccaaacttaccagttatagtaagttttttgcagctcgtctagatttctgtatatgcagtaatgtcataatgagcattttgtttcatcttttccaatcttcatacttttatttatttatcttgggttatccagttacctatgacattcaataatgtcaaatagaataataatagcaggatttcttgccttgatcttaaaagaagcgcttagaatgtttcccattaaatatggtattttgttttgttttgtttttaggtagcttttatcagattaaggaagttcccttcatttctagtttgctgagatttaatttttatcatgaatgactgtcagatgatttattgaaatgatgatgtgattttcttctaatctgttagtgtgataaactacagtaattgattttccaatgttaaatcaatctgtaattcgggggttaaacacaaattgattatgacatattatgcctttcacacaatgctagattcagtttgctgacattttacttaggatttttcatccaagttcatgagtccagttgtcttgtagtgtttttctcaaatcatcattttgaggattggtatcaagattctcccacctcagccttcctagtagctgggactacaggcacccactaccacgcccagctaatttttgtatttttagtaaagatgttcagtaaaaaaacatcattttgccatgttggccagattggcctcaaactcctgacctcaagtgatctgcctgcctcgacctcccaaagtgctgagattacaggcatgagccaccgtgcccagccatgtctctgtgttttaggtatgtttcttataggtactatatagattgattttttttaaaatttttttctcagacctcacagggatgaagatgttttaaaaagctcttctgaccagataatatttgtctgttaaatggagctttttgtctatttataattatagatcagttagaatttattttgtgcattctatttttgccctttctacattttttttctgatttcctgcttttctttgaattgtttcttcttacttcatttttttcttctgcaatttcagaaattctgtaaaccattttcattcttttggttgttactctagaaatttaataaaaacatttcaaagtctaaagttactcaggaggaaaggaaagataatgatgaatacagggacttttgaacactttaattcccatcagtttgttatcatttaccttaattctgttgtatacacccagcagatgatattgttcagaattaaccacatattttcccatgttctactcttcatttttattgctttcagaccattcatgttggatcacttttattctagataaattatattttttagagaatttttactatggaaagatactttttactctatgatattttaagttaacaagtttcactttgaatattgaagatgtcattctagtgtcttcaagattctacactgttactattgaaatataaggtgttatttaattgttgcttcctttaatgtaatttgttctttttctggctgcttttaagtctttcttttgtctttggtgttctgcagtttaaggtgcatttaggttgaaattattttttgcgtaacctgcttaggatttgttgtcttctttttttaattttaaattacgttttatttaacccggtaggtccaaaatatcatttcaatatgtgtcatcaaccacgctgcaagccctcaaaagccacatgtggccagtggctaccacactggaaaccatatgggacagttctatagaatggagtttagtgcgcattagaataaatgggaaatcttacttaaatgcaagctcctggggcgcgttcttagaggctatgattcagtaggtcagcaaagagaccctgggatcttcatttttaacaagtttccccaagtgactccaatgagagtggtctgcagaacactctttgagaaacactgatgtaggagattgttcagggcaaagcagaaggttcacctgactctcagggaaccagaataacctagtaaccatgggatcattgttacaggatccacatccctaagaggatgttccactgcagttttcatttttctctgactcaaactcagtaagtggattagatacatgcaggtgatgatgcaggtgcccatatgggacataaaaatttcaagttgggtccatttgttcttgcatcaaattatgttttaagtaaaatattaatattttaagtaaaatattttaagtaaaatattaatattttaagtaaaattttattttacttttaaaatattaattttttacttaaaacattaatttacttaaaatattaatattttacttaaaacataatttgatgcaagaacaaaatattaatattttacttaaaacatttaatattaagtaaagtattaatgatcctaataaatggggaaggagctcagacagaaccccattcccttcaaagcaagacaactttgaatagctgtgaatcttcataatggcttctctttatgaagccattgttttattcaaggatctactaattgggtaacaccatctcctatgcacaaacatgccctaaacttggactcagttacaaatagggatgaaggtaagaatggtcagactgtctggattttccttctcttagtgtttctcaaagcatggtctaaggaccagatagggccatgataccagacatgcaatagacagacctgcacatttgcagcattctcctccagagacagattcacatggtcaggtacagacccagaatctgcaaggtctgccacccacctccattctctgcccctggataattctgatacaggggattagggtgaaactagtggaacccatatataccacgctgttctcatcagaatgaaactacaaaattcactaacatctctcttgtttttaattttaattatacatgtactatttacaatagcaaagaaatggaatccacccaaatgcccatcagtggtagactggacaaagcaaacatggtacatatacatcatggaacaccatgcagccactaaagaatgagatcataccctttgcagcaacattgacagaggtagaggtcaccatcctaggcagaccaacacaggaacagaaaaccaaatactgcaagttctcacctatgagtgggagctaaacaacaacaacacacagacactaggaggggaataacagacactggggcctacttgagggtggagggtggtaggagggagaggatcaaaaaactatcaggtactatgcttattacccaggtgacaaaattatctgtacaccaaacctctgtggcacgcagcttacccatataacaaacctgcacatgtacccctgaacccaaaacaaaaattaaaaaagtatacatgtcatatgaataaatttccagttataaaatatttctttttttttttgttgagacggagtctcactctgtcgcttgggctggagtgcactggcacaatcttggctcactgcaacctctgcctcccaggttcatacagttctcctgcctcggcctcccaagtagctgggattacaggcgcctgccactacacacagctaattttttgtatttttagtaaagagagtgtttcaccatgttggccaggctggtcttgaactcctgacctcatgatttgcccacttcggcctccaaagtgctgggattacaggcgtgaaccaccacacccggccaatataaaatatttcaacaaatacaagtaaattaagtaaaaagttccctcacctcttctctaaatgtactcttcccccggggtgaccacttttatcagttaaatttaaggatttcttgtcttcttgtatctttggattgatatttttcatcagttttggaaaattgtctattcagtttcttttcaagtattgccaactcctcattctctctttcccttcctcttctctgggaactaagattatatgtttgttagaccttctttctcactgtctcttccttgactgtcataatttctgtactacattccagatgatgttttattttagcttccagtttgcttgttggctcttcaccagtacctaatctattgttaattctgattactgagattttcaattttgattaatatagtttttgtttttataatttttttaaatttaactttttatttggaagtgatttcaaatttgaaaatcattgtaaggtcagaaactgtgtgaataataccatataccctttacctagagcctctgattcttatttcactccatttgatttataatttgttttttctctctcggatatatttttttctgaccatttaaagataaatttcatacattatgacctttttcactaaataatttaggttatatatttcttaataggcatattctcttacctgattacagtatagttatcaactgtgaatattgctgcaacgaacatgagaatatagctacctctttggcatactgatttcagtttctttgaatttatatcagaagtaagactactggatgataatgtaattctatttttaattttctgaggaactttcatactgttttccttcatggctgtattaagttacattcccatgaacaatgcacaagggttctcatttctccacaccactgccaacccttacctttcatccttttgatatctcattgtggctttaactttaatttccctgttgatcagtgatgatgagcattttttcatatgtctgatggccatttgtatgccttctttggagaagtatctatttaggccctttgcccattttttgactgggttatttgttttattgctattgagttatttgagttccttatatattttggatattaaccccatattaaatatatggtttgcaaatattttctcccaatctgcaagctatttcttaactctgctaatcgcttttttttgccatgaagaagatttttagtttgatacaatcccacttgttaatttttgcttttgtagtcatattcaagaaatcttttcctagaccaatgttgtggaacgttttcctatgtttttttccagtagttttacagtttcagatcttacatttaagttttcagtccattttgagtttatttttgtaaaaggtgtgaagtaagcatccagtttcattgttctgcttgtggatatccaattttcccaataccagttattaaagagactatcttttctccattgtgtgctattggcatctttgtagaaaatcagctaaccaaaagtgtgtgggtttatgtctgtgttctctatcctgtttcattggtaatttgtctttctgccagtaccatacctttatgatcactgtagctttgtgatagatcttgaagtctaggtaacgtgatgtttctttttcattttttctttatgtagtcaatttatgaattcctattttcctaagcagtcttgaattcattactaaataattttagtactcatttcatatttggccagtggtgtccacatctaaaatggctcctgtaacctagtgatgtgctcatgtcattgatttgagcagttgtttatgttatggcataacaagatgtcattttgtatctactctgccttagtcctggaatggaaaaaagaaattttttgaattcaaaactgttgattctttatttaaaatctttaactctgttagtacatactaggtggtgttgattttttttgagactgttattcttcttgagacattacatatacttagcgtgtctgaaatttcaatgtctgaagcatttccaatgatttatgtatctgattgttgttatctgccagctttcactcatccttttgcctttccttacttgtttggtaatttttactgtgaattgcttatttccctgagaactttgtgtgagtattgcttgtttttcctggaatttttaggaattctttgacacctgggagaaggtggtttttaccagatatttgattatttcatgcctctagtgaaactacctgtgtgagaccatcttatattctcagggtgaggtttttcttttcagaccattttatgtaaattaaggctttaaaactctatgagagtcagcttgtcattatgcattatcagaagagattttttttttctgccggcaatactatttgagatgagaaattttcattgcaatttacttgagggagagggtagtttatttttagttcatctagcactgaatgtgtagtaggtcttttgtgtatagctctgttgggatcttctactagatgtcttacctggggtgggggccatgtgctatgctcttgatccctggatttgtgaagacttgaagccaaagctgaagttctaactagtttgggaaatattcataagaggaaacaaaaactaaattttttttcttctctttgctttatttttgacctgagtattgcttactttctgtctagctcatggatgtagattagaataatattttaaacttcattctgtttagtttttaaatcgttttcagtggaagtatcagtcttagtacctaatctcccatggcataaggctggaaatagccatgatcctgccaaacacggacactctgcaacctggaacaaaatattctactctaaaaatcaagtaattatgtcttttttcaataaaatataaagtataatcattaatgtaatttacttctttcattccagtcttcactcatgctttcaaacatagattatattattccaacccttcttaagtggaattagtatttcattattccataaggttctacaaatacctacaaagaccatcatgaattccaggtgctctgtaacctgatcaggttggagaactgctgatgcaaccaaatttaatcacttaatgttcttactaagcactcatttgtttttctgcttctatgacttgctctcactgcttgctatcccaaacactgtccgtttgtacatgttccaatgtcaccattcctttttcgggcaaatgcttcaaaagctactgtttctataaaactttcctttacccttctcttttgacttgttatgagctccttttgtagtttgtaatctccttaagagcaaatttcacaaatgttatatttgtaatatcttatgtagcagagtattctcacagtctagaacagatggttcttctgtatctgttgaaagaaatgggaagatagcaaagcaacataataggataattttatttttgcctactagactatctcaggatgtatgtgttttaaatcctaaaactggttagtggtatttcagttgaaaaggtcttgaccctttcccttctaacataacaatcctcatcataagtgagagagaagattgggtgagtagggctcagtgggggaagctggttcctttcacccaccttcagaaatccaggtatggaatacaggggttgttctggacctcaaaattacctttttttttttttttttttgacggagtctcactctgtcgcccaggctggagtacaatggtatgatcttggctcactgcaacctatgcctcctgggttcaggggattctcctgcctcagcctcccgagtagtggggattacagggatgtgccaccacgcctggctaatttttgtatttttagtagagacagggtttcaccatgttggtcaggctggtctcgaactcctgacctcgttatccgcccgcctcagcctcccaaagtgccgggattataggcgtgagccaccacgcccagccacgaaattacctttaaaaaggtggtctttaaaaggcaaatagggagatactaattgcaaaaaaaaataatgatgaaataagttatctttctgttttccactttttctgtggtgttccttttgacatttgcattccaaaccagagccccacaaataactgagtttgcactcttttggcaagcaaggactgctctcagatgtattttataacttcagcttatatgggaagaacttttctttccagagacggtttcatagtaatatccttcaaaagctcacattgtagaatatgacttttttttttctttgttgttatgtttgctttgttttggtgggttttattcatcatttcagccagcttatagaaagagatagaacttttgttggatactaaatcatgtctatcaaaagcactattgaccttgtgttgttaaaactaaaaatgtaagaacaaaccattttctaaggtttttaattatatgcactaaaacagagtaaggcctagatttattaatcattgggttatggtttgatgtggaaagaaccagcctataacttttccctttgtttaacaacgttattgctgaaaactttaatagacttaagtgtactggaactagggagtgaaatcttatctttccctgaacaccagggctgctttgttatggtgtttccatttgtggcataatgaatgtgtaggacgctaatgatgtggtctctaggtgttctcctactacacagagcactgataatgagctgcgagtaatctagtacgagtccctgaagatgaatcctgattaccttcatggggccattccgctctgctcccttcctccttgatgtttctgtaaagagcatttggattttgaagagagtattgtgtatttgacttttaattagatttgcagtgtgttgggttaataaactagggcttcttcttcttcagtttcctctaaagggatgtgtgtaaatgttgcacagtgggccaagagaacagagggtcataacaggcagcaatggtggtgtcgcccacttcatgccccagtcctgaaaagaaggcttatagtggctgaaggttgatttcatcccatggtccatagttacaaatggcttccaagctgccaaggacctgctaaacctattgcatctgttctgtacgaggaagcagtctcagaatgaaatatgacagttgtctgtcagggctgccccagagtcctgcaagttggtattatctgcttgcgttcagaaaacacatcaccgtggctgaccacagctttgtacttactgtgatcttagggctcgcatttttagggacaacttgccctttatgcctttggtccctttctgccttctgcttttgtttttctgccagttgggttcatttatcttctttcctgtgtgttttgccatgcttttcttattatagctttcagattcatcatggacagagatagaaagtactctagtgtctttatcccacctcagctctcagtctggtgtagagctaagggaaggagaattgccttcacagtcaactttcagtgtggtccctgaactttttattttgttcagtgaatccagcacatctcatattgtgccccagctataatgggtagtcctttcctgatcttctaagaaaattagatgcctggcttctgccttgctcttcattgttttttaagcatagtccttacatgatggtccgggccttccttacaggtctaattgtgtggctgggccttccttctgcatgcctattctgttttttagtttttgtttttcttttaagaattggggtctcactctattacccaggctggagatcagtggcataatcataactcattgcaacctcgacctcctggactcaagagatcctgccacttcagcctctcaagtagctgggactacaggcacacgccaccacacccagttcattttgaattttgtttttgttgttgttttgagacagagtcttgctctgtccccctggctggagtgcagtggcacaatctcggctcactgcaatctccgcctcccgggttcaagccattttcccacctaagccttcttagtagctgggattacaggcacatgctaccatgccgagctaatttttgtattttaagtagagaagagatttcggcatgttggccaggctggtcttgaactcctgacctcaagtgagccgaccgcctcgacctgccaaagtgctgggattacaggtgtgagccactgtgcctggcctgaagttttttttttttttttgtagagacggggcctcactgtgttacccaggctggtctcaaacttctgggcctgagcgatcctcccaccttggcctctcaaagtgctgggattacaggagtgagccatcatgcccagcctgcctatcctattttattctgaggctactactactccttatgggtagatccaaggatctgacatcattttcatacatcctgttcagtgtgtgagtatagaattgaggtaggctgacaacacaaaagtgggcagaggtttcccactcatccccgacagggattctctgttggcataggtgggctctggtccaactcctggccgacatgagcatggacaatgtggcacagttgtggctctgcatcttgtgtgtgactgctgccctgtttttgtttagcaagctgctgtgccaatttactatgcatgttgttacatattctgctctaatttgactgccattttgcttcagcgagacgatgattgtttatggcagggctgtaatgtgttgtcagcacaggttactcgctacttgttggcaatggcctaacattgcctgagacatggtgtcactgtgaaatggtttgacaatgttgagactgtagttatgttgagcagtaacaactgtagaggtcaagaaagggcatctaagaggaactgtgttcataggggaaagatggagaaggaatactaagtaggacagtagcaaatgtcatcaaagagcttcattttcacgcaattttcataattcagtctgttttctgtgaacagtgttggttcagctgttgctcgggagtagaagcacatttctgagttagaaatgaattgtgctgatcatgaccctatcattttcttctttgaacatttttagaaagttatccagcttgctgaagaatgcactagatccttgtccatgtgtgaggcaagggactcattgggccaccttcacagggtttcatttttggaacatttatctaaggactatcttactaccctgagagaccaagatgtaggctaccttaagtcgtatgaggctgctgtgaaaatggcatttgtttttttggctctaagaaattttcaggacctagtcaagcatgtgacaacaaatatttaatgatagtggacaaggtaaacttcaaaagtgactagaaacccttgtggaatctaagacagagggactctaacaagcttgatgacattttgaatacgttttgtattgattactgactcttttcccaataatctgtgaagctggctttctgtttggcaaggcagccccaaaaggaaccttcatcccatacctccatgcaggagtagcacagaacagcacccagcatcgggccctccagagtctgggagggttcggttgtctcatgaattatgtggtgcccttcaggaactcactttgacctctgatgcctttcctttcaagcaagtggtgtggaaaaatattaaaactctcagtaatgacagtttccagatatgcatatctttgagtggacaatgaaggcaacatttatattctgtccacgatgcgagcatggtatgcattctgcagctgtcacagagccttccttctggtaccaaataccttacttcctgacaggtatgacctctgagacctccctaacccctttctttcatttcatacaaaaatctagagcttggcttttttttttttccttctttttttgtaaaaagaggtttttccattttaaaaagccttttcagttcttaaacttgatcattgatatgttccacctcatcaaaaagaggagtgcagctaaactgacaatcagttcatgccattggcctcactcatcatcatgtcaaggacctggcatgcccattgagaagggcctctgtgcattctgtcctcaccaagcctaattccttcccctgttgatggttttgccagattctttgcctgttgatgcccatgccagggccacggtgcttatgccaaagcctttgacagaatgagtcaaatctggtgccagtcacccttggcatatgccaccttgttcttgaccacttcctaccagggatgggctgaaaagaatagtgtctgctaagagcttgtagaggacttttctgttaagtgctaagtgttgacattactccagtttgaatcagatcatttggaactcttgcttggatctctcaaagctgttgactcatttgtatcttggcctcacattagtggggtagataggagccaaaaagtttgagtgaagtcagaataaatatattttaagtgtggatctgtggagaagaaagaggtcccaagagcataatgaaaactgtggttaaaactgtgaatcaagaggtttgttttaatttgccattttcttacgaagttttaaaatattttctaataaagcttcttatttattgccttagtacattttctgttacttataacagaatacctaaaactagataatttatggccaggcgcggtggctcacacctgtaatcccagcactttgggaggctgcagcaggcggatcatgaggtcaggagatcaagaccatcctggccaatatggtgaaaccctgtctctactaaaaatacaaaaaaattagccaggcgtggtgttgcgcacctgtggtcccagctactcgggaggctgagacaggagaattatgtgaacccaggaggtggagcttgcagtgagctgagatcacgccactgtactcctgcctgggtgacagagcaagactccatctcaaaaaaaaagaaaaaatactagatagtttataaagaatgggaatttatttctgcagttatggaggctgaaaagtctaaggtagaggggctggggctgcatctggtgagaggcttcttggtggtggggactttctgaacagctccaaggcagcacagggtgtcacatggtgagggggtgagcatgctaacatgctagctcagttctcttccttttcttataaagctacctgtctctcaatattgctgcattggagattaagtttcaacacgagttttggagggggcatttaaacgatagcatatatatagtgcagcagtcccactcctaggtatttacccaagagaaatggaactatatgcttacacaaagacctgtaccctttttacactttttttttttttaagacagagtctcactctgtcgccctggctagagtgcagtggtgcaatctcggctcactgcaacctccgcctcccgggttcaagcgattctactgcctcagcctcctgagtagctgggactacaggcacgtgccaccacagctggctaatttttgtatttttagtagagacaggtttcaccatgttggccaggatggtctcgatcccctaaccttgtgatccacccgcctcgggctcccaaagtgctgggattacaggtgtgagccaccgcgcccggccaacctgtacactttttgtaatagccaaaaactggaaagaagcagtatacattactaggtgaaaattacagcatatagagataatggttatttctaagcacaaaaaagaatcaaactgatattcctaacaacatggatgaatttcagaaacattgtgctaagtaagagaaggcacacacaaaaaggtacatacttaataattccacttgtgttaaattctagaaccaacaaaacttatctgtagtaacaaaaagtagttccatgttcacctgggtgcaggggtgggaacactggctacagagttgcatgagggaacattgtgggtgatggaaatgttgtttcttgattgtggtggcagttatatagatacagacatatttgtccaaactcatcaaactgtatacttcaagtgggtacattttttcttttatgtgtattatacctcaagtataatgaagttgattttaaaaatatatttgttgtaatcccacttttgccacataaacagggtccagagaaatattaggtattccttctctctctctcatgtatatcctgatcaaaacatttatatgaacatattgaaatcagatttaaatatcagtttccctaatggactcagctggactcaagttaattgacttaataaaatttcgaatctcatttgttcctattttctcctccctacagttgttatctttactgttatttgaaggacttgaataagtgaattttgaattcagataatacactatagggagtaggaaagcagacccctggcctcaggagcgcctctttgatcatgaatgtctatgactgccattttgttctctagattcatgtctttatattgtctatttggcttatagttttttctatcaccatttttgttttcaactgttttttcactaaaagacaaaatttgattttcatgctattaatttcgtactaaaaagagcacagcaggcataattaaagcattttaagatgtagtaatttgatttaaaatattttactaagcgatatattacaaaaagttatttaattatctgtaaactttaaaagcaggtattagcattctatggctattgtctttaataattacattttaattttaattttagttttttaaatgtatgtttctttttgttgttgttgttctgagatggagtctcgctctgtcacccaggctggagtgcagtggtgcgatcttggctcactgcaacctctgcctcctgggttcaagcaattctcctgcctcagtctccggagtagctgggattacaggcacctgccaccacacccaaccaatttttgtatttttactagagacgaggtttcaccatgttagaaaggcttgtctcaaactcctgacgtcaagtgatccacccccctccgccttttaaagacctgacatcttagttgttactgtgaaattgattttcttgttttctcctcatcttaaccttgttttatatatcaaagtaaagaagaggaactgttaaaacttatatgaagtatggctgaatcttcaaaaagatatcaaatatttagaaactaattttaagctgcatatgttttatgaatggtagcaatacaatttataactgtcatttctgaaatctccggatttaggtctccattgccaaaaaatgtaaaaaatagaattatgacaagtgatctcttgaattaaaaccaaatgtttttgtattacaatacctgtgatgatgattccaaacaggcttctctttaataagtggccacagtagagtcatgatgttagcccttatatttataatgaggacaattctgggtcaccaagggcctggatatgggacccttggggcccactgtgatatttatggacatgaaatacagtcataggccatttatcagatttatcaaatttggaaacttccaaataaattaatttgacaaatatacataaacttcagtaaattttattagttttattttttgccctgtgtatttgcataaatgttactaggaaatatatttaataaaagtagaaggattttttttttttgcgtgatactcagctatattcttccaatagttgtggaacagcttagtgccttcagcagtggcagtctcctaaaacgattgtctatcagttaaaggttaactgagtatttggaccaagtagcaaactagaattcttttcatctaatctctgtttaatatagggatatccaatataacatccttgggtcagtgtagtacatcttacgttaagttttgtctctaatgaatatttatattacataaatgggaaaattggtgggttcccttggtagaaacatgatattggtatttttaaagtaaacttaaataggtcagaatttttatcctctagagaaaatttcacgtctgattaaatagtttacataaacttaatctttttctgctagatgcattataatctcagatattattcatgtagctattcctctgtgaaccataaaatgttcatttcttcaaaatgaatatgaagctcaaagcattagtggtcttaagagcataaaaactttattactttgtgcttcacatttttcaagtgactttggaaagccgaaacaaattttgcatttagattaatggaagatgttttccatgtgaaggaactggcaagggagcaacaataacaaaaatcccccaaggttaaaaatgtagtgcttttgattcttcccagaactgtgttagcagaacaatcatttctcagcatggaaaggtatcataattggtctatacagtggcaatactgaaaacgagtatgcttcagagaaagctaatatgactctacttaataatttccttcaagagcctgaatttgaatgtatgttccacccagcttgaggcaaacaatttgttcctataagttctagtggaagttaccggggggtcatgtaatttatttttgtcttgaagttttcaaaactgtgtagaaataaagacacgtttacttgcattgttccactagtaatttgatccaattggcaatgctcctttctcttcttctcaattctattatgttggaagagtggaagcgttcataaaatgttgtgacaaacaattcttcctagagacgtttcctctttctgtttgaacctctgatccacttgcgaatgttagcattctttttgtttgtttgtttgtttttgagatggagtcttgttctgttgccagactgcagtacagtggcacgatcttggctcactgcaaccttcacctcctgggttcaagcgatcctcctgcctcagcctcccgagtagctgtgactacaggcatgcaccactacacccagctagttgttgtatttttagtagagagagggtttcaccatgttggccaggatggtcttgatctcttgacctcgtgatctgcctgcctcagcctcccaaaatgctgggattacaggcatgagccactgcacccagccaaatgtttgcattatttagtaagtggttttttattatgggtctttacttacatgtgctgttattgtccttttcactgggattatctaggttttcaatctgtttctttgtattaattttttggctatgggactagttttaaagccctaccacagaagtagagggtctgtagttggagtacggtgagtaacatgagagaatgtttcctttttttccttgaagaatggatagttttaggggaatgtgtgcagatgtcagaagatggctacatagagaatgaagcatcagaaggtagacacaggtctctgcattgcaaatatcagtaacagggatgaagaaagaacagcaaaatttttagaaaaagtgtaaaggatggttagacacttagaccctctcttttataagtttgattgtgtacttctaagaagcagcaataagttgaaggtaaagttatctcaatactctgataagatgtggtctctggattcataccaaacattagagttcaaggcattccccttcagtttattttatattcctcaaatgtatctaattccttaggattaatgatttgtttctcttaaaaacagcatttattgctttaatctgagaaaaaaataagacttccagtgtttatatctacaaacacaaggattgaaaaaaattttataatcagcctcgctgctaattcttataggtgaagcaatgacttagaagaatggggagactggagtacatgatagttttgtagacagccacagttggcaaaagatggtggtgaggctgtccccgttgtaaatcctttatctccatgagagcaactgttgctggctagtttcttgtgaattaagtatgcagtttgtcttttttttaatgtgataaatgaacgtattttctaactggctatttgcttaataaaaatgagtaatataataaggaattaggggagcattggaaagataatcactgggaggtgagaaaaaaagttatctctctgcttcagtcccttattctcatctttatagatcagttctcccagtgagaagccaaatgggatgtcattctttgtttgtttgtttcattaattctttgcaatctatagtaggactgttgaggagaatgtataaactgcaggttaccagcaggtggaaggaggggaatgagggcaggtggtccataagcagaaatattaattcttgactgattgggacagtgaatattgaccaacattgaaaacattatattatggtcttatttaggcctgaacactgacagccagttgacaagtctaattttttataacttaaatgtggttcatttaggaaaaactgccatcaagggcaattcaattctattatgacaattaactctgactttgaagtaagtagaataaatcagtttatttctcagtaaggcccaaataaactgagattgttgtgaaaattatgcagtttgtgactacagtgtggatgttgtgtgttgggttgtgcagtgtacaacctgcaaagctgtatgaggcaacctggacattctactcctagctatatacccaaaagaaaatacatgtttctacaaaaccttgtacagaatgtttatagtaccatcattcataatagctaaaaagtgaaaacaacccaaatgttcataaactaataagtggataaacaaaatgtggtgtatccataaagtagaatattatgtagccataagaaagaatggagtaccacacgtgctacagcatggctgaaccttggaaacattatgctaagtgaaagaagccagacaccaaacggcacatactgattgtatgagtacatttagatatgaaatatctaaaataggtaaatccattgccagtggctgaaatggggagtgattgcttaatgggtatagggttttcctttgggggtgatgaaatgttctggaatcagacagtggtggggttgcacaaccttgaaaactactgaaaaccctgtgaaatgtacagtttaaaatggttaaaatgatacattttatgttgcataaaagaacatttaaaaaaattaatccagtggggtctgatggcaaattgacatgagggaacttttttgagggtgatggaagtgttatcaatctagattagagtgatggttgcacaactgtataaatttataaaaactcatcaaactgtactcttaaaatgtgggtgtattttatggtatgcaattatacctcaataaagctgtttaaaaaaaaccctctctgagtcattactgaaatcagtgccattttctgaatttcagaaatatcaaaggagagctttcctagtgtgaatttatcataaataatgtttggtattttttttcctttgacttaacgagagcctgagatgcagaaacaaatctgcacttccatgttgtgttacccgctttgggccatggcccatttgccagttgcagattgcctccttgtctgaaaatgggtgtgtttcttcatagtaactctcaattctattgttggtgacagcgcaataatggaactttcttctgtgtggataagccccttcagtgatatttgcaaatcaaatcatatctgctttttgtgctacattgtcctcaaaatcttctgattggtttggttatagacatccctatatcagctttcctgttctctttcagtttaaatatctgtatgctgtagcaaattgcattatgaaatcctctcacatttatcgctgtttagtgcatggaaatggcatttcctcattaccagtcaaagataaactctaaatgtttctttttttttttttcctgaagtatcaaattatgtattcaaaaaacttttctctatagcattatttctctgagctgtttcttttttccctcctgaatgctgacaccagatgcagtctgcatggacattagtcccagggaaatcttgtcttctacccaggacaaggagattataggaagcaatgctgactcttgttgtagattcacaatgtgctgacacgataataggacatgaatgggcttttggaatgccttttcctttgagctgggctgagagggggacagaggcagacagctccatggcctgaatttcgttagctgtgtgacaatgggagagataagtagatgtgacagttatgaatgatcctctgtcatgcactttcacgttcagattcagataaactgacactgctgtcaaacacaagctatggagagctgagacctctgatgaaccttctaatatggtaaatgggagtcttaattcttcattaactgaaaaaaggagatttggccatgtaattttctccttgctgcctgttttaaagattccaataacccagcatttacagttgactaggcagggattgcttttccccccctacacttgcaacatgcagactgtgaaatctgaggaaacgctgcttaaacccagacttattgccttggttatctttaatgactttgaaatgtattggcctcattatggaacagtgcagttatcaattcctctaattaggtgatgtgctcccataagaaatttaacattaaagcacaaaaatgaactcgttagaggcatctattgctgggaacttcagtatcaatggtgaattgaagatactgtgtttcgttaccaactcttctgcaccatacatctgactcctccttgaagactagagcatgggcatttttttctttttccttaagggtttaatcctcatatagcacctctaacacctttgatgacattttagtgcttctggatagtaaactgtgtgcctttgactaaatcgactaggagtctagggaagggaggaggtgagcagtttacatttaaatgctccacatatcagcccatctttctttcttggaatttaacccatggctatttactctttcttatgtaagtccaataaacttcctttctataagtagcttagtacagtctttgtttttatcacgatagggaccattatttgtttattaaatagtgatgctgtttcactcataaatatttcagctgtatttctagagaagtaggatggggtttctgggtttaggcttcagtgaagggactttaagtctcttaacccttctttacctcaatcatccatctgaacaaaaaaaatcattatagcctcccctttggggaaactacatagtttaattagtgttttctaataacttacaaatccttagagaaaagttatagtagaagcataagaaattatctttggggttagtttattattattgctattattatcattattactatatgggactagttgtttttttaaattggctacttgaaaatgtgtttcagatctcatggagtgaaatttacctttcatttaccttagggctcaaataagagtatactgaatataaaaatatggaacactaatttctttaaaatacctgaacctattaatagccaggagtgttaacttcgtcacctggaagaagatcctgtcctaacttgaaaatgttagaatgaaaaccttaatcgtctcctctcaaagggtcattgaggaagctgggcttgagtctgtgcagctgttcttcaataatgttatatcattctgaaccaattatcatccttaacccagatttgctttgaatctctgtggcatcttgactactgtctataacaacggtgattgccagacactgcctgatgctcaggtttctatcaatcctcttcttctcctcacagcaggtaggagcttcttggtgttccgctccttacccaggcttgaggaatagtcctactttttgccatgatgccttgctgcagttctggctcttcccttgtgctgttgttctctttgtcatgcaggtttcccagtatcttagtagaagccttgaacaattcctattaccttttcagaccttccttccaagaactgggggatgggggtgttctggtcttgtcacaggtgggtgccacatgtaaggacccactggttcatgggattctttgagagagtctgacgctcacttgtctgggttaaaagtctggtgctgacacctgctttctgaatgactttaagcaagttatttgacttctctttgcctcagtttcctgcctacaaaatgaagataatagcgcctgtcttatcaaggttcttagagaagattagatgcattaacacatgtaaagcacttagaacgctttaagtcacatagtaagcattaataaatatcagttgctaacagcttttgcttctgctctgttaccattttactatctcacctctctcatagcccataacagcaaaccaaactctttggctcttggtagatatattattcttaatgtttgagccctactatttgctattgcttccttttttactcctataatgtgtgaaattgaaataaaaaacagaattgaggccaggcacagcagcttgttcctataattccagtgctttgggaggccaaagtggaaggatcgcttaagcataggagtttgaggctgcagtgggctatgatagcaccactgtactccagcttaggtgacagagcgggaccttgtctcaaaaaaaacaaacaaaaacagaattggtcaccatgatattaaagagccatgaaatatattagcatgtcttttttctgcctatcccctctatcctaaacattccatgtagtcttgggaaataaattctttaaggtaggccagttattatgaatataacatgattatctattgtgttatgtttactgggttgatgccaaggaaaaatgaatatggcaggtcccagcaaataacaacaacaacaaaaatagtattgtctactatttcacagagggtgtggagttagtattgggttttgaaggatgaataggagtttatcagatgaggaggattgagaagagcattcagggcaaaggtatgtggaaaaattggtgtggtagtacacgccaatcctgggaccttcaagttgaacatttaggagtgtagtgtttatgtttcagaagcagaggatgagtggagagggcagcaatagaatggcattaagacccttgtacagtatactaaggagtttggacttaatcctgtgggcatgcaggaccctttgaaagatttgcagtgggaaagtgatcggatctgatttgctaactcattgcaatggctctgtggaagaatatcttggagaggggttcaagacttgagccaggggacatatcaagtagtgtttcaaatgctaactaccccctcctgcttctcacattgctaaatagagtgcagcagaatgaggtgtacttctgaagacaggtttttgaatcagctttccagcagtcccttgagtacattgagagggtgcatggagggaagacatatcatctttaccctgccctctccccatgttaatctattaaaagagatgggagcaaagctgctatcacattgggcttgactgaagacagaagtccttgagcatccttcccctgagtgcgggcaagcctcgtgcttgcagaggagaggagattagaataacatcttcactcttcggtgagagggcaggcagaccctcacactagatggttccaccccggagttcaggcttctcctgacaagtgttgcgagcatctgatgtccttggcctctcttctgcactgcttaccttacagcagttaagcatgagggcattctgtgtcttcctttctttcccttcagttgcttaaagaagatgagaatttgctttaaagaaaaatattaataaatctttataaaatggcattaaatagaaaatctcacactcttttcttcagaatgcttttcttcaattgccattgtatctttttgccccttccaaagtcttaccaattattattaatatatattatcataattacttgtagaaaatcaatagaattgcttgtctttatcagcagtgctacctttctacctctctctcccttttcatcctctcttcgtctcttgcgaattgttgtttctgggggtattattattgtaattacggaaattgataaaaataccatgacaatttcatgcctcagaattattacacagggtttataaaaaaagattattatacatcaatgcagtatttgttattcctaaatgattattccagaaatactaatcaaaaacatctccctgcagaatagtactgtggctttaatatcagctgctgtttctttgaatggggttgcccaatctttcatcaaagaaacacatcacccatatccctgtctttaaaaacagcaattatgtgtaaatgcctcctgatttatttgagccagggccactggccagtatgagtcaccacaatttattgctaaccgtcacttttacatgataggtctgtaacaaatatctgccgcatattgttaaattaatcttccatttaaaattaatggagttagactccccaggttcaatgtaatttcatgttcacgggcagggagggatgtgtgctgcatacaaaatgagacaaggcccaacgccctaatctttcatcaccttgaacctggagactaggacgcgtctcagcaccaactaatgagattgagcctgcgtctctcctgaggatgccggctcaaagaggcttttctgctcagaaatagcaggctctgtcttattttaataattcctcagatatgacaagtctgatgttatgtatgaaagagccaggcttgaaaaagagataaaatgaattttatatcattacttcaaaaccaaaccaagggaagtgtgttgtagttaaattaaaaaaaaaaaaagataggacacattttagtcatgaaatatactgactgtaaaccaggagtcatcctttcatttattttaatgcacaatcaccttagatttctcttctgtaatttttaaacctattcatgcgttaatcaaaataatgtggatgaaagcaggagcttgttcaataaacatttagatgaaaatatcagaggggacatgtaattcctgatggggtatgtcatactgaacctctgaagtcccatcgcttcttttggtggcatcttttgaaaatgcatcttttttctgtgtaccactaacctattactgtttagtctcttagactttaaaaatgcctaagccaaattactcaggggtattgggttctctcgtttttttttctgtctttttcacaaaccaggtaactattttgcatccatggaaaagaaggttttacagaacagatttcggctctcatacatctatagtacttctggcaaatggttgctgtttttttgtttgtttgtttgtttgttttaattcttagggaggactgagccccagagacaatgggacccttttcctaggtaaagaaaacgtctctagaaagacactaagttaagagccaggcaaggtggtgcacacttgtagtcccagctacttggaaggctgtgacagagaattgcttgagcctaggagttcaagaccaatctagacaaacatagcaagacctccagataaggtaaacttcctggtttttaaaaattctgtgagttgagttctgcttcctcagaggggaattctaagtatctgcactttgtgtctgatttatttattttatttttttgagacagggtctcactctgtctcccagtctggagtgcagtggcacgatcttggctcactgcaacctccacctcctaggctcaaacaatcctcccacctcaggagggagctgggactacaggtgcctgccacaacacctggctaattttatatgtttttgtagagacaggatttcatcatgttgcccaggctggtcttgaattcctgggttcaagcaatctgccggcctcagccactgtgcctggcctgtgtctgatttataatacaacatatgattgattttaaagctcttttttgtgatttgttgtaatttgggaccacaataattttttttccaaccccttcttcagacatacataataaaatttctaaagaagtagtattggtattatactacctatagcttttattattattattattattattttactggcattctataacttagaattctattttcttacaatctttgtatatttaaatgaacattagggatagaaaaaatgtaaactctaatacaagaatcaagtatagtcacttaattgacacgtgcagttttaaaaattatagtcaccccttggtatactgagggaattggttccagtaccccctcaccttcacccccatatatattcaagtcctgcagtgggtcctgcagagccctgtgtatgaaaagtcggccctctgtatgtgtgggttttgcatcttttgaatactgtattttaaatctgcatttggttgaaaaaagtctgcatgtaagtggatcaaaacccatgtggttcaagggtcaactgtgtatcactttgataggctatttataagagaagattttaaaaatattgctccatgtctgtacttgaataagatttagaaaatcttaggggtattttagaaccagataaattagtaaaaataatgatactgtaaattggaaaataaatgaataatagtagggcatctttctccatgaacctgaattgctttgctttcctctcttttgatgtctgtaagctgttgcgttttgtacagtgggcctcagggtgcttcgtgagtcccaaataccagatttctttttctctcttctacttatagtatatttgccttaagttcttgatattttcttctgccctcttttcttcttttaatatcttcagcatttttcttcttttttctttctctccctctttccttcccttaaaagggcttctttattttatatagaaactcatctttttttgttttgagacagggtcttgctttgttgctcaggctagagtgcagtagtatgaatcatgactctactgcagtctaaacctccctggctcaagcgatcctcccacctcagcctccaaagtagcctggacctcaggcatgcaccaccatgcccagctaacttttgtatttttttagagacagggttttgccatattgcccaggctggtcttgaactgagctcaagcaatctgcctgcctcagcctcccaaagggctggggttacaggaataagacactgtgcccagccttcaatttttttgttattgttgtgagtgagtgagtgagaaagagagagagagcgcaggttgatatgctcaagcttaaggtctgtaatgggtttaaagctccaagttttataatcggaatggtagagacggaaaggatctctgatctaatccatcctccatttcataggtaatgccatggaggcctgaaaaggttaaggttctcaaagatcaaaaatgtatccttttggaaagtattatagtggttcctcaaaaaaatttaacagataattaccatatatgattcagcagtcacacttctgggtatataatcggaattaaaaacagggacttggacagatacttatattccaatgttcatagaagcattattcataatagctaaaaagtggaaacagtccacatgtatatcagtttgtaaatgaataaataaaatgtggtatatccatagaacagaatattgttgttacttttgtttttgagttgcattttattctgtcactggggctgaagtacagtggcacaatcacacctcgctgcagcctcaaactatggggctcaagaagtcctcctgcctggtactacagacatgagctaccatgctcagcctggaacattattacctagccttaaaaaggatgataattctgacagtctgcaatacgaatgaatcaatgtaatttgaaaacattatgctgattgaaataaactacacacaaaaggataaatattgtgggatttcactgctatgaggtacctagagtagtcaaactcacagagacaaaaagtcaccaggaactgggaagaacagtgggatagggagttacccattcatgggcacaaggtttcattttgggatgatgaaaaagttctgcaaatgaatgttggtgatgattaataatgtgaatactcttaatgccactgaccatatacttaaaaatggttagaatggtaaaaaaaaatttgtatatttgccacaataaaatacacagacactggtatgatttggctctgtccccacccaagtcttatctcaaattttagttcccataatccccatgtgttgtgggagggatctggtggagagaattgaatcatgggggcagtttcccccattctgttcttgtgatagtgagtactcacaaggtctaatcattttataaggggcttttttcttctctgggcactcattcttctctctcctgccaccttgtaaaaaaggatgtgtttgcttccccttctgccatgatcgtaagtttcctgaggcctccccagccatgcagaactgtgagtcacttaagcctctttcctttataaattacccagtcttgggcagttctttatagcagcatgagaacgtattaatacagacacgcacacattcttttattacctgagaaaatttctggcaattagtatgtctgtcctcctctgcctccatctctgtagctaacatttggacattcctctgtttcagtttcagatttgctctcataatgtttttgaatgttacatctttccctttcttatttcagttttctttttttctgacattgagtacgtgctttgtgatagtcactagagatacaaatagctcagaatcaaagaaagagtgtacatgaagtattttcaagaatatgcctataaaatattcaacgatttctcagaaaatatcaattgtaaaataaataaaatacaacaaaactttcttatttgcacaaatgcgtaaagtacatgtagtctaatttaagtagtttttattttttttctctaaagtaaattttgtgactttttttttttttttgagatggagtcttgctctgtcacccaggctggagtgcaatggtgtgtgtgatttcggctcactgcaacctctgcctcccgggttcaagtgattctcccacctcagcctcccgagtagctgggattagaggtcccagctaccacacccaactaatttttgtatttttagtagagatagggttttgccatgttggccaggctggtccctaactcctgaattcaggtgacctgcctgcctcagcctgccaaggtgctgggattacaggtgtgagccactgtgcctggcccaattttgtgaccatttcatataatattataagtattcctttactaaggcaacctgttaatataggtctctcagttgcaggcttttcttattctatggattgactaagaagcccccaaaaatccttatgaggaaagatagagtcatgtgtcataagagaaggctagtaataggcttgagtttcaaagaaaagagtttatcagactgaggagtaaagaacgttggtaactggccttcaaaagatagttaagattgcatccggaaagatgtggggaaggggatgtaaaatggatagcaaggcaggatagcaacagggcattcttggaatagacaaccatccatttgttctcagtgtgaaatatacatggttttgtaatgggaattaaggccgaaatggcatgtcaaggccagtagttgagagctttgtaggtcacattgaagagtttgtatttggagtttgatggactcctaggatggatctgtccagtggacaactggatttcagacctaggagagcctctatagaggtattaattgaagcctttggatgatcgagattgtgaagatagaatataagacagagcctcttgagcatttctcccttagtgagaagaaggtggtgatacacagaaggaaccttcagcaaggtgagaatgatagataaaggatggactttccccaagaaacctggcaagggagtgatcaggagtgttaatactgtcacagagactttaaagaggatcacaaatgaggggaaaccttggattttaatcttgactcttagtactcaaggaaactgcatgttaagatgtggtaattaaagtattaaaatattctaagggtcccttgcactctccctttctgtgcccattgtgacagcatggtcacatcattgcttgaggcatgcaagagtgctttattgaagatagtattacggggggagattttattttgatagagagtaacaaatagactaataatctatcttaaagtaagtatcttaaagtcagtaggcaaaggagaaaaaaagatattgataaggaaagcatctgcaggacagattctagatttctgttttttgttgttgtgtatgtcagggcccagactatgtaaatgatagggcaaaatgtgagtagcaacatagtcttattagaaacctaaatatctacaaagagagcaaaaaactatcaagtcaagaatatgttacccattttagtaaaaaggttagatttcatttgccttgtgtatttgtgtgtgtgtgtgtgtgtgtgtatgtatgtatgtgtgtgtgtgtgtgtgtgtgtgtatgacagtactgtattaggaatgcttagtaggcatttggagaagttttgggtgattggtaacatgaaccattcttccctttaatctggtgcatctgaacatattcctgggcagaaggtatacctgtgcacattacagacgtttgtgggtacttttatttcattatcctcaagcaagaatacgagattgctatattctacattagaccaacttgttcttagcaagcacagaataataacctttcagtgtgaatgtttgtacataatagtagtaggatgtattttgtggtattttttaaatgaggattcattttaggcttggcacagtggctcacgcctataatcccagcactttgggaggctgaggcaggaggatcgcttgattgagcccaggagtttgaagccagcctgggcaacatagtaaaacttcatctctacgaaaagtacaaaaattagctgggtgtagtggcacatacctgtggtcccagctacttgggaggctgaggtgggaggcttgagcctgggtggtggaggctgagtgagtgagagtgtgtcactgcactccagcctgggtgacagagtaagacagtctctcaaaaacatacatacatacatacatacatacatacatacatacatacatatgtacatgcatacatacatgcatacaaatgaggattcactttaaaaagcattgaaatgtaaatatcagctatacctgaatgtttataatttaaaggtaagattgtcattaaaggaaaccttaggaatttctcagacatactgaaaatcagcccgaaagtgttttctgttgtttggttgttgtcgttcttttaggattttatggagtactctcattacttatcacttagaccaaaagagaatgtcaaactgccaacaaagttgttttttctacatttctactaaataatgttaagtagtcaggttcatctttggaaggaagattcttaagtgctttggcctccagtagtttagatgagacttcttaaaactcaaaatcattttattggaaaatgctttattttctgtctttgtgaattatatttataataatgcatttaatttaggccttgggattttgtatacctttgggtgggcctcttcctcttctccccctgcatctctaataagcactgaatatcaaattgaaaccatgatattctgaaatcggaaagtttctgccttttgcagcttatttgatgggaataaaaatgactgatggcactctctcttggacccttttgttcaactcacctatgattatggagcctattagctggagttacaacctatttaagagcagtgcttaccagtaatgggggccaaatgattttggaaagttcagatgtactggactccctgcagaaatgaattcagcactgaacatattgatgcagaacccgaacgaggctactccagtgggacaaagagaattgtgagctctgcaagaaatgagtgggtagtagaattaaagatcagatagatgttcggctcaagggcagtctcagctcttaagttcatcacagcaatttaatcaggcccaaatgagcgttgcccagaaaggaatcagccttcggtgtgacaggaaatggagtttatttaaaagattctttgtttctagtaattgtgtgttaaggttttccaagtctacactaaaattacggaactactacatttgataggtgatagcactttggtttaccttggttcagaagatgtactgttgagaagatttatacaagtcatgatcttgtccagaaggagcctgccacctcaaaagttccagctctatcgtcttttggattaagtaggccagagtgcatctttggctatagctatctgatgcccccttccattgtaaaattattttcacaaaaatatatttgtctacagtaagagttatataatatagcagtaaagaccacaaactttagaatgaggcacacctgggttggaatcccacctcctccacttgttagctatatgaccttgagcaaattacaactgtagttgaacacatagttctttacttacgaaatgagaataataattcctgcctcacaagattatggggagaggtcaattaaatgatgtagtatgtatcagttgcttcacaatgtctgcacataataagggctcaataaatagtagttacagctctagagctctctcatcttgtccctcacctcatttgcccactcctctactctcttcatgagccagagtgttcactgctttaggaataagtgagggaaactttttttttcttttttctttctttcttttttttttttttttccgagacagagtctcgctctgtccccaggctggagtgcagtggcacgatgtcagctcactgcaacttctgcctcccgggttcaagcgattctcatgcctcagcctcctgagtagctgggattataggtgcccgccaccatgcccggctgatttttttttttttttttttgtatttttagcagagacagggtttcaccatgttggtcaggctagtctcgatcttttgaccttgtgatccacctgcctcggcctcgtaaagtgctgggattacaggcgtgagccactgtgcccggccaaataagggaaactttttagaggatctttggcttcagtcatggagaaaaagaagaaactataaacacttggaggtctgaacagttcattgattgttaagaacccaaacaaaaacactccgtccccaaccccgacacaacaatacagtggggtattttggattgacacattattagcctggaaacctatattgacagccaggttatgattttacacatgtaataagaagagtctattggtttttcttctttgttgctcactagttcttaagtttgctcactaatgtataggtatttttgtctaacactgacaaaatttgaaaagaagtataataaatttattaggattttacttctctccttcatggacctggcaaatagtgtatctatgtctccatacccatatccacgttcttattttttttatctgtatctattatctgtctctgtgtgtgtggaaagtgataatgaatgaatgaatgaatgataaaagatccaaactatgaactttatggatatcggggtaaacatccaacaatcccttaaatttggtgcactcaagtaaaagctgaactggagagagttgaccagatcctcttaaagttaagctttttatccctctgcccataatttgtaccttgagatcctatagggatgtgcctaggcctgtgtgaatggcagcctcatctatgctgtacctgcagtacagaccagcctcatctgtgctttacctgtaatacagagcgaaacatatctagagaaagagattagtttgcaattagggggatcccacccattccacagcttggcccagtggaggttccctgctttgatcgtctcttggtgaagagaagaagagacagcaagtgctgtagaaagttttcttctttgtagttaaagtgatagggtggaaacaggagcatagaaaagacattcagagaatagaaagtgaccaaccatttgaaaacctaaaggaagacctgggttcaaacatttgttaacatacagagaagaaaaatatgatctgtttggggtattacaatccagtgtgtattttctatcatacttaccaaatgtacttacttgttgtaaacatttaatatttgtttagtgctttgaagattcggagtaatgtttcagatctacatattgtatcaataagcaaataacatatgctaagcacttaaaggctattgtcattctccagctagtacagagcaaatgtgaaagggtaaagactatgtaatttcaggtgcggtttcagtgaggaagccagaacagcagtctactcttatctgctgctttcttccaccccaaccccctgacccataacaacaaaaatcaaacccagaacaaaccgcatagattgatcaaagagcataacatgcattgttaggatttcagatatgtagacagaaagtcagattaagctttaatgataattttgagttcttggagcaatgctcattgattacaatgtgtgtgtgctggggagcaatatttggggtacccataccttccctgggcatgttaaccttgtggggcttgccttgtttcagaacatgtttcctattaaaaaaagatgactgtaaaatcgtaggccttttctagcatgcacctcaaaactcttccagcctctacccatcacccagttccaaagccacttctgcttccacattttagttatttgttacagcagtaccctcccttcttggtaccagtttttgtcttagtccactcaggctgctataacaaaataccaaaaactaggtagcttataaacaacagaaatttatttctgacagttgtggaggctgggaattacaagatcaagatgctggcaggttcactgtcttgtgaggcctagtttctggttgtagatggcaccttctagctgtgtcctttacatggtagaaggggtacacgagctcctagggccttttttctaaaggcactaattcactcatgaaggcttcaccctcatgacctaaccacctccactaaaggcccacctcctaataccatcaccttggtagttaggatttcaacatgtagattttgagtggacataaacattcagaccacagtccctgtgaagaaggtatttgttattctggcagtgcaggagcaagctagcacacttgccatatttagctgatagaagtaatgtgaaatgaaccgttaggaggagggattttgtggaagaaggaatggcggactgagcaagataaaatatggagaattgctccctcttcaagaaacgcctccatcctgatgtatatcagctttcatatccccatggatattttacaggcattgctacctctttaaacatttatgctattaaaaaaatcagaccaattgttgacataaagctaacatagcagcttctatatagacagaatatgaattttttatgctgttgatgagaagtttatgtcatttatatactatagtagggtagaagatggatttggaatcctgaaaaagctactgtttgtaccattcagaatattagcttgtgctttgaatcgaaatattaagatacctgtattgtcaatgtgagtgtttctgtgcaaagtggcttacatatgggtggaatgggagaaattgctctacctggagaaaatagcaatagttttctttcgtttatgttttgttttgtgaaaggaagggttaatagcatttaatacctgatttatctgtgcttctctgcaccattaaaagaatgaactgttgtggtaataaaaccatatttcattgaattaaaagtgccatcacttgcaagatgcaacattattttatgtacctctaaaaaactacactaacaaactgacatgtcaaactgacatgccattgatgttaagatgcattccaatttcagagatgtaaatatactttaaaatgtatatcttggaatcaatgaaatactgcatatagttcttttgtggtatgtgtatatatgtatgtatacacacacatatatacatatgccacaagagaataaagtatacttctatttggttatagtctataatattttgaatcattttactgagttaggttttacttattttttaaagttgctgttgacatctgtttgataccattcatttaacatggcatgaatttagaatctctacttagaatagtcctttggaagccctagtttgttgagttttcaaaagaaaaaagagtctggtgcaaggaggcagactgacattcaagtcagatcattttttaaaaaaggaaagaaaggagggagggaggaaggaagaaaggaaggaagaggttcatcctgtcagttaggaaccagctatcttacttttcaaagacaaaatcagatcatactagtatatcacaatcccgtagtttatctaattgcatatttataattcttcttggatggtgtctctcatcttggattacctctctcacccaaaatcatattttattttgttttgtcattataaaatttactatatgatcattgcaaaacaaaaacaaaaaattaccagtacatataacaatactggatgtcatatattaagttcacaataaattatggcgatttttccacatcaataccttatcttcatgtttcacatcaatacataatcttaatttttagtgactgcatattatatcattgtatagtaaaacataatttttaaccatttccctattgatggacatttagattggttgcagtttatcactttaatggcatggctgccatgtactttctttttgtcacacttacccagtgatcattttaggatcaattcctagcaatttctggattgctggatcaaaggctctgtcttcatgttattatgtgttgggaagggaccatttcctcatctgttcaccaatacaggatatcagccatctcccaccccaccccatctttacctacttgattggttaaaaaaaaaatctatttttgtttttattagcatttttaaaattgtagttgaggttgaacaccttttcatatgttttggccttttcagagtggttcttgataatagaaagcacagcaggtcagagagcaaaaggtcttaatgaacttccattctgcttcacagaagcctatgaggttttgaggtaactttctcaagttcgttataaagaagatgaaactgatagaaaataactgtgatgtagagatggggtctggcccactttcagctggtctactctccagcactggaaaggaagactgagcatcagaaagccagggaagatccctccagaggtccaggattgttctgaggaatactgaaatcaaaaactctagactccttcctgctttctgagatgcagggatttgacagagaggtcaaaaaagggcccctttcctctgcatgtgcagcttttatttactattgtttcctttttgttgtattgaaatgtcttcattgcttgcctttatggatacaaataaccggatactgtaatttgaaagtagttaacaatgaaactgcatagtatgagccatgctgatttttttttttagtgggcaaatggggtgatttctctatgagcctctctgctgtcagaagctcttaacatttgagtcaacatgggaattatatttggaataaattagtaaattcccattcagcatgcctataccatgtaatcttcaggaaccgtaatgactgtgtagtagagtatatttccaacttggtatttataaaacacatttgctctgagaaacccttcagtatttgttcctcaaggcccagccctcatgctgcctcctttgttagtcagtgtttattttgtaatagttgggacagtgttgtacagtggaaacccatttgtctttggagttagcccagacataaatggactcttaggcctgctatttactagcagtattctcatgtttggaaatcaggagcaatgtaattgttgagacaatttattttaatgagagtaagtcatgcagtaagcatcaatcttagcacatatacatgttgtctttttttgtctccctgaaatcttcttcagctgcttccatgtactgatatcttcttccaaattccttaagagccttcatctgggtcatacattgacatttatttgatacttaatattgatagttatctcttgatgtttgtgtatgtctttgtatccataggatcctccattagcacatgtattcattcatcaaatatttattgagccacttctgtatattaggcatagagtaagatgctggaatatgttaatgaacaggagatgtggtcactgtgccctcctaatgcttacatcccagcaggcaagacctatatgaaacaaagtttgaattactaaatgaaagacatggcagttgctattagcaatgttgtaaggggctgtgaatgtagactagcttgtacatgacatttgagctgatatctattggctgagtaagagttagccaggtagaggtgggagtgataagtctttaggcagagaaagcagcacgttcaaagactctgaaacaggaaaggacttgtttcagtggtgcaatagaggatgagcaaaatgttctcagagaatggagtgcagaaagcaggccttcagagaggtcattggcagcgtaaaaatggggtaagaacggcaaccttgtgcagggtcttgaaggccaggtgtaggttccagtctgtcacctgagagcaacaggaagatactgaagggttaaaggtttacctgtggaagagtatcagtaaaacataaatggatagattctaagtgagtctactttaagctggagtttggagtcgcagggtcctgcgtgtgtaccaccatactctctacacttttaaaactaaaacagaaagtattctaaaacataaaacaaaactggattgtattttcaactgttccttcaactctgaaatactatgattatgctagagtatgagaaattttattttccaaacaaatataaagatgtatttctgatgaaaaacattttcaacctaagctaaaaggaaatctaatgaaaactttaaggatcctttaaaatactaatattgtgtttaaagagaaaatgatacttgtctttaaaatgttttaaaacatttaaaatatgctactgaatataagtgaagagtggtagatcctaaagtagtatttcttagaagagtagaataggttatttccaaaatctttttcatggaattttagtgaaagctaccatagggatcatgttgtccagcctctttgtccttataaaaacatcaatatcttcataaatcaagaaaatgagtcccaaaattggacacatgagctacccattttctaagattttgctgaacggaactttgatcataggggtctctttctaaggcaacgtattagaaactcccagcatcactgtattccttataagaatcatattttttacattaatctccagaatcaaactacaagacaattaagttgttgcttttaccaggttgaaacttgccttgatttactatgaatgttggttgccttgatttcttctactttttgtctcagttctacatgttgttgttcttctggttttgctccttatgagattcgctggatctctgtatctcttcaactgtggtgagtttcatggacagggtcagaacttagggaaatgttgagaatagggtgtggtcctatgatgggtcctcctcttcttacaccttcgactgttgtaccactctttgatgttacaaagatgaatgacttgtggtccttggcccagagtttcatattctggataaattattatttatttgtagtgtacttctatatttttacatgctgtcagaatattagaaatacagtgtttcctgtcagaaatgccagctgagcaaaagccagtaagtcagatactaatgaatggattagcaaattatagggactaatgaaattaaataaagattattcaactaaactagtggctcctcccagtagtttagagcgttgctgaccaccttctttttgtccactcacatattagaattaaaaatgtcaaagtaaaattaaaataacattctcacctacaagaggtagggagaaggaaagtaatatttatctttaatgttattttcagttgtgcatttattatgtatatttttgcataaaataacttgtagtttttgtttggacaagccaatcaaatgagtctttaagatgaagaaggagagcgaacccacaagagatgagtttcgtatgtcttctcaaaaaaaaaaaaaaatttttttttagctcaccaaaaaatgttatgaaatgagaattttgaaaccttacctgtggaaatcacagtggtaatacttatatttcagcccttagatattcccagtggtgttttgatcttagatattcccccaaaggtgttgattagattctggctacagctgaaggaagagaatttttgctttttagctgaatagtaaaacaagcctctaaagatatgaggcatgggggaaaaaaactaaaggcttcttcaaggtggtgtaagggcataatttttgtcatctttattttaagagctctaccaggccagacgcggtgactcacgcctgtaatcccagcactttgggaggccgaggcgagtggatcacgaggtcaggatattgagaccacggtgaaaccccatctctactaaaaatacaaaaaaaattagccaggcatggtggcgggtgcctgtagtcccagctactcaggaggctgaggcaggaaaatggcgtgaacccgggaggcggaggttgcagtgagcccagatcgtgccactgcactccagcctgggcgacagagcaagactccgtctcaaaaaacaaaaaaaaagctttgccaaaggtttccccttagtaaagaatttaatacttgaagtcatcagattagatttcagacttcatttacccgctctatgcatttttttcgtcttcctgggtttggtctgcctgtgcttcttagtctacaggtgtcttttctctgtactgccaacctctaattggagatttattaggtgctcttaagtaagagaggaggaaggccaaaggagacagaaaatggagaagcaagaagaaactgatcaaggcaggagagggaggaactggagaggatggagataaaagatgtataaatgaagacaaatggaagaacaatgagatagagaggcctgaatggtagaaaaattctaaaactgagctagtgagaatgcatataaaataggggtctggtagaagaacttcagcaaaagtggtgtaaatcaatgatgagtaaattaatagggcaattgtgcaaatgggactcactcatttatactaagcgtaatacatcatgaatgatttagagataatgcaacccgtagggcataccttttaatctacccaggacccggtagagaatgctgtcacttcaagagtaaaaaggcagaggatcagaatattgggtgtgtctcttcattctaacagtgttaatgagatagattctgagcaacatgaaaattaaccagactcacaagcttagtttgtgatttatagattgaaaagaagcttaatatattccaaacatcttcctacaaacccaaaatatttaagtgttttgaaagtattcatttgaataggttaacatgtgtgattgccatggatggaaatgaaagtaaaatgagtcactgcacatatgatccaaggaacatctgagtgttaagtgggttgtaactgcataagaatccagtgctattggaagatgcatcagagtattctgagaccagggaataaaattctcttccatgtgctcccttctctttcattcgtgtgcctattcactcaccattcaataggtgtctatcgacagccttctgtgtggaaggtactgaggaatgtcctatgggttgctgcttctacctgaaacagaaacataagatttacatccctcaggccctcttaccagtatttttatgggaggatattgaggaagggaagggagaaagtgaatataagaagtggagagaagtcttggtttatagagctgttagggttccaagtctgctgttctttcttgattcagaaatggaagctcacaaaggttgtgtctggaccaaagacccaagatagttggagtgttgaggattagatgattttgggcttcccttctagttcattcttagaatttattcccagtttttgtgtttatgaaagttagagatacagtcttcaaccattaggagttagaggtgaaaataatagtaattggatgttaccaagtatgtaaacacttgtagggaagggaaatacataaataactaaattctctattaaattctgattctgaaaacttcaaaacagacctaatttagtaagaggggctgcatttttatatgtgatcccacagaatgcttctagacttctgtcactgatggggaaaaatcaaattattcaaagtcttgcaccatataacaaaaaagctaaactaagacgagatttcagggagtatagaaaccagcaatttgtgaaaaatcttgtgtatgaagagtcatgatgtagaacattcaaacaaatggatcacaagagatttctcaaagcatgtcttagaggtgagcaggcaggcatcaattttaaaattctctgttataaatgatcataagcttatgtttttctgtgtaaaggagaaataatttcccaattttataaaacaaattaccaatgatgtaaaaaaaacatttagcacagtattatatcagagggcatttaacattcttttgaatcatttgagattttcatgtttccatttcagagatcagggaagatgtgccttggagaggaagcatgtcttaaatctggaaatgatatgaagagggatgtcagcaacacttcatcctgggccagtaatagggagagtttcttttctctcgtcaaattgcttaaaggattctagttccgtttggtgtggtcactcacatttgaattctaatactctatgtgatatagattctgttgactactgttagcgtgaccccaatgagaaattaaacacttccctccttttcatttgcagtgtgttttagtttaaccttcatttgtttctcttttctccattcctcatcccaattcaggtatcagatcctttgacaattgttaacctgcccagctgggatttttggcattaagctatgactgtaacgtttctactaataaattagattttttaaaagagtgctgcttgccaagaagcaaagtcattacatagtgtgtatatgttcaatgtatggctataaaagtctccttagccaaacataatcgacagttaaaataaatttaaaataaccgtgctacctctagattttaaaattgttaaggtgaagataggtggtctaattttactctatttccatttttcttattcacagggtatatttgttctgtaaaaccacatatgtatcttatagtctgcagctgatgtatttatctgcctaaatacacatttctccaatggaatattctgtaatatcaagcatttcttttttagatggaaattaattttataacagttgaacatcatctttgtcaatcagcagctttatctaccataaagaacaaaaacgtacttggcgtggcctgctttaacttttgtagttcctatgtttaaactgaacagaggaatattatgtgaacaaattggaaaattatataaagaaataaaaatctttttactattatagttatctttaccccatagctttcaaaaaggcatttgaagcaatttaataaaataggaataacagtaagtactagatgtgagaggtgagaaaacaactttgtaaatcacccatctcacgaagttgcacagaggttcctgatagcccagacaatgaaataatgtgataattcctattttcagaaaagataactagctccttattttgttttgggtgtagaatgggggaagtggtatatttttgctaagttctaaattcttaggaaaatgttcacatgggttttgagagtcactgtataactgacaatgtccccagttacagatttccagaaaattcagacatggaattcatgttactcattttagttctaacctttgatgaaagattagggcattagattgaagcttaagtaagcaaaggcattcttcaggtgatgtggttcattctaatcagtaattttatgatggtgttcatattccattccaatgatcaaatggactagtaagcttgagaaataagacaaactagagagagagattattttataaatatgaaggaggctagtgaaattttggtccagatggaaagccacccactctcccaggtcaggactgcatagatgaagtataagcaaaaccgtcattcacactttgaaggtgctgctttagagagatgtcattatatgtggtgtcagatttttcaccctgttcagtactgggcactgatttttaaaaccacttatctatattttttaaatgtcttctgactcattggattgattttgtggacctactggtagtctttggatatcccccagttaatctttgcttccatgatgagcatttattgaattctattcttatgccaggcactgtactagattttaggagtacagtagtcaggttttccttgccttcatggagtctctggtcaaatactttggttcttatatagcggttcatgttccgacacgtggttacccacacaggctttagttaacatctgcatcacctgctgcacattctcatctaaaatgcgtatgtgaaagtacagttgtagccactcagtgtcactcaccagtggggctttaggcctgagactttccgatagcctctaattatgtaaaaccatgcctgtattcaggagtcagaagtgatcaaaatgttttaggaagcacaccgtcagcatagatgtgtcaactcagcagcaagatttttcattcttttaaagttacacatttcataaagaagaagggtatcagtgtaaacttctaaatgcaggacaaaatgcatgattggggatggagattggagtggacttgttcaaagagcagcagcaaatgagacattaaaggaatacataggaagccacttccaagtacttccatttttctttagttgtgattgtgagatggttccctactagttagagaaggaaaattttaaaatgctttgctaaacagatgatccttaaattggtcactgtataccgtgatgcagcctaatcaaaatggtattcctttgagtgagtgagccacagagactctcgccaaccccttgtgcagctttctattaacagtataaatactccattgttgtaaagcagtttatggttaacaaagcgctgtcacagacacgttatcttagttttgcagattgcctttgtacatgttattctcatttcctagcatgccctctatccctgctttgcctgcttagcaagctcattcttatccttcaggacataacaccaactctgcaaagtcctcttgagacccttctgagcaggtagatggtcccttccccgtacttacacaagccctgatctcatctctgttgtcatttgttcacatcactgtttctccctggagactgagtctctcaagggtaaggacactgtgtgctcttcatttttcttcccagtgcctttgtaaccagtcttcctgggggatactttgtaagtaaaggtgaatactgtatggtgtgcagcttaggagagcttaagccacttcctaagttaagatactaagtagtagataagagtaaaacttaagtgtcttaactcctgtttttatcggtttttctggtttatcagtttattgctcatctgaaaacaagctgtccacatcatactcatgctgttctacctgtcagagatatattacatggtaaatgtgagtgataaaggaggataagttctttgtcagaatgaggacatttcggttctgtcatcatgcctgaaatgcatgatttcacatgatttccatgtgaaataaaacattggtataaaagggatatggacaaatttgtggatgttagaaccacacctttttctctgaatttattttcttctcactcctacttggcatattccctgtcattgtttgagagtgtgcaccaatgtcctcgtctcagggacaccatttctttcccgctattagagtgtctggatgatgccgtacccttagtgcactgtcctgttgaaaatttggtacattagttattttaaggtttaaaaacattgctgcctacataatattccacctctttggagcatttgcattggagtgaccagtggcttgaagctctgtatggtggagtgactgatggtagttgaagactgcaaaagtaggtatctgagggctggaaggcattcctggcacccctaaaactaccccactgggggccatccaagcctgtgattaacaaaccctagttatttgctaggtagtttccacatggcatagtaggatatatatatgtgaggcacaatacagtgtttatgtgagaataatatagattatttgaatctaggctgcagaacctacctgaaaatgggttttacagttttgtgtaattgccttttctttgtgtttgcatagaaggcattgcatagctggaagatgatggcaattataatttattatgctgtaattgttacctaaatgtttttgaataagcaaaaatcacatctgtttaggaataagttgcacagcaagagaattccctttgaaatgaataccgtgttctcatattctgtaactgtacacataaaacaacatatttatttccccactgagtccattacattcccaagtcaaactgcatcctctcttcctttcccatattaaaccctttgatttaatggaggttttaactactggttctttagggaattttcagtaggctttgcacagattaggttattggaaagtatagttatttgcttgtaaagtggcagttctgtgtcaaaattgcttttctctggagctgcaacagtaaaaacgataagcttctgctttgcatccaaaatgccctgatgttcctagcatgatcgtttttcctttgcttcttgctcagcaccattcggtcacaggctggtttggacaggcgaatatgagcacatgtagcccagaggactttgatatccagtggtgataatagacaaggcctgtcttccattctggttgccactggtctgtgacaaccagtgttccgggcatggtgagcatagtgctgcttcccttctccgttaaataggaaatgcataagcctggagtcgttttgtttgttccacagaaacgtagcagttgaaataattgccttgccatgcccaggctaacaggatttatcttccattatagatcatgaagacataggcaagaatagtttactcctctaaatttactaggctactcacttcgaaatgatttcactgtgtaaaagagaacagtcctagctgtggcttagcctagaaaggctttgatacctagaaagatgaagggcagaagtgtattctctatttttctgctcccagctcataaaatagaattggagtttatgtaaatagcagatagcctgattttattttttatgccccagttgcaagttagtgtctccttaagatgggtcttaatcactgacgttgtgtgcttccattcagcacctatctgtctattaagtggcattctagtggcctccaagagttgagtactttattctgatcagagtcagcctgggtgaccaagatgggctgtatcaatctgttacacctcagacccactggaggccacaatctttgagtgtcttttggaagatactgtcctatgttgttctagaatgctgactcctactgcttaaacctccgttctctctctgtttttatcttaggccagatgtcctttataaattttgattttttgttttttgggttttgtttttggagtttggatctcttagttttcatcctgaatactgttccacactgcatatttaatcagttaaatcttggtctcctggctttgaccatcaaatgttactctattgcctcaactctattgagttactccaactcaactgctcccacctcagggtctttcactacccattcataggcagtagccccttgtttctcttcttcgtgaaacctgagttttccttattgtacttatctcaggcattaatggatctgtgaagaagtatgacgttaagcttaaaggatcaaaaactgggcttccctatgtatgtttcaagtttcatttgtgtgaccaagagagttcatagtatagatttgaagagttcaatcaagaagctaagatattaactcatcttagtaatagccttttgtctacttcatccatctgcccatctgtctgtcaatctgtatacattattgataacttccaatgttgtaaacactgggaataccaaaaaaaaaagaatgagccatgcacctttccttcgtaatgactacattaaagccccaagacatgaagctacttgctgagccttgcagctgacctgtggcatagtggagactagaacccatttctagagggatcttcctcatacttcccaaggtcagttctctttaggcctttggtattcctgtcttagttgttgtaagagtagatttcgactcatcaaacatttgtgatttggaagtatcgcatagttgaagaattgaagaaagctgatgggaacaaagtcattttcaagtttacttgagcacatagatatcatgttgactactttgctgaatattcagaatcatttatatttagtatagtaaaagtgaaaagtatctgtttttaaaatttggaaaacacacgaaatacaatgaagaaaactaaagtaacaaccattttactactctttttatgtatttcctttgagtagatatcaaatatatcagcattttcagcatatacgtacagttttgtgtcctgcctttttcccttcaactatataatcagcatcttcccacatcgtgagatgtgaattttttgaaaacatgataattaatgcaatatgttatttcaaagtaaaaactttttatttaactattattgtgtgtgtaactttattttctgtgtttaggttgtttctgatttttcacccttatcaaccatgctgaggcatgaacttcctattaataaatcattgtgtacatctgtcagtatttccttaggataaatttcttttagttctattactgcatctgaggaaattaacatatcaaagctattgatatgtatttccctgggtatacatttttttttttttttttttgagacagtgtcttgctctgtcacccaggctggagttcagtggtgttatcacagctcgctgcagcctggactgcttgggctcaagtgattctcccaccttagcctcctgagtagctgggaccacaggtgtgcaccataatgcctgactttttttttttttttttttcaatttatagagacaaggtctcactatgttgcccaggctggtttcgaacttttggactcaagccatcctcccaccttgacctcccaaacttctgggattacagatgtaagctgctatgctaggcctcccagggtatacttttaaccctgccttacaccacccagaattcaaagcatggaatccttgacccagtagccagagtatttcttatcttaagtttaggaaagactactctgtggtcaaatgtagtcacagaatttctttccaacaaagctgtctacgtagttaactgagaaccgtctccaaagggttgttcctcttgagggaggtttcagagaagagatggcattgatgtaagtcttgaagaagttagagctcaaaatattgtgaagaggaagataatttttttttttttttttttatcgagacagagtctcgctctgtcacccagactggagtgcagtgacgcatctcggcccactgcaagctctgcctcccgggttcacgccattctcctgccccagcctcccaagtagctgggactacaggcgcctgccaccacacccgggtaatttttttttttatatttgtagtagagatggggtttcaccgtgttagccaggatagtctcgatctcctgacctcgtgatcctcccgcctcagcctcccaaagtgttgggattacaggcgtgagccaccacacctgaacgatgaatttttctaccaggacaaacaggatgttcagaaggaagacattgttagaactgtacataatcttagacatcatctatcccagtggtttatcaaatattttcacagacaaaacattttttcaagccaaatcttgtctagagtactacaaactgattgaagtgaaatgtctccagttaaatcacagtggatgggagagctcggaattgagggtagaacctcctttgctcagctttcttagagcttcctatgcacctgaaaaacccaaagcctctttttttggttttttttgggttttttttgttttgttttttgagacggaatctcacttttttgctgaggctggagtgcagtggcactgtgtcagctcactgcaacctctgtctcctggattcaagcaattcttctgcctcagcctcccgagtagctgggattacaggcggccaccaccacgcccagctagtttttatatttttagtagagatggggtttcaccatgttggccagactggtctcgaactcctgaccttaggtgatccacccacctcagccccgcaaagtgctgggattccaggtgtaagccactgcacctggcccaaagtctctttaaaaaacaaattttaagtcactccagtttgaagtttaggacacagagacaaactgtgactttcctcaaggtcagtcagaagtgattctgaaaccacctttcagtactttaaccctgtccaaaagcagccattttagtgcttttatcactagatgttcccatgcaggttgagagagattatttctgttctgttaggttatgcattgttgcagtgtcccaagagataaagtcccaagatattaatgtaagtattagcttctgtaagatgttaccccaatccatattaaccatgtctggctgaggcatgaaggatctattaaattatatccaggttcctattaaatcactacactggcagtaatacctgggctcaccttctccttaacccaaattaacacatgctgttagtggtctcaagtctaaggcaagttcctgagatgaacaagtgactgggaaaacaggagaggagaaaattaaaataaatgataggctgaccttctcacaccacttgtggtttctcaattaaccaaaagccagacagctccacgttgctgttctctcagtaataggtttcaccctcccatttaatgccagcccacacgggtgcacacacagacacacactttgctaatcagattggcagcaaatagaattaaaccattaaggcaattaagcaattcttagataacatttgatcagttcaatgaaaatgcaaattcattcttcttttggagaaataagttgatggaaagtcatttcgtgttctataatcataattaactcttttccaaataaagattgcaatgttttgggcttggagctacacagatggaaatgatttttttcattttttgcttcactctgttcatccttttgtaatgcaccatgtttttctgcctccagactctttgggacatttaggtcatcttacctacaatctcttccttgtgcctcaaggcaaactctgttatttactctcacacatgatgactcatgcattaaacacctccttagaccctgagttcggaatagatcctacagcattctggaatgattttggtcggatattcatgtgttgtagatgcactacttggctgcttctcatttctctctattccccacacttacggtttctcctctctcacaagctggtggggaagagaatgttgcacccaaaaataggtgcttgaaaatgagcgtgtggtgtctgcattttcatttctagattggtatcattgaagcctacgttccattctgccaccacagcctgaactttcagcaagaaaatgatgagcaccttgcagcccgtgcttccctcacctgccaaggtgcctttgtgctctagctcagggtttccaaacctggtacatcatcagctggggacatttggaaatatttatagtccacagggttttaatccagacctatagaatcggtatgtcccaggtttggcttagggattttcttttgcttttgtttttttcctttaaaaaaaaaaaaatctttctgtttgataatagggatcagccagtcttaagtctagatgccattttttttctacattggagaccataacatgtagtctgatgcatgatctgtcaatgacacagaaatcacttggatccaaagaattttatgatagccttgcttataaagaaaaataacaccttatgtggcaggtcattttatagatacacacatatgaatagtccactgcatcatgcgtgtgtatatgtgtatatcaagtgtctttagaggtaggtaaaacataagaggcagctgttatcacctagggcaggggtgtccaatcttttggcttccttgggctacattggaagaagaattgtcttaggccacgcataaaatacagtaacactaacgatagctgatgagctagaaaaataataataataatggcagaaacatctcaaaatgttttaacaaagtttacaaatttgttgggccacattcagagctgtcctgagccacgtgcgggctgcgggttccacaagcttggcctagctagatattatatttaatgtatctccttttcagtcttaataaagtattgcagccaactcccatccagcaggacacatggacttagtgtgcctacctgcaggtttttgagcatgaatgtaaatattaatagaaaaattgtgaatgcttctcaggaatgtcaccagtgatttttttcccccaaagaaacctttagttttgctaatccctttactagtacatgtttgtagaacacatctttttgagaattttttggggatactgatcagctactattaaagccatcaagccagcggtgccaccagtgtcacaaggaagaacgatgttttgggaagggattgagctcagcattccaggaaatattttttacctattcattactgcatgcataggcttacattttctcaatttaaaaatacttctaaagggtgggcttttgggatgtagacacataatgttctcagcaatactgtaaagcctcattaatttgctaaacaaataagtgagatggtaaaggatattgcatagattgtaagggcacatttaatcatctgaggtttaactggctctaaaggcaacaccttttcaagctcttaagagtctatatttacatggatagtaggtcttcttccttcattaaacttgccctctaagaccttttagctgttagttagaattacattttgaacttcaggataattctatatttctttcttaaaataaattctttatatgagcatttagaccataattcaaactgaggtttcctataagttctgtgttatattttatttgcgtgcatagtgatattcataccacatctgttaaagtatgaagggaggaaaatgtcagcaagtgtattgtgtctctgctcacaataattttccaatgaaagttcacttaaatgagggattcatatatattaaggactgttgttggtgattagtacataaaaatgtgggtttttctcataagtggttttaaaacttcagactgagtacctcttttgtttaatttttgcacttcttggaggcataaggtattttagtatgtgtggatcttttttattgagtttgcatagtttaggagttttttggcttaaaataaaatagggaaaaaaagctctcttaaaatagtatcctttcttgaacccataaagtagggctttgaagacgtgcaacatttgtgaggttctaaagaggggattttgtggtgttctttccagtgcttccttccttccgtcctcaccaccctgctgtaatctgataacaaataactttccagtcagtcaatttaaattatatgtaggctgcaattttttaaaatttcataatggatgctatttaaacacaaacatacatttaaaaaaaatgccatactaaagtccaaaaggaatggtgacagacattttatttatttagagacaagttctcgccctgtcacccaggatacagtggtgtgatcttggctcactgcaacttctgcctcccaggctcaagcaatcctcccacctcagcctcccaagtagctgggaccacaagtgtgcaccacgatgcctgtgttttgttttttgtggtttttttttttggtattttttgtagaggcgcattctcgccatattgcccaggcttatctggaactcctgagctcaagctgtctgcccaccgcacccagctgacattttaaatatttatttatagagcttcattatttgtacagtgcccttaaagccaaaggcattgattaggcttatagaaattgcaattaggccatgcacagtggctcatgcttgtaatcccagcactttgggaggccaacgtgggaggatcgcttgagctgaggagttcgagactagcctgggcaacatagcaagaccttgtctctagtaaaaattcagtttaaaaaagtgggcatggtggtgcaggctggtattcccaggaggctagggtgagaggattgcttaagctggggagattgaggctgcagtgagctatgattgtgccactgcacttctgcctaggtgacagcaagaccttgtctcaaaaaaaaaacaatgtagtgagtcatagttatactaaatgggcttgaatactataactagttttagtgttatagtcattaaaaaacaccataattccaaatggatataccaattactgcttgcttatcttatgcatccttttcctctcctctctatcccccaaaaccactcttgaaatcttcctgtccttttgctcttatcctacctggccatctatccaccatttatctagtataatttccataataaaaccaccagcttgcattagtgtgttggttacttcaaaggtggctaaattagagactttggttaaggacaccaaattcttaccaatttgatggtcttgaggggcaggctgtctggctcatctcttttctatctgctgcccaccttttactgcctgccccactaagcacttctcatcatgtccgaggagagagtaagtgggtgcgtgcatgcgtgctgcaagtatctgcatggcattctttttcctgaaagatcttctttttttttttttttttggccatcatttccattctgtcctaatatatcctttctctttaaaaaccagcatctagccaaggcattgatgaaaagttttctttgagctcccttgtggctgtgcagaagagtttattcctgaggttgctctcatttagggttggaatctttgaagataaaatacttcttcctacctctcacttgagatcaaggaaacctacataagactcccagagcaaaaggaccctgtaacacttgtgccttggcattgccatatgctctgttgcgcaggaatggggaggaacggccatccacatgccacccccacttccactcggaaataatagggggtgacaaatggctgctgcattctattctgttttaccaggctgtttctttcctgccctcaagaggtttctgactttctgacagcagggagctgaggttgatctagcaactgggaggattgcacctggatttgcagaaatacacatgcacatgtgtgcacgcacacacacacgcgcgcgcgcgcacatacacacacacacacacacacacacacacacacacagtgctgctgcaactcccagagtatcacataatcactcttctggctttagtggttttcctttggccacactctgctcttgtttggcttgctagcacagtaatcagaggaaagacagagactctttgcactctaatccccttgtgggttacagtagtttcagatagaagacactccagagggtgctatacaatttggaggtttataaaggccatcttctggcccccatttccctttaagaaatgagcccctcaatctgcattatacatgttcccttactgctagaagggttttactggtgccctgacactcttctcttcctcacccctcccagagcaagaactacaaaaacatagtttttttctcattttcttttagatgtatctgctgccatttattttctctctggtgattgtgtgatataggaaggggaagcatcaatggcttctttatatcctaaccacattccttgactgggccctgtttcacatctctgactcctctagagattactcagccaacatgctgcccctcctcagcgcatcaccttcttgggtctcagggcttggcattttcattcagccttgcagttccatgctcatcaccaacactgcagacatctgctgccactttcctgcctaaagcaagggaattcctgtgattcacaccgtgagcagaagcaggggtcctcttctactcagcattatcccagtttgtctcactcctttagccaatatcatgaaactctgaaactttatagcaggatgaaaacttaagcctgtagtctaaagacccagaattatgagtgaggaaactgaggccaggagagccatgaatgatagtgtttacttgattgctgtttcagatttcaccagcttttattgatacttcagcattttacttagtcgatatatctcttcgtgtgactcaaagtatcccagtggagcacagttaactgccctggatccgaattgccactggaggccgtggcagtgtcggcatcaatagggatcacccatgaccttttatttgggatgtagtagggggtctgaagttgggaaagtctgaggtggtactcagttctgggttgaatgtcttgtgaaaatcctgtgaatacatcttgcggagaaacacagaggggaaaacttcctgttgtgagagcagggctggttcccttttaaaaaggtataggatgaatattccatatttgaaatacttgagaccagaagtgttttggatttttaacttttttttttttttttttttttggaaatgctctggtgaacatttccttagagtgtcatgtgacactcaaatagtttcagattttggagcatttcggatttgggatgctcaacctataatacccaaaggctctatttcagtagaatttattggtttgctgattatagcagtgacatagttgcattctagagaccttagaaaatgcagaaaatttcaagaaaaacatttaaattgtgctcatagtgaaactgagaggtgaccactcttaatattttgtggcataagcattccagtcttttatctttctcaaagtttcacataaactttctcaaaggccattaaatacttttccatagcctgattttttgtgaccacatagtatcctattatattgataataccataatttacctaacccatttttatatatttggattttttccaattcatcattattatgaataatggtgtatctcagtggttattactttgcactgcatttcttatgaaagtattgagtaaaaggaagtaaagccctctcagagtgttttgtaggctgtcacatttcactccataatgtcctagtgtttgttgccaccagtgatatatgaaggtacccactgaaatgtcacacctttttggttttcctttttaaaataaaaaataaaaaagacatttaaccatataatattgttcttatatatgatttattataatgtagattcacatctttgagttcataaaaatattgaatttggattctctccaatttcccttttagtagaaaggctaaagttcggtaagaaattctacttggaattttattgaattgagaaacatacttggatttctgtaactcatgacaagtaacaaataaacaattagccaattaattaaaatatctgttaaaaccttgagtaatgcagagatttagttaggcagtgtagtttaaaaaaatcaaacaaaccagacctatgctgatctccttggagatgaccatcaacaggaaagatagactttaaacagtgtatgttgacatagagcaagtttctaattttccatcatttcaaggtgctggaaattatatggacataaatgcctttataatatgtgtacatctggtgagtataaattctcagatttgaggacatttccaataaaagactcacatacaaagtataaaaccagtaagcaatggaatgctaatcaagtaatgaaggattcaggaaagaaaataaaattatgccaaaccatgtaggccaagaaatgcaagtgggaaaaaaaaaaacttaagctgatgtcaaagtcaaaataaaatgtagagacaaatctctaaatttaatgttttatttgggaatcatagaatcacatttggggcatgcaaacagactgggtggtcttcagcatgtccaaagaacaaaggaaagattgggggttttattagaaagggaaatgttacttacagttttgaaagaaagctcattgaccctagagaagcttgtgggagctgcccgggtctgattggtgagtgatggtagtagataaaactagtcttaaagtcatagcaggttgtttcagcagctgctaagtaaaactggtcttatggttacagcaggctgtttcaacagctgggcttggagaaaactcaattcttggagcatgtgctgtgtcttgagtactttttcccgctgctctgtcaactcttctttagttgggcatgacaagaatgatgcaatttgcataatcaactttcacactgagtttcctgtagcctatacaaaacataaatattagtgtttttttacctttttacagtttttattgtattgtctattgaagtgaaacattaaagttatcagaatagagaaacatttgcctatcactacacattgagaagatactgtaaagagacttgaacaaacactgggcagtatgatgcgtagaactttcagtctagtttttacaagaaaaagaaaagaactgtgctaaccattttgttcatcaatataaactcaagtaatgaggttaaattgtagttctttgcagagtgcctggccaccaggtccgtaatcgctggaggtttgattagatattgagaaagaaatctgcaaaccttggcaaaatttgctgcataattccaagactgctggttcttaaatttatctccatcaaaacacagatgtcctgtgagctggactaagccatctcactatctataatcaaattattgctttcttttttttcccactgaaagatcgaaaaagaaaaaatgggtaaaaattcttagataactgtttttgtaatgtgtatttttgttgaaccttgcctcattgtataatcaagtaacaaatatgaatagaaaatactattgactatggatggtacttagctcaacagcttattttgaagaggaaaccatcatgtttttaaatatgaaacataatcatgtactttacgaataaaattcttcctatttcttacaacaaaattgaacatttcaggatttaatggtgttccatagccactagcacgcagtagctcataatttcaaggtgtttgaccacatcggtcagtttgaaaatcatacctgaccatcactattgaacacctgaagtgcaagcatccatgatggagactggagctgtccattggctactgcctttcagactaggggtggcaaacctgaccctttgttataaaaatgaaagccctcaaacgtgttcttgtcctcacgaagatttttgtctctactgaaatgcctgtaggccatttttggaaattatagctagtgtgctcactaaagtttttcttatgtgccagacacatgctctagctttacatacaatagctgtaaacctcacacaaccttgtaaggtagagagcattattatctgtattttattggtagggaaactgagaggctaagtgccttggccaagatcaccaagttatgaaatcacacgaaaggagagcctagatccctctaccagcactccttcctctatatgcactgccttgcagtaatcaagacttcactaaaagcaatttcagatctctgcaaatgtttgaacaagagctctgttgaaatgccataaaatataggatataaccttagctttgaaacattttgaggggagttaccaacttaaaaaaaaaaatgtttacctttgagcataaccacatccgaaagagtcacagagctagtcacagaatgtacccctcgataagtaaacaacataacctgttgaataagtaagtagtttagtcttctctgcctgcatgttgctaaaaataacttttgctttggtatagaagttttgaaagttgtgtagttcaatgaatatttgttgacagtgattgaaacttacattgtttctctcatgctaatcttgccaagctttggtggtcttcaagtatttgaaacaagaaagggccaggccagagccctcgttttcagatatgggacaacaaccaggctttctccatttgaaggaagaggaaagagataagggaattgttgcagtgaatcctgtgggccccaggagttataacaattgttttctaggacatacccatttcactcttcttaattttctgccatcagcatttctggggatgtactaggaaaatggaaggaacatacccagcttccagggtttcagtagtaaagtatagactagtttaagagcaaattgattagatcacttctactcctatgatgtccatttctcatataaagataagctgagaaaggtttattttaaaattaaagctagttgtttaaaagtgcggctgaagttaactcatggattgccctaaagtattgagctgtgattataaaaaaatgtttaccaaatattgtcactatggctcttatgtagtgaagagaagaatttagccttaaattagttaaaatgtgcaaaccgtttagaacagtgcttaacatatagtaagtgctccataggtattacctatgctttagaacagtagttctcaactggtgtaccacacggcacaagtatatctttatcctttctcagacatgtgccgaaacatctatacacatattaatttttttttgtatagccaaatatgtaggtgaagtgcacactgatgtttcacttggctgaataaaataagaggtgagagacacagtgtaatgtcaagtctttgcttaccagagtgaaatggggcatcgcctttcgggtctataggggtgcactgagcagtcccgttaaaaaggcacatgttcaaaaagactaaccaggtgagcagcatgttaattaccactgcttttaagaacactggaaaggcaagtggttgtatggtagtagcaattacattgtaattactgtgacttagttagaagtttttgaaccccttttgtatttcaaattgccctgtacatacaaagtgggtcagaaccatcagttaagaattagtggggtcagttcctgtctgtagctattaaagtgatttatttattgtcttataacattatactatattaatttacacatagccttggaaaaactctttctcagacttctaggccagagtctaaatacatttatgaaacttctcaggaccaggttttgatagtgcggagatcagggagagcctaaaatcataagacttctctaatagagttaggtcattaaagaatatgaatatatgaagagtagggcattagagacaacattctatacctaacattttggtccaaatcctataaaggtttctcacatagaaagctgcctttttgcatgtactacagcttgtgtctctaatatcctttctgtaccaatacacaccacatatctgattattgttcaaatactcctcttaacttaccaatgaaagcttcagatcacttaaagagattgcagatactatagtgaacatagtagaaaatcattattctattgtatagtaaaacccatgagttacatctaaaatgttactactgtttttatgtagtctttaaaaaaagagattatgaaggtttacaattatagtaaaacttattaagtagatgcatcaataggaaaagaaaccattatcctttcaacccagtcctatttcataaatagcacatcagcgcttcagtgattaagaaacatggctcatctttgcagcatgttgcttttattactttttgcccacggacctaagaggggagaggtaaagtgatagaggaaaaagctccaaggcaaatcaagttcacatatttttatttaaggattctaggaactcgaagactgaatcaaacttgttacttagtttttcactggaataatggctctatttctatagtagagtgagtagaaggttaatggtatctgccattgatggtttactaactggttaaataactgattgaaatgtggtaaagggagatgaaaacaaactaaatctttttttttttttttggcccagattttcacgtttagatgccatgaagcttttgattgtgggtctaaagacaaactgtgacagtgattggaggcttcttttaggggtcgggagatatatggaaggacaaggaggacagaggaattcaatctcctatgcagtctctgcacctgttcactaagaaataagtcagctgaggccggacgcggtggctcacgcctgtaatcccagcactttgggaggccaaggtgggcggatcatgaggtcaggaaatcgcgaccatcctggctaacatggtgaaaccccgtctctactaaaaaaatacaaaaaaattagctgggcgtggtggtgggcgcctgtagtcccagctacttgggaggctgaggcaggagaatggcgtgaacccaggaggcggagcttgcagtgagcagaggtcgagccactgcactccagcctgggcgactgagcgagactctgtcttaaaaaaaaaaaaaagaaagaagtcagctcagtccaggcagtagactttggggtgggccttgatggaccataagacctttgctgccctgtgacttctcccttagttctcagtctgttcagaaaacaatttgcaacaacatcagagagaaatagaatgcaaaacacagctcccttttgatgaattggctcctggctcggcctgcaaaagataacatggtttttcccttagaatacttgtcatgccaaaatgatggtatcgtcctactggggtttttaaatgttaatacaagtaaaataagatggatttttttaaaaaatggcaagcgtttcttagtttggctctcttggcttttgtttaaaactgaagatcactaagcctagatttttgtgtctccagtttaaaaaaaagtaaatttcaaaagcagttcctagaactctccctctccataggcctgttgtgagatgcctatgtccctataagtgtgcttcaatctaccagctttcctaaaacaggttgatggcttagtggataaagatgggacttacaaagcctattgattctcttattgtactcatctgtagaatgggaatagcaatggtacatgctgatcttacatgatgtgaggatgtgatgaaataatacatggaaggtattgagactactgtctgggtcatagcaagcagttttgccattattatatttgtcatgacagttttgccattattattaacccaataataatgtcgtgtcccctttctccattcttgtctcccaaagatgtcacacattcattattgccaaaaaacatttttaaagctttctgtttttctggtacttgcagtgtggctgacgccagtagggtataactcctctgagaatgggtgctgaattctgttcccaaggcctatggggaaatctctttttgttgttgttttttgttttgttttgttttgttttgttttttgttacagtctcgttctgtcacccggggtggagtgcagtgatgcaatcttggctcactgcaacctctgcctcccgcattcaagcgattcttgtgcctcagcctccctaatagctgggattacaggtgcccgccaccacacttagcgaatttttttttttgagacggagtctcgctctgttgcccaggctggagtgcagtggcgccatctctgctcactgcaagctccgcctcccgggttcacactgttctcgtgcctcagcttcccaagtagctgggactacagcacccaccaccacgcctggctaatttttgtatttttagtagagacggggtttcaccgtgttagccaggatggtcttgatctcttgacctcgtgatccgcccgccttggcctcccaaagtgctgagattataggcatgagccaccgcgcccggccacacttggccgatttttgtatttttaatagagatgaagtttcaccacattggctaggctggtcttgaactcctgacttcaggtgatccacctgcctcagcctcccacagtgctgggattacaagcgtgagccaccacaccccgctgggaaatatcttaaaagaatcaaaataagaaagttactctacttaaatcgtgtgctttttctgtgtgtgatttatggtaatcttaccatggggtatctgattactttagaaagatccatttagcttatttttttcttctttgggttatttttttcttccttccatttgcacagcctccccccaaataaaaaataaagatataaagtctatcttctccctcttgtcagtttaagtaaaaagaacttttgcttccattttaataatagaatttgtgtgtatataatataggcagtgatttggcctcaagctgagtttagatttgaaaagatgagaatattaaagcttgtcagccagcccacaaaccacttaagtatttctgatctgacaggatgtggggtggagttctttttcttttctccaccaacacccctcacaattaaaataaatcagataaaatagacactgtgaaggtgggactgaaagtaggtgataggaaagggtggccccacaccaggaccagtacatatgcagaaattccgtccaaagtacttcaagggtctaggacagtgctgtccagtacaactttctgtcacattgaaaatgttctgcatggcccaacagagtagccacaagtcacacggggctgaaggcagatagtgtaactaggatttgaatttttaattttatgtcattttaatttaaatagccacaggtagctaatgtcttgaacagtgtaggactagaaaaaatagattttgacacacattctcatgtatgaaaaactgccaaagagcatcagattgctctagttgtggaagattgatttgggagtaaaagaacgtctaaactgctatcctgtggaagagaaatagatttctattttgttgttccatagggaagaaacaggactacttgggagaaactgcagagcaacacatttaggctcaggctaaaaaaacttcctcagaattagtcatacaaaattctactcagatctcttcgagtttaaggacgacccccaattctgagagtactcagggttagacttgatggcagtttgacgaggacctgcagttccccatttataacacttgtcccacacagagtcactagttgtgctaagtattagctgaaacattgttttcataagtgctctgaagctaccaagaccattggtatcattttattagacatgactattatttagctaaagacaatgtactttgagtcactgtaaggccatttgttctaaaagaaacaaaaagattctccttgggatcccaagcggaaccctgttgttctaacagtaaacatgctccccatgactacgataggtggcactggtcattcagttgttaatcttaaacttttcagtgattatttcacctggaggggatgctgacattggcacaatagcctttccaaatacccagaaaatttctgataataagcaaatggatgaactcacagtagttcagctgtggtagatgctctcgttgctggttagtacttgtagcatccatcagccacggacccgccggttcctactgttggatgtaacagattcatggaaaagaagccttgtaggtaatgtcacagcagtggtcttaaattgcaaagaatttctaccagcctcacgaaccagggcatggcatggaattcattggccctgcttatccccccgtggagacgtgggaatggcaggactgtgaatgtggagctcagttacccagcagaggggtaacgctctcataaagaactcccacagaattaattagccgcattttagcactggagactgcacctcttacatagtaggagcgatggttcagaaagataatgaaggcccttaggttattattgatagaccctgccttctttttaagcaggaggacatttcctcgttctttctcttgttaaaatgataagtgcagagcactctcattaggatgtagccccttggctcccaaggacacagtgagatttcctttccttccgtgcatgttgtctctctctctttccctgccatctcattctgacatttcaagtaaacaggcatacatttacctgttggtaggtgattacatactaataaaaactacaagtaaggaacactaggcagcccccattttacaaattggcatttagtccctctataatctcttctctggagaggagtaatatccacctggatgtaaggctgggtggaattataatgcagccctgttacacagatggctgtcttcgtctgtgacatgtgtgcacacgtagacattcttgcatgtgcttttctgtcagcccagattgatgtgtgcataggttaaattgctagagaaatcagctttctacaccagttgcatctgatacaaatttctacctctggctgggccctggtgccaagtgtttgctcattttgacagtcctcaaatttgttgctttagatttttttcctctcatcttaaaccctctagtccagactttcgtatcacactttattatgtgtagatagctctaccaagaatatcaagggtatctagtaaaatcaccctcaacttccatctccgccatttaacatgaaaacattgttattcatgtttatgtcactccctctggagaaaaacatgttcttcattcccaaggtcaaagccatgttcttcaaccaacgcttacagtctcctccatggttttgtcacatcagtcattcctttccctttgccttgtacctgctgtctttttcaccacttccctctcagctcatgaactctagcgagtttcctccaatctttaaaaatctaaaggagaaaccacctccatcttgtgtgtctccatccctcaaggtcaaagaacttttatgcttgctgtcacccttcataacccgtggatgaatagttactgtatcctattgtgctaataaaatagtttcttaatacccaccaatgactttctaataaaatagcttcttaatgcccaccagtgaccgcattctgcctagttgacaagctgttccactttggatctctctcatcccatggactgcctgactttgccactccttgttcccatccttttctgtatctttgtcaggctctcttctctttctccttaaatattcgtcagtatcccaaagtttatagagaatgttacttaacagcatggatatgaggaacaggtaggcctgaattcaaatccttgctccactacttatatggctatggaaacttgagtaaattagtttttctgagtatgttttctcatactgacttcagatggttgtgaggatgaaattagcaaatacatgccatgtgcttagcagagtgccttaggtcactgcccctggcctgtctttcccctcttcccactgttcatgctcttacctgccattgttattctttctgttcctggcctccttcgggaacccaaaagccacattgtcaaccacctgccagacacctttctcaaatagaaataactatccctttttcccaaagtaaatttctccttccccaacttggcttgatagtctctctcaagtaggaagcacagatgtccatttgacctcctccctctctcttaccctcatatccggtcgacaatccatgtctatcctagcccctggattcttgagtctagacctttctttgattcttaataccaccatcttggctaaggcttctcctacctccagcttagattattgttctggcatcccaagtcgttccccatctctattctattgtaagcattctccctgaaattgtacatatattatttagttgccttctcaagttgttctcctttgtactttccaatcccttattaacttttggctgaaggtttcatagccaatctgtagctcaggggtagaaaggcaaaaatggttgatgccctgcatagagttagaactcattaaatgctgaattaatgcagtataaaataaagcaaaataggaagtgtagtaagtcataatgtaataagaagtggggataagtggttgattaaccaaaagttagctttccattgataaatactacagaattagttgtagaaaaaagagatttataacttgatcttcatttctcacctgagcctatgacaagagggtaatggattggacaaacaagtggaaaatctcagctggcatcaatgggctgtcttctgctcccacccagtgggtgtgaagtcactctctggctctctgtatacctctccttccagccattgctgatggagccaggtctctattttttttttttttttttttttttgagacagagtcactctgttgcccaggctggagtgcaatggcatgatctcagctcactgcaacacccaccttccagattcaagcgactctcctgcctcagccacccgagcagctgggattacccgccaccacatctggttaaattttttgtatttttagtagagctgagttttgctgtgttggccaggctggtctcgaactcctggcctcaagtgatccacccaccttggcctcccaaagtgcttggattacaggtgtgagccaccacacccagcctggatctccattcttgatataggtgttttgatcctaaggagacaatcgttggtgaatttgaaacagattcttcaggaaatatagtgcaagaccaaaattgggtcccaggaaaaatcatgtgatacttcgtaatgcaggtctcttgtagacacaagaaggcacacttgctcgtttccctgggtttggtttttgttttgttttcttccccctatgtctcacatcctctcctgcaaccccaaccctccgtaccgcaggcaagaaaacattgatgtttctgcatctggcagcatgtctctgggagaagaggccggcggaagggagtttgatgtgtgagtgacagatccccaggtaacaccactggggaacacttgatctgacctgtttgaaggtgaaaactcaccaggtcacactggaaacagttgctgctgggcatggctttgatccttgtttatctttttctcttttttttaaccttcttgaaaaaaatgttttgtacaaatggatactttttcctgtgtatattttgtctgctggagcatttgtatattttgtgtgtgtgttccttgtcactgcagggcggggttttgtaaccttttgatgcagattgtgaatcttaatgaatttgtcatttgccatggaaagatgtttgttcaaatagagcagagacattttcgtccaacaatattacaggaatattgtgtagaaaataatgactaatactttgagcattccatgttggctcccattttaaacacttcatgtattaacttgtttaatcttcagaagaattcatttttcctggttttcctgttgacatttgatgaaactaaagcagagggaagttaagtagtttgcctgaggtcacacatttagtaagtgagagacccaggactcaaactcaggcaggggttctagtaccagcagtgtttatcaactgctttccaaccctgacaagcatgagtgggcacaagcatggagcactagggcttacaaaaagctccctcaggctggcacattgcctgacttaaaggtaccgaaggcatggccctgccttcaaggtcattattgcatgctggttagaggagaaatctgtctgtctcatttgcggacgtgtctccgttgctaagtagtgtcaggcatgtaggagatgcttagtacaatctttttggattgtatcaatgtaggttttgaaaggttattagagcttgtgaatcatcaaggttgaaccataatcaattaacaagaaaggggaatctgagacttctaaaatgtaatggtcatgacttgctacctttagaaacaccagcgaaaaaaacctgtggtgtcggttggatcatggctcttattcactgcggcgtttttaaagctttttcaaggattatgtggggatcccaggctcctttatgatttataaatctattatgcatgtcacgtagagattttcatgacagaatcgtcagatgaactcattcagggtataatattgtaggagaagggttggcgaggttgagggggatgccataagaaaatgcctaattcataggtagagtgtaggacagaaatggatggggactggaggccagttaggacgacactgtagaggccagtgtgaggagcaaggacgtgggctagaggaggaggagatgagcatggggaggaaagtccagggagagttaacaggacctaccgactagacaagaggatccagggaaagagaatgaagcattgttaggaaagtttcacagtatagcggcccaccgataaccttaagaacctacaaacctaacagttttaaaacgatgagcttgaggctcagaaggaaaggcatgttaagctgtcatatcaggttgattgaatagattgggtaagtctttcagacatcctaccaccaccttctgccccatgctgttaattctttaagcattgggaccatgagttctgtctagcagtgtgggtgttgagaccacatgaatcaaggaagagggcttctagaggcccaagggctgtttgctgtagaggaggcagaggagggttccaagaatttcagaaggcactgtatagctctgccaggaagtgtttagagaactgaggtgcagcccccacttctcattacaacattttactaccatcaacctctcagcagaactgctgcattaggtacctagtgtttgatttgaactttgtatttattctccatgaaaaggcaccgtgcccattgatgtcactttggtgctgctgagacagaaagtgagtattttatgtgctgtctcttttcaagcaagatggaagggtcttgtaaaagtggtttctaaggaataacctaacattttaaagatttatagaacaagcatccacttaccagttcatttaagttttacaaaacatctctgcttctgccttgccatgtcagcaaaagattctgacatttaaataaataaaatatggtgggatataataaagtgcaaaaaaaatgatgcatcaagttactactgaaaggaatattgaggcctgagtcatctccctgctgctgtctcccaaacagaagatagctttaatcttcaggctctgtgttatttaaataagctgagggatttgcgagttgggggatgctgccaaatgtatccactgaagataatgatcccatttcagatctgcaggtctattttaatgaaaggagacaggtgagggtgcagaacagaaatgttcatagcacctgaccctccttctttccttaggagtttctcaacccagcgaaattggtgagatttttaaaaataaatactttggagtatatcatgaggtaggattactgtagtgagacagggagcagtaatggcagtcaggaaaacctgtgtatgttaaaaagtgtttgctaagtctctcctgtgtgtttagtgttgtgggggttttagtcgaaacaaattagggtctcagccaacctcaaagggtgtattttctcagtctttattgattcctcttggtttcctcagggctcagaacatccaacaccttaggagcaaatgtcctttgaatgaataggtttgggatgaggttctggaagacactaacacaaacaaccttgataaattacatggtagtgacttcatcacattcttccatctagtcggagtagctggcctttgaaaattacccttatgaagcttacattttactggagaagccagacaaaagaatacgtaaatgaatgaatgaatgagtgaatgaacaaaacaaaattatctctcgttcatagatcaaattgtcctaaacttgctcattaagacttacttagctatgcattttataccactgtccctgagcactttaatcatttattaattattcaacctctacattgctttaggtgaactggaggcatgagacaagtttgggatgcagactttttctttttattgtccttaagaactataatatatgcagttagttagaaaccctgtcctattggtacttttgtttcagtgaacttgagtttaaactttaaggcacagaggttattacagtatcatcttcaggaagctactggtactgaaaagagcattcttcatgccaccccagtatcatctttgtactcttacctttgtgttgagaagggatacatgtcacttataaaacctgggtatgactacgcaagccaccttcacatttgggatagaagattctacaaaagtaaaattcacaatctttgtacatacacagaagccagacttaccagcatgtattaaatctgtctttattttggatcatggcatttatggagatcactaagcaggcagctcatttgaagtgagattcagaacacttacttattttatccatttagcaaacatttacttaactcctactgtgtgtactacatcactggggaagacaattaggacccagtccttgttttcaaggagtaagtactctagtccaacatgaaacaactaatgaaactgagcagggataggcaaggcagaggtaagtgtgccttggaagaaaaggggaagaagaaatggtggatgttgaccaaggctggcactaggtaggctccaggttcccctgggatgctagttttagaggtggaagggcagttttgaagtctcatttcaggagcagggagaggctgtgcgttgatggttccagtaggatggggaaaggaggaggagtcagtgcagttggaccaggctcttgtctgtccatctcatctctccccagggataggatgacaaggaccccagaaatcaacagtgacaccagctgagtgaccacaggcagtaaacaccttacaatagctgctttgatttgtatccttgctggcgtatcttaacaacatgacgacatttaccaaatgaatgactgcttaccaagcaccagtctaagtgcttcacccatgttatcatgtttaatcttcccaattttgtgagataggtagtattattcccatttgaaaggttggaaatctgaggagtgaagaggtcacccagctagtaaaaggtagagatgatgcaacagacatacatgtccatgcttgtttgactgtaacacgtttactcttaacctctaagcaatggtgctttccttaatatagaatgtccttcgaaacatcccaatgccaaaattcagcatattttcatattagaatagctttgcgttaggtctctttttccctgaacatttcttttctctgttttgcagaatcttgttggcctcctttaaatatcattataaatgttggcagtgttgttttaaataattgtgaacagaaagtaaggaagcatatgcactctgatctttttaaagcgatttcattattgtaaaaaattctggttacaactcactaaattggtagtttggagcacctttgggtgtactcccagatactctctactcccctctcctccctcccacaaaaaaacagcatttctaaccacagtgactaagtcatgcacttctaagttagaaaatttatagatgggggaaaaatgtagttgaccagataaatatgcagatagttgggacatgtctaaagtgaaacactggtttcctgacacatattcattaaacatacagtcatgtcacaaaaagagattatggtcaggtgaatttattattatatgtccctcccgccccgagaatagtaccctatagtttatgaagcatgttgataatgaagttatctgtttcatatactctttatgaaaataatattttcccaagaagcctgaaaaacttacttggtcagtccaagtgagaaaaaattgaattattttgtatttagcattttaatccccaagttagaagggacatttaacaactgtactaaattcaaaaggttacttagagacagaattcctctttagatctaatatgattgtctggttttaacagtttggctttacaggaagacttggaagaccagcaaaactgccctttatttgtataaactctgcttgcatttgtgactttttttaaagggaaaaaataaaattctttataggcataatttttataaattaaaatacattatagtatatttatgtgggtgaagcttaggaaattctttataaaatgaactgtattttgaattggtcaactgctacattgtccaaaaatgggaatggtgattctgtggatgaagtggaagaacaaggctattctttactgtcaaaaagggcctttatgctatggtttaaaatctttctgcaaagcccttggatgttataccacacatcctgtagctcctacatgccaaactcccagctttttttatgtggagccccaggaaaaggtgatcacttacctgttagcctcatgcctggtggtgataagaaagatggctttggtgatactaactgaatgcctactagaagtcaaatgtgttgttgtttcaattttatggcctctctgctggtgagtatttaaaatgagaatcgagcaagtgaaagtgtgtcatagttttttgtttgtttgttttttaattaagaggaccaaaccaaagaaataggcccattttgttgagagaggcagtccaacacagtggctcaaagttccagagcttgcctgcaagctcaggcagatgctggtaccaggaatgccctgtacggataccaattcattcgtgggagatagtacaggggcaggtaatgctgaatcccagctccacttatgtccagagcacaagtgatggcacaaagccctagctctcttcatccttccactctcagcactttacatgtgttgccttcctctgatttgattccaagctcaggccccagatgggggcctcccagcaacatgtccctctccctttcctggcttaaaccaattagagtgggttctgaaactggagctggagtttatcccacagaaattgaaagtacagcagggatatttcccaaaggaaagttaggatactattttactaagaagattgagaggaggaggtgacaaaaacaacagatgtctgtacatatgtgagggtggagctgaaattgcttggtttctacagttagcattcgctcaaaacaggcagacctaagtttgcaggtgaggccagtccacaacccaactcagaggctgagacaagcaaagtaagtggaaaggagacggatggtagaaagaaataatatctattgggtgtctgttctgtgccaggatctttatgtttgtggcccagtgtacgccttgtcaccctcatgaagtggtattggaaggtttaaagggtttggagataagggtaaagatagatgtagagtcagggtcagccactgtagccaagagctttgggtagttccagggcaaactgaggaagcagacctcttagagggtaaaatgggttatgattttctaaagaggaaattcttctgtttgacctagatgtgaactgaataatcacttctgttgtttggaaagccataaagccagccaaccatgccacaatcctgatctcgcaactcacatatcttatttttcaacaaggaaaatcctttcaaagagataaatgtgaattctgtgtgccatgtatatatttgtaccacatttaatttcattagctataatatcatgtagctgtgcttatttaactgcttagcccagatggtaatgccttctgaagaaaaatggctacacagtgtaattgaacatgtcctattgacagagttacaacaacccattttccccattaaatataggtgattcaataaaatgaacacagagtctattactctgccaccatttctagctgaaaatgcaaggaggaaatgttctacaaggtgaagaaatggcacagttatgttgcatgcagtgggaggacaggcgtaaaggcaggcctcctcctcccgccttggacaaaagaggagctatttgttgacactcagatttggttgggaaccaaggggagaaccttggcgtcatcagctaagacctgtctgaaagtgatgatgatagcagatgtgaacatgaaaactaggccgtacattttggaaaatgatgtaaaaggatttggcttctaaatggaatcaagtggtagaaacagttgtgttggctctcagcagatgagggtcttgggtcttatgaatgttgtcaatcactagtataaaaatattctggccaaattagtatatgagaacaactatctgatgaagctatcactgcaaatatttttgtattcattgaaaaaaaattgccaaggcagaaggattgcttgagcccaggagttcaagaccagcctgggcaacatagcaagaccctatctctacaaaaaattttaaaattgactgggtggggtgatggtgtgcatctgtggtcccaaccactcgggaggctgaggtgggaggattgcttgagcctagcggttcaaggctacagtaaactgtgaccataccactgcactccagcctgggcaacagagcaagaccctgtctcaaaaaaaataataattacagggttggcctccctgatcctgtatatattgtctatgaaattgacaggtttggtgtggtctaagaaagtaagtcatactcgacactgaaactttcctaggaagagcactagagatgatgtgagaagatgttattgaggaaaagtttgggaatggcaccttgccatgtggcgggacttattgcagttgctatgtgtatattttttcttagttttcttcatgttttatgagtaaagacttacagtcgttctctgtctttgcttatggggaagttgagaattttagagtcaaaaagacccaaaagcccactctggcttaccctctcattttcctgaagaggaaagtgaggcccagtgaaaacccacacaactcaggagagatgagccagggtccaattgtcccttctctcattactgcattttgcccttattccagtgctaagggacttttggggatgaaaggagagaagtgggaggctggaaggagtgaggtttcttgtcctcacagctagtcacccagagaagcttaagaaatcattacaggcattgtggctcacacctgtaatcccagctctttgagagactgaggcgggagcatcgcttgagaacaggagtttgaggctgcagggagctgtgatggtaccacttcactccagccggagtgacagagcaagcccctgtctctcaaacaaatataaaaataaaactgaaaaaaagaaattacttaaaatatttttcttatgtaaagaagtacaaaatttgaaacccactctcctaaacaataggaattcgtacgaagagtgatgggcatatattatgcctccctcttcttcactcctgtccagtgtgtcctagatatgggcgtcacaatggctagtatatacctaaatgaaatgacaaaaagtgaagctgaaccttgtcttcttatggagaatatattcagaaggtagaataaaaagatattttagggtgattgagtttaaacaagtagaacctggtcactccaaccccacccccgatcagattctcaaaaattagacttagaaatcatagtcctggatgttagtcaccctttctgcaagggaattgctatctgaccttgcatattgcatgtggacaagttcagagccatcagatccacctgagaaaggaggcaggaaaagagggcaagccttatcaagctgctgtggggatgaatccagtccggtggaagaaactatcccacctctgagccctgccagcacaagccatctgtctgcatctaacaacaccatgggcctcagctctgaagcccctcccttggtgactcagcaatcaaactgttcattttgcacatgttttgtgtttgattcatttagtcactgagtcttcagtttctctgcctgctttttgccctgctgatggggaccagcctccaggtcagcacagcaggttgagcctagagaggcaatcacagtcccaggatgaacttttttttttgtccctgaaaggggcctttccaggagactccccaggggctgctgatatgctcttccaaggctttcctgattgtctgtccacccatacccaaggggaactgatgtttctatcctctcccataggccttttctaggctttttacccacttccagcctgtctcctaggggcctgattggccctctccacttctcccaaggcagcctttcttcacttgcctcagccacctaatctctgtcccaccagttttggggttttccttactccatgcgtttacctttccacacttgcacatgcacacagcaccgcatgaaaactcctaggaatctctccttcaacatggcttaatagtccttcttacctaatttcccagtgacctctgactcacagttacacaaaggaaatggacgtacacctggagcccagctgacttgggctaaggttggtcatggctctaggtttggtttaccttattggctagaagacagtagaggcccaggcactgtgtgctttatggatcgtctttctaatttacttgaacctgggatccatggtcacttctaagagatcaagtctattttactctaagtagtttctttgagtaaggttggacatttatttcccttgacataaggtaaacaagtgtgcctatgagtgtggcaacaatgaggagacattgaatcctcaagtcacattggcatgcttgttgaggcttttaaacgatctcagtatcacagttcttggtaataactgtaaaaacataatcacaggtggcacttggcatgaaaggtatgcttggttcttttttttttttttttttgtgacggaatttcgctctgtcgcccaggctggagagcagtggcatgatcttggctcactgcaacctccaccttctgggttcaagtgattctcctgcctcagcctcccaggtagctgggattacaggtgcctgccactgcgcctggctaatttttatatttttagtagagacagcattttgccatgtttgccaggctggtctcaaactcctgacctcaggtgatctgcccgccttggcatcccaaagtgctgggattacaggtgtaagccaccgcgcccggccgctcagttcttacataatgagggcatccatggatttttaaatggaggtctttatgtttccagttccgtgtcttcccaccttcagaaagcactattttgctgaatttgtctaaagggcagtagcttctagagtaaccccaggagcaggtcttctcaaaatgcctatttatcagcctttgcatgagttttgtgggagctggatagaatggaaaaagaaatgaggaatgttcttcagatatgacattgtacagatctattcttccaaagaaatttgccttgagaatagtactccagacatggaaggggctctaggtatttaggctatggcagaaggtaacttgtaacatcttttcagaatttttgcaacctctgattctttatttgacatttttctttcttaataagatgcacagctagtacagcagcatcctgtaatccatggatttggatgttctgggcgtaatcatccctcaaaatgcaatacaggtgtggttagtctaagccatcttcctgcaaaaactttctattcctcatcccctccttagactccctgtttttgtaatatgttgtcaactgaaccacatttatcataaaatttatcattttctttgtatttctactgagatctagatagtcatcaacatgggacatctttccagcttgaagcaaaaattcttggtacttaggtatctcctgtagccttggtagaggcatgtgtggttaggcctttctgaatattgaaaagagctcccttatcccccagttggatccatggaactcctggtcccaaccactgaattcagcactgccttgtttttgcctcaataccacaatgatggagagaagctctactttaggattcttatctgacaaattagacagcaggaccccttctaccttctaatatattagatttaataaaataggcatatactctctactccagagaaccaaatgcctttcagcttgggaaactaaaatacaggggtgtttgatttgtgtgtggttttgcttgtttgttttgagactgagtctaggtttgtctcccaggctggagtatggtggaatgatcatagctcactgtagccttgaactcccaggctcaagcagtcttcccacctcagcctccctagcagctgggactacagatatgcaacaccacacctggtttattattttttttttaatagagacaaggtcttgctttgttgcctaggctggtcttgaacccctgacctcaaatgatcttcccacctttgtctcccaaaatgctgagagtgcaggtgtaagccgccatgcccagcagagtgagttgttttttaagatcacactgcaagtttatgtaagaatcacttgaataactttttgttcctgttgggttaagctggtgggctagatgcttggaagttgtagaccttactctcaagaagtttctgtgcaagagagcaaataagcaataagtaaaattaaccacattcagcagtaaagaatgattttaagccaacagtttatgatgcaagatttaagagaatggaaaagaagttatttcttttaaaaaaatcgtttgagatgaaattcacgtaatataaaattaacaattttaaagtgaacagttcagtaggatttagtatatccacagtgttttacaaccactgcttctatcttgttcccaaatattttcatcactccagagtaaaaccccttacccattaagtagtctgtacctatcccttcctccccattgcccttagtccccagtaaacctctgatctgtgttctgcctcttcagatttatctattttggaatcatacactctgtgaccttttttgtctggcttctttcacttagcataatgttttggaggttcagccatgtatgtgtgtataattactccactcctttttatagctgaataatactccagtatttgtatataacatgatttgtttatctgtacatgcactgatggatgtttgggctgtttataccttttggctattgtgaacagtactgccatgaacatgtgtcacatatacttgtttatgtacctcgttttggttcttctgcatatatacctaggagtggcattgcaggacgatatgatacttctacattaaactttttgaagattgccgaactattttctagaatggctgaaccatttcaagttcctaccagcaatatatgagggttccagtgactccacatcacttccaacacttgatattttcctttttcttaaaatagccactcttatgggtatgaagtggtacctcattgtaaatttgatatgcattttcttgaccaatgatgttgagcatcttttcatgttttttggccatttttatatttttttttagagaaatgtctactcaggttttttgctcatttttcaatttggttatttgtctttttgtcattgaattgtaagcattctttatgtattctggatactagatacatatgatttgcaaatattttcactctctaggttgtcttttcactttcttgataataaatgccttttgatgcacaaggtttttaatttgatgaagtcttagcctgtttattctgttgtaacaaactacttgacactagagaatttataaacaaaggaaatttatttcttacagttatggaggctgggaaatccaagaccaagatgccagtagatttgctgttgggtgtggggtgctcgctctgtttcaagattacaccttgttgctgtgtccaagtggtggaaaagcaaaaatgccaaactctgtgtgaagcctcttgtataaaggccttagtcccattcaagaggaaggagccctcatgacccagcctcctcctgaaggcctcacctttaaaactattgcattggagattaaatttcaacatgaattttgagaaacatattgagaacatagcaaagtccagtttatctgttttttcttttgttgttaatgcatttgatatcacatctaggaatttatggccaaatccaagatcatgaagatttaccactttactttcttctaagagttttatggctttagtttttatatttaggctgttgatccacgttgaattaatttttgtacatggtatgaggtaggggtccaatttcattgttttgtatgtggatatccagttgtctcagcatcatctgttgaaaagattattcttttcctgttaaatagcttaggcatcttgttgaaaataagttggccataggcatatgggtttatttctcaactctcaattctatttcattggtctgcgtgtctatccttatgccagtagtacactggtttgattactataggtttgtaattaagttttgaaatcaggaagtataagtcttccaacttttttctccttttacaagactattttggcgattgagggtccattgcaattccatacaaatctgtggatcagcttttgcatttctgcaaaaagatcactagaattttgatagagattgcattggatctgtacattaccttgggtagtactgacatcttaacaatactgtctcccaacccatgaacacagggtgtccgtctatttattcaagtcttttaaaatttcttttagtaatgtttattttataattttcagcatataagtctttcacctttttggtgaaattgtttcctagatatttcattctttttggatactagtgtaattgtattattttcttaatttcctttttagattgttcattgctgatgtgtagaaaaacagctggttgagaatttttgcatcaatgttcatcgcagatattggcctgaaattttctttttttgttgtgtctctgccaggttttggtatcaggatgatgctggccttataaaatgagttagggaggagtccctttttttctattgtttgtaatagtttcagaagagatggtaccagctcctctttgtacctctggtagaattcagctgtgaatccgtctggtcctgggctttttttggttgttaggctattaattgctgcttcaatttcagaatttgttattggtctattcaggaatttgacttcttcctggtttagtcttaggagggtgtatgtgtccagaatttatccatttcttctagattttctagtttatttgcatagaggtatttatagcattctctgatggtagtttttattactgtgggttcagtggtgatatcccctttatcattttttattgtgtccatttaattcttctctcttttcttatttattagtctggctagtggtctatctatttttgttaatcttttcaaaaaaactagctcctggactcattgattttttttttttttgaagggtttttcatgtctctatctccttcagttctgttctgatctatactggcaaaccaaatccagcagcacataaaaagcttatccaccataatcaagtcggcttcatccctgggatgcaaggctggttcaacatatgcaaatcaataaacataatcgatcatataaacagaacaaatgacaaaaaccacatgattatctcaatagatgcagaaaaggccttcgataaaattcgacaccccttcatgctgaaaactctcaataaactaggtattgatttaacgtatattgaaataataaaagctatttatgacagacccacagacatactgaatgggcaaaagctgaaagcattccctttgaaaactggcacaagataaggatgccctctctcaccactcctattccacacagtattggaagttctggctaggcagtcaggcaagagaaagaaataaaggcattcaaataggaagagaggaagtcaaattgtctctttttgcagatgacatgattgtatatttagaaaaccccattgtctcagcccaaaatctccttaagcagataagcaacttcagcaaaatcccaggatacaaaatcaatgtgcaaaaaccacaagcattcctatacaccaataatagacaaacagagagccaaatcatgagtgaactcccattcacaattgctacaaagagaataaaatacctaggaatacagcttacaagggatgtgaaggacctcttcaaggagaactacaaaccactgttcatagaaataagagaggacacaaacagatggaaaaatagtccatgctcatggataggaagaatcaatatcatgaaaatggccatactgcccaaagtaatttatagattcaatgttatccctatcaagctaccattgactttcttcacagaattagaaaaaactactttaaatttcatatggaaccaaaaaagagcctgtatagccaagacaatcataaggaaaaagaacaaagctggaggcgtcatgctacctgacttcaaactatactacaaggctacagtaaccacaacagcatggtactggtaccaaaacgtagatatagaccaatggaacagaacggtggcctcagaaataacaccacacaactacaaccatctgatctttgacaaacctgacaaaaacaagcaatgagagaaaagattccctacttaataaatggtgttgggaagacctgctagccatatgcagaaaactgaaactggaccccttccttatactttatacaaaaattaactcaggatggattaaagacttaaacataagacctagaaccataaaaagtctagaagaaaacctaagcaataccattcaggacatagacatgggcaaagacttcatgactaaaacaccaaaagcaatggcaacaaaagccaaaattgacaaatgggatctaattaactaaagagcttccgcacagcaaaagaaactatcattagagtgaacaggcaacctacagaatgggagaaaatttttgcaatctatccatctgacaaagagctactatccagaatctacaaagaacttaaacaaatttacaagaaagaaacaaccccgtcaaaaagtgggcgaaggatctgaacagacacttctcaaaagaagacatttatgcggccaagaaacatgaaaaaaactcatcatcactggtcattagagaaatgcaaatcaaaactgcaatgagatacgatttcatgccatttagaatggcaatcattaaaaagtcaggaaacaacagatgctggagaggatgtggagaaataggaatgcttttacactgttggtgggagtgtaacttagttcaaccattgtggaagacagtgtggtgattcctcaaggatctagaaccagaaatagcatttgacccagcaatcttattaccggatatatacctaaaggattataaatccttctactataaagacacatgcacacatatgtttattgcagcactgttcacaatagcaaagacttggaaccaacccaaatgcccatcaatgctagactggataaagaaaatgtggcatatatataccacagaatactatgcagccataaaaagggatgagttcatgtcctctacggagacatggatgaagctggaaaccatcattctcagcaaactaacacaagaacagaaaaccaaacaccgcatgttctcactcctaagtgggagatgaacaatgagaacacatggacacagggaggggaacatcacacaccagggcctgttggggggtggagggctaggggagggatagcattagcagaaataccttatgtagatgatgggttgatgggtgcagcaaactaccatggcatgtgtatacttatgtaacaaacctgcaggttctgcaaatgtatcccagaatttaaagtgtaataataataaaaaaagaaatacagctgatttttgtgtgttgatcttgcaattttgctgaattaattttattagctttggattttctgtacatagaataatgtctgcaaatagagaggccatttctttctttttcttgtctaattgccctgggtagaacttccagtgcaatgttgaatagctatagataaaagcaggcatcttcatcttgttcatgatcttaggaagaaaagctttgtctttttccactgagtacaatgttagctgcaggtttttcataaatattctttatcatgttgaggcaattcccttctatttctagttttgtgagtatttccagcatgaatgggtgttgaattttgtcaaaggctttcttgcatcatttgagatggtcctgtggtaagtaaaatcttaaagagtaggactgataacagatacagagaaatgcgattctggagaagtaagtaactaacttacagtggtaggtgcatgactagtatctgcagagattagtgcacaatctaaatcactgtgtagagtattgggggcagaggactgaatgcagtacaggcaagggcagattctgagtagatcagggaggacttgattgacagattgccttcatcttgtctccattctggagatccttatggtttctgagcccagtcaaactaggaattgtacgccttgctcattgttctctccttctgtgtcttcacttctcttccttctattgactttcatgtccctctaacaatctttcctttttaattttggtagaaaagtgtcatgtaaaacaaagaaaaaatggagttttttggtactgtgtgataaatcttatgattttttagaatttaggagtacacataaaattgagaggtgagccaacttttttgttggtttatttctagttatgtatggagatagacctgctaaccagccaacagctagtgtcagggctgtaaattagactggaggaaagaatgaactgcacatttctagctcctgggccaaggttcctgagatttttgccagccctcttctagacagcagcttggtacctcagctgtccttctcatcagggagacagatggaacctctgaggtttcctgttgaggcgtctcagaattcaaagttgttatgatgtgtgggctttgaaaatgccacacgtcagggaagctgagtttttgtttctcaggctttcttatattgagcatgtgttcctttctgtctttgtggcattaagtttcattatgtgtgtccccaagccttttcctggaatctcaacagaggatgggttttagctctgttggaagttacattccattaagtgtgctcaaagatctgctttactacacactctctcctgcccaattcttaggccagccccttttcctctccctactcttgtctaattagtcctctccttcaaaaggcagccctttcatgggattctgctccccgaagtagtgggccctgacttaagggccagcccatctttgtccatggccatacttatcagggatgtgactatttagctctttaaccaggagtctgtcctttctagagaccttccagcatactattaacctaagtgcataggcagaggagaccaggagcacttggtacaaatgttaatggctttttcattagcgtacttcatcacagaattccagctgttggtggcaggaggtgacagtgaggcgtctcttggataagaaggacgtggagatctacggagatgaaaactgaaaagatgcatatgattagtcatcagaaagatgtttgacttctaagttttttccaacagcaggtatggctgcatggaaaatgcatacatccattgttgcaaggcctttatttccttatcaccatcatcaagcagtattaatgaagaagccaattgtgcatgacatagtgcaggtctctgtatgtagttatggaaaacgcttccacagttaaattgagtatggatatgtaaagtgattaaccaagacttgacagctcacacaattctttaattgcagcaagcatctcaagtaaatacataacttttaagaaaatccagaactataaagtcttaatttttgaaacaaatcatgatctttcacgttacaaacagatctttctttctaaaaagatgattcacaatcttttatgctggaacatcaaacatagattttactttacttctttttaaaataattggtttgttaacagttaggaaagccatacgtgttatttgttaaaaaaataaaaataaaatggaacaataaagaaaatgtatccaaactataaaaagcaaaagtcaccaacttgtcccagctgcaccccctccaccccacccatgtttctgttcccacaggacaaccattgctagcatttctctctgtagttcatctcttttgaaagtacatatgtaagtgtgtgttaaatgattatttcagaatttatattgataaatgcctatgttttctattatttcaatttgcccacatggagggtgattgttttttagtgtgttcccttagcttctggaatacaaaagctgatgcctgtataccttgactttgctgacggcagtggtagtgagtttagtgctttctacttttagctttatgttttgcactatttttgaattatatcaattagctatgatgtatacacattcaggattctttaattttgggtaaaaataattcttcactctgtgcctacttagctaagaatatctttaacagaggcagagctgtgaaaccaccgagcaccaacactgcctctctggcttttgcagggacgcttgggtttcaggctgtaactcttagttgcattagcctctgataacttttttgttaattgataagtatgtgtatgactcatcaagatgctggttgctcagtaagataaaattatattctctaacactacttctcctttagaagcttacttacctgccttggtgtcttctgtctcggtcttactttgttttttagtttgtagtttgttcttcagcttactaaacctctttcattgactgtggtattggctaccgatttaaaaatccttgaagacttaaaactcagcagacacgtacagggtggacccctgctttttctcaagtctcccttcatctccaggaactgaatttttcatgcagtaattaaaatttgtaggtcaagcctcccatggcaccgtttgctgctaatatgggaaagcagtgatcagattcgcttatgctgctcttcactgagctgagacttaaaggatgaagggtgacattttcccccattttgtaaattaatgccattgatctgcctaacaagaacaaagttaggcttcaaaataccaaatgataaagagattaagactttaaatggctttccaaaaggcaacctctattgtaaggctccgagctgactattgaactttcaattagaatttctaataggctattgacttaaatggacaaaatgttacaagtgatagctttcaagatgacaaagattgcttcttacgttctggaatattactttatgtagcgtgcactgttctggagggtgaataataataaactgccctccccctgtagagtgtcttctgcatctgtgctatagttttctcaaaggtgaataaatgcattttttaaaggcatttttgaaatacttgctttttcatgtgtttgctgaacacaggttttatgaaacctttcatggcagggaagtcccattagtctttagcactgtggcactattcttcttttatgaaaaatagcccatgtggtatgtatttctctgcacacatgtgtgttcatgcatgttaacatgtgtgttcacagttgggacaccagcagatctgttgtctatcattgccatgaggatcagtccctgaggccttgctctctgcctcagtttactgttgttggaagctatgattcttttccacaatgggcttgcagtgtagtgtgactcaatttaggccttgttgtgaaacactagctctaatacatttttaaatactaattttacaaagaccagctacctcttctaggataaagggttaatattatgcttatgttacagtgcattaaaaactctaattaaaacagcattacattcccatctgccaatctccagtaatcttctttaattgcagtaattaaactatatttacatgttcagaatacttgtaatttagcaaattgcactctctgctctacatttaatcaaacaaccagttccagtatatttagtgtggaaagaagtaatttcaatgttttgattactatagcagatttgacagagtaagtgcccctctagtagagggcttgaaagggaaggcaaacatgaaatatagtcatggttttgattgtcatgtgaatgcctaattacatgttggaggattaactattaaagggtatcatggttgcagttgatgtttagaaacagccggtattacagatagcatagactgtcttttaggaaaatttcacaagaagttttctctttaaaggttgtgagatcataggaaaatttagtgaaaagatcgcctacattgtataattgttattatgtcttctacctgtgatcccaaagcctgctatacaagatggttattttagtcttcccagttaaagcccagaagaaattcaatgataaacaaccaagagaaattgcaatgattatatcaattcagggatgagtattccctcatttcggtatcttttggcaagtctggttgactctggagaggacatgtggtttcctggaaaggactcatcagtagaagtcaggctttttttattttaccttttgctgctgttgttgttttaaaccatgactctctactaggctgttccacctaacccatctccagcctcatctcttatttatttatttatttatttatttatttatttatttatttattttgagacagagtctcactctgttgcccaggctggagtgcagtggcgtgatctcggctcactgcaagctccgcctcccgggttcacgccattctcctgcctcagcctcccaagtagctaggactacaggcgcccgccagcacgcccagctaattttttttgtatttttagtagagacaggtttcaccatgttggccaggatggtttcgatctcctgacctcgtgatccgcccgcctcagcctcccaaagtgctgggattacaggggtgagccaccgcgcccggcctggcctcatctctttttttcttggttttctcattttaaaaacaagtaacagtgttgtgaatattgattagattcaaaggaacaatgtcttagtcatctcaaagctatttttaaaattcttattgttattatctctttgcaccagtatgaaagtttctgtttctttatctagataaatttgactgggatattgggtattgccatcaaatctctgttatccaaaacaacgtgctaatttattcaacacagaaatataagtaatactctctttttcagtagcttctttttaattatttgatgttaacagtatttctgagaatttttctctctctccacttcggggtcatctattgtattaataaggattatgaattaatgaaaacaaaaagctagtctagcgtacctgtttaaaccaatgtgaaaccttgcttcttgaccatatgaaagagcaaagctactgaattgttaaaatgatatgcaggagtgaggatccaagattttcttcatgggtcagctagtaacttactgtgatactgagagcaacatgtttgactgatttaagtctcagattgttcaaggtggggtagagaatagggcctggatttttttggttcatgaagagtcttgacataaagtaagtattagactttagactgtcacaggaataaccattcagttcaaatctacactcatttctgtgttagattagtgagaatttaacttctgaaaaaagttcaggcaaaataccgctgatgtactgcactaaggagatttgagagtgccagagatactttgaaaggaaaagagatgtaatttgaagtggaggacagggctagccagggttaaaattgcagctcttttacttagctatttaataccaagcaaattaccttatcctctgaggtcttgtctgtaaaaatggggataataatacatacatagtactacactattagtttttctctcctatgacttgccatctgtgtccatgtatggagagaaacacacacacacacacacacacacacacacaccccgtaataagttaagagtctttggaatggtaaatgatttgaacataaataccagtacacattttttttaataatgcagcataaatgtcaagatatatatgcataagggatgaggtgtgcctagaagctgtaatatctagaattttcgcaaaccttatttataaccatttgtttctgaaccctaacaattcttttctgaaactgttaactgaaagatctgaatctcactatttatttcacactcttcacatagaggtgctaatgagcagcagaataaccccaaaaatggtccttaatccaaacaccgagaagtcaagttataagtaattaagaatacactggatggaacatacctacatggcagctagcatctgtgctttccagaggttgctggggacggttagttcagttctcatttttgatcctctttggaaactcaggagttaaggtcagcatcctcagtacaaaggtacttgaacatgtatgaatctttgccttcttgaaaactttttatcttgggaataaggaacctgatacaaagagaatctctagtatttcattccatcgagagaagttttgacatttacaattctgctaatttcacacatcatttcgcagcatgcaggattttggcgcctgccaaggggactgcaaattctttttggaaaaagtacttttttgggtgttggaagagttttgagttacagacacatttctttaatagtgttcttgaaatgtccatgtggtcttaatatgtaaatcatatgaaactcaaaacccactcctgaacttactcttccaagaaagctttaaaacagccctcattctaatagtaaggctgttttcctcttttccaatgtttatgtatactgtataatgtttactgtataatgagtttattgtataataagggactctgatttattagctcttcattattctcattctgtcagcttcccaataaatgctacaacccttggcagagacatgagtctcaatcaggtgatatcattgctttttaatgaactcttcttaccggagtaacagcattacatgtgaaataccttatcctgcattattaacggaccgcagcataaaaggcacaaaggcactgagaaggttgcactgaaaaatggggcagaattcattaccaattcgatatactgtcagctaacagtctttgattatcatatttacccttctgaaactgtgaaaaatcatgggcggagccgctgtgaacaatagcatgtgtaggcattttgtaaatgttgccttagttgtttaatgcccaggctgactgctggaatttaacacagtgacaactttctcagatggggcatgaaaaaaactgtgatattttactacctgagaagttaagcactgagatagttaggacccagctctcattagctgaatggtagatttttctaattagttctttctagtgcaattagcacgaaaagagtctaatcacctcatgtgaaaccaatctaatgctcagaaaagaattcccttggcctctctttcagattggatcttaggattttcagtctgcctccttaaagaatggaatctgttagtgactgattatttgaacggtaaggacagatctgtagaaaaggcaagaaatggacaacttattgacttgcagtgcaagtttggctggagaaggtgtttagaaatattcattaattggcagttatcacttcaactataggttctggttttcttgatttctttcattttgaaatgggagacttgggcccgggacagctatagttcagcatggctgcctctctggagggcatgaaacatactgcacattagaatcaaatgcattcggggcctgggactactgggcttgctttcttagcctctgcagtgcccagattcccccatcagtttttgctaatctgtgtgttcagggctttgcctgtcctctctctctccctgccttgcagtcatctgtaggcaccacattcatttttgaactgttctctaatttctagtgcccatccatcacttcacatttcttaagtaagccaactctgggcatctcagttgatattgttcatttttaactggaaaggaaactataatgacagcatttctggcacataattttttctttttttttttttgcgggggggaagtcgcttgccagaagatcgatgagaaaatgctgagtatgtgtgtatttattatcaactatgcagaaaatgggcatccttgctcatcaggctacagagggtgacaatattgaatttccattgttcatcccatcactgcccagtagaacttcccatgatgttggaagtgttctgtacctgcactgtccaatacaggaggcactagcgacatgtggctgttgagcacttgaaatgtggctagtgagactaaggagctaaattttaaaatttcatttaattttaatgagtttaaatttaaatagacccatgtggctaatggctaccatactgaacagggcagatgtagatctcttccacctcctaaccactgtaccccaccttacacatagctgcatccttaacagagaatacactgccctccgcagcctcttgctatccattctcttcagctttgccttaaaagcaatcagactttttccagtgctgtctggagtttgacacaaggcattcccttggcttgtgctatctgtagatcattctgtatttcaccgtggcagtgttttgttctaaagttggaaaagaccttgtagttttttaaagagccaaaatacaggattgtttctaagaaaggaggtggccagaatcagtaaatttaagctcatttgtggaagcttccaaatctcaaacctagggcagtattgaacacctctccaaaaagtcagattaagtatttgcaaatggcttcaacaaactccctctctatgaaattttaattatagttgattaaatattcactttaatcatcttaattaatgatatttgacaaatattttagctttgcttatgatattcacttgctctgtcagaactctccagttcacactgaaagggtaaagttaacaacctggacagacaggcccatcatgtgtgttatgacctatctggtttcctactcgcatggttagaaggctcattttattgctttgaactctggaattaatcctgcttaaaggagaatagtaagaatactgtggttttctgctcaacagaatgcatgttcatttattccacagacactaattgaaggcccattgtgtgctagtaattgtggtagtcactgagaacgcatggatggaaagacactatctatcccactggattgtaacctcaagccactggaacataaacagttaaaagtactatatgataaatcttctggaagacgggtgatggaatgtaagggaagaaacactaagtggtggtttcaaaacagaaagacttttaagatgtaacatgtaagggaaattttatggatataagggaatacaagggagagtcttaaggggattacaggattttgcccgggataaagagaaggtggggcatttgtgaaggggattatgttttcctaattaactgtattcttgaatgtctttgaagaaaggagtctctcctttcttcattttgtaaagcaacagtgtgtgttagaggaattgctgttaggaaaggaatgaggatatttggtgtgtaactgtgagtgctgggaaatgaaacaaaaggcagccctacctcaggtcctggaaaggcacatagtggtgtgagtgttgcagcccattgaagctacatcctcaattctggaaactaacaagaacagcattagggtgaggccagagatccacctaaggtgcaaaatgtaagggggcactcactttgagggtcgtgcaggttcaggatcagtactgacacaaccctgagaatgagtgtctcctaaaattgtgtgccctagacaccttacttacgccctgaaacatcccagccctgggtttttgtgcagtgaatgggcttgaaaagcaagtagataagaatctgaaccatggaaatatggcagacatggcagaatagaaatcaatgagacctatttgcaaggtaaagtcaagagaacctagggcagaaaaaaatacgaggcatgagagaggggaccctaattgtcctgtcactgaattctggggatcttttctattgcctgatactgacttttctccaatttctcatattcctcagctcctgccctgtcctgaaggtcatgcccagttcaaattcagcccttacctctttgctaagtcccatgccctcaaccttgttttcagagaaggccatgagaactggagtttttaaaatgtccaactctagatagatctgctttactgagtggtcttaacacattcagagaactgcattcttcttggctctctaaattcagtgaccttattttaaaagatgatcaacatgggttagaaccttttgaggattaggagacattttagcaagtttatcaagaataagcaaagatgacatttggctagcagtatgtctcccccaccccatcctgcaaaaccattttttttggagtgaagcttttccatttgacaagtttagaattaccaatactgcttgcaactccttccttactccaaactctgggatgttttcaggagggactcttttcttcaaaggcatccaagaatatagttaattaggaaaacatgcaagaaaagacatcttggctcctctggccgcctgttgtactcttccagcatatgctattacttgtctcagataagtagacaggtggctgtttgcaaagcagggtccaatgtgcctttgactcagagaagtttggaaacaaagccctctgtataataagcttctcactgtatgctgacgtcttctgatcttgcctattccccattacctacagtctgaaagaattttgtagggagtgtgtggtattctgcagaaggctattgtagcataacttagacttagccggcatttattgggcttagaatcacaaaatctcaagattgggtgactactggatggttatctaatccaacttccctccagaaagtctcccatacagtttttcccgcaaagtggccctcgagccataacttcctatgacagagtgcttactgcctctttgttcaacgctggtgaaacctcagtgatacttataagttaactttcattccttcagcattcttctctttagtgttaatttctttgatggtggtaccactttccaacttttatatgtggcctcttaaaatcagcttacccagagaaacttcctgcctagctcctgatttatgtagcttctcaccaccatgccctttctcccttcttataggggcagtttcacaattttgaagctccttgattcccttgagccattgtcctttccaaaacttgtcactatgaaaagtagactatgttttagcctttgaactataaaatctgcctttcagtaagcttagctccatattttgaggtctctagatccccccttagtatgcatcatgagacttgtattactcgccaagactctcatgactttcttcaagcattcagttttgtctaagaagccatcgtttgatccagaatggagtagacctaattatatctcctgtttttttggacttgaaatttacttcaagcctgatgataacctgttggtcagatgctctgccattaactaaatgacaccatcagcaaatatccagatagttgaggtcccagtgtcctgaatctgtggttttataatctatgtcagaagtctatcattttttttttcacctggctgtcatctggtatattctcaaaaggatatcacttttcttcttatccaggtacgtgccagtgtgcttcatctctcatgctcatggatctccatgcaaattgatctgcttttccaaaaactatttattaagcattattatgtgtctggtactatgtcaggtggtagagctacagtggtgagcaatggaaatctacgtgttttttgacatatgacactgcttttccacaatacctttcccaccttaaatcctatcccatgagcctgggtgatactcaggagattatttttatcatgtctctaaaaatctctgcttattttataactgatgatacatagacatctaaagagatgagggcctcacacagggattggccatgagagaagctttcagtgctgcgatctgaggccagtctgatctgacaccctcttaaaggctttcaagtataggccactgggttccacatcccatacctcttacctccattgtggctagtttctcatttgcggaggaggttagagatgttactctcttcccctccaccttcagtgtaaatttctcttaatcaggtcagctcacctccccaggcaagcaaacacatgtctctctgtcttcctgagctacccccgggaaagtctgcattattttagtaccatagacacagtctagaaatctgattcctatgggttgacaacatcctcatgacaaacccttcacctaccacatcatcttatttttataatcaccgaactttgttaggatgaagaactagagcactcaccaggcacccaactctgcgccaggctccatggtccccaaatgaagcttcctaggtctcttgtgtccaagccattcccctcacgtgaaacaacatgaataggtagagataagtggctttgtgacttggaacagacagtagcccaagaagaccacatgcctcccttctggccacgtgaactacatgaagcagtctcctttctgttcagccaagagtccgtgccatctcagtgcttgttttccttcctgtccctttatctggctctgtgcatgactgtttgagcagcctgtgtcttctccttccagccacacagagtactggtaacttctcacaggatattgcggtgtgcctccgtttacactgtctcttcttcctggatgctttcctctatcccctgcaatcacttcttacttacctgaaacttacttcttgtattactgcttaatgacagcttaacttccatgatacctccccacctccttctgctcaattctaggtttgagtatgtgccttcactaagtcctcccataatacctaagcaggtctctatcacagtccatacattgtttcctgtgtgtgtctgtttcttccattagactataatttccttgaggactgctcttgtgcctcactcatctttgtgagtacagtgccaagcatacagtagatgctatttaatgaaggtgggcatgtatgggtgaatattcccagtgtttcaggatgttttttctttctcctctggcttttctattctctgctcacctggaatgagagcggataaaataatacagacaggaaaccaggaagcagaagagaaccccagccacctacctacacttccccctcttagatgccctgcaacagagatctgtcctggggactccacctcatctttgccagcggtgtgcagctggcttcctaaaatccacccagagtaggggttagcttgtcagaaaaatacaaattggatgtcttctgcagggctttgcacagtcccctcagcacccacacttctgtgtcagggaggggatgcagggacacatctccttctaccctctgggagacttgtagtctacggctccaggagatgactccctggcctagaggactgtatccttaaaccactctctgctctgctggcttatgtcatcctcctgctcctttgggtagaagttctagagtcttatccacaaattgtcaccagttataggcttgagtaggcactaaatatgaaacatgaataatgacatgagccagcagagcagagagtggtttaagagtggtttaagggtcagagggaagggaaatgaaagccttggaggatttcagattcactcactcttctttaccttatagcctgtgctgcaaagtcagagtaaagaaacttctgttctgcctcattgcatccccaccacaacaggctgtaagcaggagctactccatgttttaatataaggaaactgaggccccaaaaattaaaaataactttatagtaccagctagccattggcaaaacacgattatacattcagatttgtccaattgtttccccatgtaaatgagaccacagattaaaattattattgtcaattaagaaaaaataaaagaaacccctgaaaagaggatctgatatgtgtctaactacctttaaatctccttgagataaattataaggtgttgtttctattgagccacccccatcaccagtttctcacaattcagtgctcagcaggcagtggctactcaagaattccagctggctgggcacggtggctcacgcctgtaatcccagcactttgggaggccgaggcgggtggatcacaaggtcaggagatcgagaccatcctggctaacacggtgaaaccccgtctctactaaaaaatacaaaaaaaaaaattagccaggcgaggtggcgggcgcctgtagtcccagctgctagggaggctgaggcaggagaatggcgtgaaccccgggaggcgttgcttgcagtgagccgagatcatgccactgcactccagcctgggcgacagagcgagactccgtctcaaaaaaacaaaaaacaaaaaaagaattccagctaagtggcagtgaactaatgagatttcatcacagagcatggtgaacgcttttctaaggtctaaatatgtgctctatagttgtcatggagggccaaagaaatgaagaaaataaagaacaatattagtcttaagaacttttttaaataacaaaaatgactgagttactaaggtcaggaactattctaatgcttttatactcatctcatctaattgctccaaaccccatatgaagtagacactactactactatcatgacccattttacaaatgaacaaactgagtcttgaagaagctaagtaacttgccaaagcacatcccagacttacaggcagtctggctcagagacctctgctcacagacactcctcttcctgggtctaattcaagaggggtgacgtgcgacttagagcagcctgtgggcttagtgattctgctgcttggtgcacagcaagacagaccataatcagcactagaataatagaatttttataagtgattaaagtaaaaccaggatttagagattgagagttgattgttaaaggataaatgatatttggaacatcttactggatttgattaaagtgaaattcaaaaaccatcacaaagagaatgattatttaccagtggtacttgaaggactttttttgtggcttaagtcattggcactccaatgcttaaaatctctgtgctcaaaaccagaatgtaattgatccttagaaaatcagaggttagcgccttctttggcaagctacttctgagctttgttacactgtaacataatcatcctttgaagactgagatctggttttccaggcttttttttttttcttcacatggtgcctggtatcttctcttgaacataatagatactttgagatgggtggacaaaccgaagtcattttatattgctttaggggctctgaatttaagaaagagttgatttctgaaagaaacataatagcaaagattacttaaacacaaaaatctcatttctgttcttaatcagctggacgtcaatacccaggttccagtccaagtgtcacactgtgcctctataagttaatcttttctggaagggaaaccaaatatgaaatagtatcaagaactgggacagtgttggaacaccctgcatgtcctctgttggccactacaaaaggttaaacaacaggagaggctggattagggtttgtgtttggaagtgcatttgaggcaagcttgacagttaagctcatggccagtactacatgccacagcaagaggacaataggagatttaaaagtgtgagcaggctgtggccaaatgctggaattcatgggctaagtagatgaagagtggatggagttaactagtaaacaagtttcatggtccttgaagagacctatttttttttatggtatgaatttaagatgtacaacataatgttttgatatacatacaattagtgaaatagcgataatttgatatttcatatatataccaaaatgattactctgggtgtattatttccttctcatgctgctaataaacaaatacctgagactgggtaatttataaagaaaaagaggtttaatggactcagttgcacatggctggggaggcctcacaatcatggcacaaggtgcgaaggaggtgcaaaagtacgtcttacatggtggcaggcaagggaccatgtgcagagtttataaaaccatcagctctcctgagacttattcactatcacgagagcagcacaggaaaaacccaccctcatgattcagttacctcccacctggtccctcccatgacacatgggagctacaattcaagatgagatttgggtggggacacagccaaaccatatcaacagggaagcaatttaacatatctgtcaccttccatatttaccctttttatgtggcaagaccacctaaaatttactctcctggcaaattttcagtctacaatattattaactagagtcctcctgccctacattagatctctagacttaactgcaagtttctgctctttgacctatatctgcccatttcctcctcctccctacccctggtaaccgccattgtgttttttgtttctatgtctttgactgttgttttttagatgccatatatgagtgagatcatgcagtactttttttttctgtgtctggcttatttcacttatcatcgtgttctccatgttgttgcaaatgacaggattttgtcttcttctttttttttttttttttagatggagtctcgctctgtcacccaggctggagtgcaatggcacaatctcggctcactgcaacctccgccttccaggctcaagcgattctccttcctcagcctcccgaatagctgggattacaggcgtgcgccaatacgcctggctaatttttgtattttttttagtagagatggggtttcaccatgtaggccaggctggtctcgaactcctgacctctggcgatccacccgcctcagcctcccaaagtgtctggattataggcgtgaggcaccgcgcccagccgatttccttcttttttaaggagatgtatatgtgtacacacacactacagcacattatcacattttctttatctattcatccattgatggacacttggttgatttcctatcttggttattgtgaatagtgctgcagtgaacatgggggtgcaggtatctcttcaagatgttaatttcattttctttggagggattgctgtgttgtatggtattctatttttaaattttggtggggtcttcatactggttttcacaatagctataccaacttacattcctcctaacagtatacaagtacctttttctccacaaccttaccacataagtgttgactttttctttttcttttttcttttttttcttttttgatacgaagtcttgctctgttgcccaggctggcgtgcagtggtgtgatctcggcttactgcaaactccgcctcccaggttcaggtgattcttgtgcctcagcctcccacgtagctgggattacaggtgcctgctagcacacccaactaatttttgtatttttagtagagacagtggtttcaccatgttagccaggctggtctcgaactcctgacctcaggtgatccacctgtttcggcctcccaaaatgctgggattacaggcatgagctaccaggcccagccttgaccattatttttaatagctaacaattattgagggcttaccatttctatgagtctaagcactttacaaatatttaatcttcataacaatctctgacatagatactactgttaatcccatcacacatactaaaaaactgaggcacaaggagtttaaggaactcgctcaaaatgtcacaattagtaagtcatgaagccagccagaacgcatgctcttaacccctgcactgttctgccaactctttggagtggtttgtttcagttgtcagtttttgtttgctgtctctgaaaatccttgctcttacagtgtcagccagagtcctgcattgatcacatggcctaacttgcctctctcagtacagtgactttttaatcttcggctgcaatcctttttttcctagactgtaaactccctgagggtagaaagtctgtctcattcatttgtgcccattttaatgaatgttgaaagggagcgtcaggaggggttatctagatgcctgtggatctagattattcatcatccactgggatctttattggtgttccttgtccccaaggagggagtcagcagcaacagaaggcagcagagatctcatcagtgttcatcaaacacatgttgagtgcctactacgaggtaaacagaacagacgttatcttctgtgccctctcagaacttaaggtacagcaaagaaacaaatgagataagcacaggtgtgataaatgcttgtttaaaaaacattttaaatgaaatgcttcgtttaaaaaaagcgaagaggctgaggtagagaataatggaggttgggtggggtaggacctactttaggtaggtaggcatgggaaattcctcatcgaagaagtgacattctaagcgaagatttaaccaacaagaatgacatagctaagaatgagaagactgctggggaagctccttgttggcaaagaaaacagcatctgcagaggctctgaggttggaaaggctttgtttcatctgtttaatagtggaattcagtgacactcattagttacctcttcacacattcccgccaaacacttgtccctgagtctgttctttttcattagtggttcctaatccagttttcaaaactgctcaatatttggagaggttttgaccagttgctctggaaacagaggcggttccaccatagccaacagagttcagaacataaattgtccatttatatccccatttgtatcttaagcttagcttgcataggactcagcaaagcaatatgtcaaattccttatatttgttatatctcttttttcactgactcaaagcatgaaaaatttgaaattaataaaacaattttttagatgatcagagattcttttttctaaaattttctaaatactatggttgtgtcccttaaccacaggcatggtggtttcactgcattttactcaagagaagattgcttacaaatatcacacaggagacctttctagtctcctgcaggagggtggctgacccagggaacctccaggcaagcaggacatatgccaagtatcctacatgtggacagtgtctaacttgatccgatctttctccttccccatgttttagttaagtcccctgaaagcccccattacccactgttcataaagggtctgtaaattatttaagagaaggaaacacagcctttatcccatcggatttttcctctcaatcacttgagtcttttctctgagcacacacacatggcccagactcactgtcaggggagatgtaatgccagcatctggtgttaatatctattgttgacattttgggaatgagaacatgagctgttagggaagatgtttgcttgtacctaattaatgtcccattgtatcctctcttgttgtcagctctgcctcaccatcctgccttggcattttcttttactggctaactttaaaagttaattatttctctgttgaatgttaaatgccaccggtttttaatgccgttccttggtgtgagttattagttatcaaaaatcaaaatgatctgtgcaattatcagctctttacctaaagccactgttcttgctaatcgcgtaaagtgtgatagcatttgctgatgtctggcaacatggatctttctagcagatttaagtttctcactcagtacattcctgtccctgtctggctttccttgtggagatcagatacaaagtcctggtacatcatctaatggaaacaattactgacagggccaagtcttcaaggcccattttgcttgaatctcaaatcactgttaaaattcatttggcaactccaataagtacagagagtaatgaggaacttcaaatagaatatttcctaatagctttcgtaaaacatgtcttggtaggagatcacaactctttctttacttgagattggtttataaaaataatagtacaagttccaactaacagctactaagtgcatactctgtgccaggctttgtcattagcttttcgcatggattatcttaatcctctcaacaatcctgtgaggtaaagtcttattattattcccaacttaaagatgagcaatttgaagactaaagacttgagtaattaatgcagcatcacatggctggtaagtcatgggccaggatccccagccagcagtcactgcagagctgcactgtcccaggcagtgactgtgactcacacgtggctactgagcacttgaaatggggtgagtccaaatgagatgggccataagtgtaaaacctacgccctgttcctaagctttagtcaataaaatagcgtaaaatgtctcgttaagaatgtgttcataccaattacatgttgaagtgataatattttggatgcattgagttacaggaaatatgttattaaaattaactttttgtttctttttcacttctttaatgtggctactagaaaattttaaatttcctgtactgcttgccttatatttctattagaaagggctgctgtgtgtgtgtgtgtgtgtatgtatgggtgtgtgtgtgtatgggtgtgtgtgtatgtatgtgtgtgtgtatgggtgtgtgtgtatgtatgtgtgtgtgtgtatgtatgggtgtgtgtgtatatatgtgtgcgtgtgtgtgtatgtatgggtgtgtgtgtgtgtgtgtgtatatatacggagagagatttctggagtttttcttgtcttaacgagtttccgatcctaaactattgaggaataggcacaaatttctgacccttcctcccctttctggttgtttcacttccagaaatccgacagaaagtacaaatttttacatctgagtctctaccaagagcccatctgttggctcttctcaagtatggaaagatgaaacactgacatgccaggcattaacgagatcaaaagcagggctaatgacagaaatgtggctgctgttaaagtgtctccagaggattatcggggaggactttttgttctccttacggcgaccccctcaaatgtcttccagagagtgcctctcagttccagttcctgaagtcctcctttgccttcctttccaatccttgtccaccactttcctggtccacctccctctctctcctggacgcccatctctggggtgtctgtgcagctgaggcggcccctctgttaagcacttctgacacgaggcaggtcttttttccctgccagtgagagcagagtgtataatggtgttgccctccaccggggatctttgagaagctttatggctctagcagacatgggggaaccaatcacaggcactgcagctgatatatgacactaatatagggttcacttttattctcaacctaaaaaaagatagattgttccaagtttagacaggctgtaaaatcatgtgcttctggaaccatgctgccttacccctgggaccactgtaattgctttacatctgtacaaaggttccttgtaatcgggctttctgccttcatttgtcttcttttcagcctcttagtaaagaccttaattggtcttagtggggcttttttcagttagtgcaactgtacctttagggctgaacaagtaccagacactacctgcggggagaagtgaggagatgggaaagacatcaatactcctttacctttaacagtttaattaatgtgctcagaacaaggagcagtttgaagaaattttggctcctctgggaccctgctacagatcagacataactagggttaggtggaattttctagatttctttcctgcttcagtctctgtgaacactcattagcctcataattgtctcacagtaaactgctgtatcaagtttcagtctgtctctttggaggatcaagttgctttatatcaatagactgaagtactaggggatgtgtgtgaagggaagtagcctctaatttcttctgtttcttagctactaattatttaataatacattttattgcctattaaaatgtggcataacttgcttgtcagcaaaactagatggaacctaatcatttgaggagaaggataattggcacttgtacagatggcttttattgccagttgggtttgttattgcagatagaattccttgccaggtttcttggttctgtttgtgggctggtcagtgttgtgagggggttacttactgtattacaacccaggcggttaaatgtggtattattgcaaatgcagtgtgtactcagttatagatcataaaggcttctgctgtgtaggtactttttttcttctcctccccccacctccccacccctggttttaaaggaccctagtgagttttgtaccacactgaaaattaccttatgtgctggaaaatgcatcagtggagactttgtttaaacaaagggcgtttttatgatggatagaagtggccaaaacttctggatttccatctagtaaaaatttgtgtaggaaaattggaccagtcccagttccttagtagaatttcacgaaggttttcctgttgcttcaaaatgaccccttgaggaatgttgtataaattccagaaaattgctcccaatgtttcctggagcacattaaaaaatgaaggagacacattgtgtgtgggatagtttggtaacagaattagttcactgggtagaacagaggggatcccaggtagttgggctctaagtgggaagcgttggccaacatttgtaactggaggcagatttggcaggcacttgggtaaggaacattttggtggtaatgaagtaggcaggaacaaaccgcgcaggggaagaatgcttcacactgccaggctttgtggcccagagcctagcattctcatccccaggtgcccagctcctctgccttcccaaggtgctcaagtttgctttctactcagatatggcccagtttcactggcaaccacctcccttatttgttgaaagtatggcttgtgttctgacccaagagagccatttaaaacctataatgatgtccatctttgtacgttttctgggtcccatcttcccatccattactactttgtcattgttcttatgtctcatagttgaactcctgaggtctaattgtgccagaacaacatgtctcccatctgtctggcaactctcttggcaactgcattcctcttcccttgaaagaggtacacactcttgacccctcccttccaaaagcctcagtgaagacctatgtgttttacctgtaaacgcacggcctttttaagtgtggaagggaatgtctagacttgatactttagaaaatcattatgaagtaagcttgacgtaggtagctttgtttcttaggggttgaacttgggaattactgtaatttaatacctacaataaatgtgttaaaatagggaagaaagccaattctgaggttttgtgtgttatatgaagggtgtgtgttatgcatcgtcattaaattttcttaagcaaaagctactagcaagtggaagccaatttaaaaggtgtatattggaaccagaacatgtagccagaaactggcttgggaggtgcaaatcctttagaccattgagagcatggaggttggcgagacctagaatgtctataaccttagtggtcacagtctacagtccactccggatgacgtggggctatggatgagcagatgggtgggtatgtgttggggacacgattttggacaacgttacatctgttgatttctttctgtcctgtagttgactcttctgagtttatttgtaaatcaccagttatgccaatagtattttcttatcagccctcaccctggtaacttttctcttgttgatctagatggacagacccaaatggagggaaaggattttaaacagtatgccattctttattaaatgaagcaccattaaaactacttccatctctgagtttcctttttccaggcccacgcctaacatttgcaaggcaagcatacacatggaggcccagcttacttctcttcacttctctttccagcaccatgaggagctttgctcctcacctcactcactccatacatccaagctccacccatactttttgccctcaccagcccagtaaacagctgcctgttgaccaccctcaagcctataggtgtgtgtaccaacagcatggcctgcccttgggaggatggcttccagggtaggaacctgcctatgcaggccctagaagcagcttaggccatctgggaagaggagtcctgtctccttggtgtgcaccacatggtcctaagggggaatgtgtcagctaggtgggcccatccccacgacttcatggattcttgccccatgtggagggacacagctggaggggccaagaaggatccccttatgcatggtctcaaggcaggggctggatctaacctgtattgcctctgccttttcatttcagtcttcataacctcacacttcatgtcctgcaaaaataaaatgaaataaaatggatccagctctccttcagaaaagctaaatggatgagctagttaactcatcagtgtctgcggacacaaggtgtgaaggcttagtctttagattcaatactggaaagtcagctggggtcttgtgcaaaagatgtgatgcattttgtgtaagaagtctgttttttccattagcatttaaagtatagcatactgctaaccagacacaaggaatgctctactatacagtgaaagaactatgcaagggaaaattgcagctgaaggaccaaattaggaatgttttcaatttcaagagtccagagaagaaacaaagcattatattgacatagtttgaacaaagtaaagcacttcgaaccttgctaacatttttaaatacacctttgttaaacctctttaaagaatgacgataattgcgttgttgttgttagtattcctaatgtccaaagggttgctgtaatttactctcccttcaaatttgaatatggttcataggcttctgtcttagtccatttcatgttgccataacagaatacctgacactgggtaatttataaataaaagaggttatttagtacaaggttctgcaggctaggaagttcaaggggcgtggcactggcatctgcttggcttctggtgagggccacatgctggtcaaaacatggcagagaaggtcaaaggggaagtggacacgggtgaagaaacccaaggggcgcccttgctttatctcagccggctcttgagggatctaatccattccctggagagtgagaacttactcacttccaaggagagtgttcatctattcttgagggatctgcttccaggacccaaaagcctcccactacaccccacctcccaacactgccacactggggattaaatttccacgtgagttttggtggagacaaaccacatccaaaacacagcagcttctaaaattaggttaagaggacacaaactctatccagaagccaatgtagtatgtgttttctattgtgctgctacccaaattttaacaatgagaattctgactttgatgtggcagtgatagtccttaaagtatttgaaggtctttgtcagttgccacttatttttgtgtagcagaagcacgggtttttatgattttgatcttcctttaaaaagatgtaggttaattattctgtcatctttatctgacagacaatggctaatattgtttattgtgtaaatgagacgctttactttcaaagaatgctaatattggctttgaaaggaaaaaataagcaagtatcttttttttaaagaaaaacagtctcactctgtcacccaggctggagtgcagtggtgcgatcatagctcactggagcctcaacctcctgggctcaggcaatcctctcacttcagcctcctgagtagctgggactaggtacatccaccatgcccagctaagttttaaactttttttctagggatgggagcctcacttgggatatagaaacccctagtgttgtccaggctggtctcaaactcctggcctcaagtgatctgtcgtctcccaaagtgctgggacttgaggcatgagccactaagctcggcctaagcaagtatctttaaatgggtccttgttagtcagcttttttcattatctcaagagaggagagtattaggagagcacattttcagacacactagaagacaacaataatacctgtgacaggtgtatgaccccggctcatggtggccttctcactcacctgactcaaagttgggcagcgggactaattttacataatcttaaatcttataaatgactttctgctctcttttccttacaccactgatttctcttccctggcacccttgctagtgagataaaacagggaacagagccaggaccagtgagctgccatgtggagtgctgcatctccctgaaggctgaccgtgagctgtgttcatgaaggactcattgtcacattctacccagaggcctctaagctgctcttttctggagtttaagcctcattcttaggacatgccgtgaatttgctctccaaaatgattccacacacaaaagtcctctctctataagccctaccagcattagccagagtcctcctggtattctttctcatctccacctgggttaaaaagtgagtgtgtagcagatttgtttaaaagggtcctcagctacacccagcctcccatataaaaatcgattcttggccaggcgcggtggctcacgcgtgtaatcccagcactttgggaggccgaggtgggcggatcatgaggtcaggagatcaaaaccacagtgaaaccctgtctctactaaaaatacaaaaaattagctgggcgtggtggcggacgcccgtagtcccagctactcgggaggctgaggcaggagaatggcgtgaacacgggaggcggagcttgcagtgagccgagatcgcgccactgcactccagcctgggtaacagagcgagactccgtctgaaaaaaaaaaaatcgattcttggaaaatcaagtcagataatgacgatagagcaaagtattttgctcgtgtcttttgtttggctcagtgttcatttgtcattacgcctcagcctccttttctttaagcacttgttgtgatctccgggcatgtgcttatgttcgtgactgttttccagagcattgctgggctgcttaacttttgatgctcccgtctaaataatgactaggttcctaagatgcctttacgcttcctagaagaatctgccaccatttgaattctctagcagcaccccaaaagtgctaaattatacagtccaaggaggacagtcatccaccaaagaaacaagggtaggatgaacagaaagggagaaagatgttgaattgagccaattcagggagtaagtaatacatgctctctggttgaactgatttttcatatggctaggtggctgggttctgcctgtgacttgttcaactctgcaagctactaaatagaataaaacttgctgaaatcagagaacttcaagaagataagttttatgtatatgtatatgtatataggcatatattcatatacatacccatgctctcacacactcatacacaaacttaaaggattctagtttagggtagacttaaccctttgacagttcaaagagagaagttagagtctacaaagtgattattatgtaaacccaacagggcctttcctggaaataccacaaaaatttcttagaattgaaaagatgacaaatgctgatttatgcagaactcgggacttcattgatagagcactgtcacttactacttccatcagcaggaatggttccttttaacatcagattgggtgtttacatggatgacaattagggctggtgaaatagttcaaataaaagaagaaccagaccggcatggggagtgaacctagttagttcccaagtattaaatacctgtcttccctcccttgtctctctcctcttcccttcctttctccactttgtttctcacttcactccctttccagactgttcttccctgtcagggaaggctgaacagagattgaaccacacaatacattgagattctgcagcagagaagacattcaaatcctgaaatactgtagtgggatctggttttcaaatgtttcttccccgggaaagtgaaacattccttgcagtcttataaaataagtatgttcgttgatatttcaagcaggagaaattcattttaagaagttggagtatttatatgtgacaggatagtagttcctctttctctcccccgtccctccctccctctctccttcctcccgtcctctcttccttcctccctccctttctctctcctctttgattttattttttaatcagaaagttctttttaaaggaagagaaatatcaacattgtacattctaacattccaaatgcttcatatagttccttgttttattgctttaaacattttttcaacagatacttaaggacatttttcaggagttgtgcaaggcatgaacacctggagatacgtaagctacagtggtgaacatggaggtgtccacagtaagcgggagagaggcaggtactctgcagtaagagacgggtgttaaagaaagataaattatctcaataactctggaatgacatcaaccccacttagaattaaaggaacagaagtctttgtgataaatattctctcagtctttccctctctgtgtgtgtataatatttttgttaatacacagatggtaatctaatgagatgcatttattcctcctgatatttgtaagtacagtgtatcttttcattgtattaactgttgttctacatctgtttggatccattctgtggattcaaaatcatgtagatcaccagtctctaatggttggacatttaggatttatctggtttctcatctgagtgtttattagatgactattggatttccttagacatattcttggaaatagaattgctatatcaaaaattatggaaaatctgaagctattgatatacctaatgctagatgacacattggtgggtgcagcgcaccagcatggcacatgtatacatatgtaactaacctgcacaatgtgcacatgtaccctaaaacttagagtataatataaaaaaaagaaaaaaaaaaaaaaaaaaatctgaagctattgatagtcttatttttaattgctctaaaataagtattaatttcttagaaagaattatttatttaaattaagatatttatgcagatgaaatacccaaatattctggtttgctgtttatttttatcccataactcaacgggtatttatataattaattatacttttcaagtttttcacccctatgttctacatatattgctacccatgtactccatactctattcttttatgcttctttgaattctgtaatttaaaaaatcaaagcaaactaaaaacaaaacaattcagctcaaataacattttttcctaaaaacctaagtctcccagcttctttgaactcctccttctatggactcttacagtcctcctctagcctatttatctcatttgttaattagctagctagcttttatgctatgttttattattagaatcctgtttcttttagtagattgcaaactactcagagccagagaccatgccttgtgttatttgtgtacacagctagcagagcaccttacacatcataggaatgggatctattttagtgattaatctgttctgtttttatttcagcagggtttgtggaagggcatggccaagttgatggtgatcatatgccttcaaatatcatgttgacaattatcacgttgatatggaaggaagggagactggcttactaaaaaagcattctagttgtctagattggaaaaaaatgcatttagtctttcaactgtctagcacctagtaggcagtcagtaaatagaagcttaaaaaaaaaaaattaggccgggcgcagtggctcacgcctgtaatcccagcactttgggaggccaagatgggcagatcacgaggtcaggagataagagaacatcctggccaacatggtgaaacccagtctctactaaaaatacaaaaaaaattagctgggcatggtggcacgtgcctgtagtcccagctacttgggaagctgaggcaggagaattgcttgaacctgggaggcagaggttgcggtgagccaggatcacgccactgcactccagcctggtgacaaagcaagactctgtctcaaaaataaataaataaataaataaataaataaataaataaataaataaataaaaattaaaaagggctcaaaagtccttttaaataagtatttcaatttaaataaatttattaacttctttttactccatttccttgtctaggaaaggtggatcagactcattcattataaagaactctttctgattgaaaacatttagttaactctctctggtcatgggcattcacatattggagacagaagcagaaccagttgtgtaaacactgaccaatgtgttcaatgtagttttaaggaaataaaatattttttatttatggataagtcttgatactaaaatgctaaaaacttttcagttagctggctggcacatatctctcagcagtaatactgctgtaggtaaagttggcgtgctacttcctttttcatcaggtacagtagctcagtttagacatcatatgtaaatggagaaaggtactgggaaagcctattaacaaaaaggattagtaggaattttaaaaattaactgtgaaaaaaattctttctgctctaagacatcatctctgcagaaaagatatttggtaaaggaataattggttcagattttctcccctagtatctttactatctgccctgaatttccctctttactcttcagaagagagggtcagttccatcaccaacccggatacaaagattctcatttcccgttaggtcatagcatttagaataatgtttattttggtatttttaaatattttgtggttttatgaggaaccaatacatgtggtcaagcattcccttattaagggaaataaagctcaagctcagaacagatggagaaacttgtccatacatttgcatgtgacgtgtggtgtagaccagaagtttaaagaatattatattccaatgacacatataaagcacctgcaattgacagagaacgtaaatggtattttttaaaggctagaagttcatagactccttccattcatgtctgacatcagcaagctcttaataatgcagtgtgtacttatctattgatcagaccatttaagtagtaagacatgagaaagtagacactattgtctggtaattgaccatattggagagttaagtgttctgacaaggaactaagtgtatttaaccttcagataagatcaattttaagataatgcctactttagtaatgaaccaaagctgttaagaaaactttgttcttctaaagcagtgctgttttgatgacaactatcatagttttaatgaccagatttgttcctgaccagattggtcttccagggcaacctggaaaggagttactaacattcatcctttacttaccataaaagctcaaatggaaagagacggtgggaagcagcactgcccaaagagccactgattggtttaggagacatcttttgggtacctaccataagccagtcatcatgctatattgtagggcttccaagtttagtaacatatctgacttcaagaaacttatgtttcagtaaaatggttttccagttgtattttatatgttaaatctctaaaaccaaagcttatgttagtccttcatttattaaagagagagagagaggaagttctcctatatttgcctctgagtcttttccctgtgacctaattgaacaccacttgaaacctccttctcttagagacagatccataagcaaataacacattataagttatataatacaaacatgaacaaaattgacaagagaacacaaagaaggacgtagctaaagcggctctgcatttaggaaaggcttcctagaggaagcaatgttgaactcttgtctcgttggatgagtaaagctccccagagagagagaaagtggaggcagtgtgagcaaagcaggtgaaggctgtggtatgtttgtggaagtaggtagccctacttatatgtctggaatagaggcttttgaaaagaaatagtgagagataaaacaggaaagtagattaggccccaaatcctccagaggtttttaagcagaagactaaaaatcagatttggatatcagtgaggtgatgctgataaactcggggaaatcacaggagctttttaagaagagagttgatattcacctagggcagcagtagtgacatttgagaagaaggaatgttccaaaggtattttagaggtgatagtggatagattaagtgactgaccaaatgtggagaacggagaaacaaaagaggagaggaggtaagggtaattctgagacacctaaccccaaagactgcatgggagagtatgtccaatacagggggaggattgagttgaagatgagaataaggaagaatcagttcattttggagatgttgagtttgaggtacctgtggaacatccaagtggagaactttggctaacaaagtttgggtcctgaagataaaggttaggattagaaatactgatttatgggctgggcatggtggctcacagctgtaattccagcactctgggtggctgagatgggcagatcacttaaggccaggagttttagaccagcctcaccaacatttgcgaaaccccgtctctactaaaagtataaaaattagccgggtgtggtctactcaggggctgaggcacgagaatcacttgcaccaggtggcgcaggttgcagtgagccaagatggtgccactgctctccagcctgggtaacagagcgagagtctgtctcaaaaaacaaaaaggccaggcacggtggctcatgcctgtgatcccagcactttggaaggccaaggtgagtggatcacgaggtcaggagatcgagaccatcctagttaacacggtgaaaccccatctctactaaaaatacaaaaaattagcccggcatggtgatgggcgcttgtagtcccaactacttgggaggctaaggcaggagaatggcgtgaacccatgaggcggagcttgcagtgagctgagaacgtgccacagcactccagcctgggagacagagcgagactctgtctcaaaaaaaaaaaaaattgtaaaaaataataataataataatactgatttatgaaatcactgatgaagaacgtagttttgggaatgttcactaatgatggctagaagaggaatattcatcaaaggaagcagtcagaggtattatttgatatctaggaagcagtagttttgcaaaagaagagagttctcagaaagtgcaaatagcaatatctgataccattgggagaacagaaagatatgaatcttctgaagaccactggctttgctagctattatagaaggccactgacctttagcaacaactttttcaggagaatgatgagagtagagactgggttagaatcattcgaaaagaatgaaataaagaaatggagacaatgaatgtgtgtattcagtgtttagggtgatgagaaatggagaactctggctgaaaagagaagcaaagtggagtgggtgtgtgtatgagagtgagttgaatatgtatataggctagggatacctgtatgtctctgggatagtaaggggtttggaatcacactcgtggaagatcaaacctctggcctactatttaatagatatggaccttgatcaagttcttctgtgagcctcaagttccttatgtataaaatgagattagtactacctacctcttggagttctttaaggatttaatgaaattatgacatagaaaacacctagaactcagaaggcactcagtaagtattagtaggattttttgtttgttcattcttgtgaggaagggagatattaaaggtgcaagagagggaaaggatgatgcctatgatgtcagagaaaagagatgagtagacatgggatttgagtagaggtagaggagtagtttcaaagtgagattggacctattttcctgggtaatagaagggaaggacagtgataaaatgaggcattgggcaggataatttaggttatgttgcagtaacaagtagccctaactctaagtctgttaatgcaacagaggttctctattcatactgtatggccaacattaattaggaagggtttctgttttatctctgcccctcagagacccagcctgatgggagctccatctcggtatttgcctctgcagtcatcatagagcagtcacatggctacctctgacctcaggaggccaagaaagtgcctggaattggggaagcacaggaaatatttggtgatcagtgctcaagaccagaacaatgagtagagctataggtataagtaaatagggaagggatggcagtggcttctctttttcccaatgaaggaggcagcaaaaatatgatccaccaagagcagcgtgaggggtcttacaagagtggtaaatgtttggaacagctgtttgttaaaataattaaacgggaacatagcagcaaaggaaaaggaagttgttctggttaaatatttatcattagggctccatgcagaatgaaatggtaatatagctgtgattcagtttcttagttcagcttaaaattagaagctgcccatcaataattttcccaagagagcgatttctactgtaacagcacatagcctagagaaaaggaaacgcacaaagaacaggctttcttggaatgggaagagaaaccattgcagggagagaatatgagagagaaattgattgtacatctatccctggaaataaaagtgagttcccttttatcagtcattctgtaaatacatctgctgctggcctagcactttggcactaggtgtaatcgagagaagtttaggactttattcatgttctcagagaatgtgttgtttggtcagtggggcaaaaaagctcatgccatgagtttgagggttgtttcatatatgtcttttattgccctaattgctataatttttggggaagagtttcatggaacagatgagattaaaccgaggccttgaagaatagattaaccttggagggtgtcaaaggaaggaaaggagggcaccagagtgatggtatcattcaagggccaatggtgggagtgaaaatggtttctaggggaggcaagaaggagagtggccagaaagaagaggagatgattagatcaagaaattatgggacatcaggttgaactgacaggttgcaaccttattataaggagttggtacaatatggaaggaaagcaggaattagttgttgcatgagagaatggcattgtgacaaggtacacttggtcagttgggaagaacataatgagaaggattagttaaaagacttcataataatccaggtatcttctcctcatctactccccatacgacttgaatgacttcctgttaccttcagaataaagtcccagtctttagtcctgcttgcccatccccattttgaagagactaccagatatgcaaagggtactagaatgaggaagactcggatatgttggaaccaggagccagaccatggatgtacaattagattccaacaatgctatcaacaggcaacatttaggagtgcagcctagcaccttgcaagggctgtgaccaagtcagacataaccctgccctagtaggatgttggaggttaggtgggctttccaacacaggcatcaaaggagaaacctctttattatttttttaaacagctttattgagttatagttcacataccacacaactcacccacttaaggtatacacttccatgttttttaataaatgcacagagttgtgcattcatcaccataatcaattttagaatcaatttcatgacccaaaaaagaaaccctgcactccctatccatacctccttccttgcccattccactgccccagctctcagccctaggtaaccaaccctctatttttcatctctatagatttgcctattctgggcatttcatacaaatggaatcatacaatatatggtccttgtggctgatttctttcacttatttttcactggttttaaaggtttatccatgttgtagtatatgtcagtacttcatctctttacattgcctcataatattacattacattgatacaccacattttgtttatccattcattaattgatagacattgggattgttgctactttttggctgtgatgaaaaatgctgttacaaacattcatgtgtaagttttttgtggatatgttttcatttctcttagacatatacacatcttatagtggaactgcagagtcactatcatttaaccatttgagtaattgccagaccatttgctacagtgcccgcattttacatttccatcagcagtgtatgagtgttctagtttctccatatccttgctaacacttgttgtctttttttttttattatagccattattctagtgggtgtgaagttgtatctcattgtggttttagtctgcatttccatgatcagaagttgtattttcaaaactaaggcataagtgaaagcatgtttgagggctttgacagaagactgagaaataaatattaagagattgatatggataggaggatttcaagcagttaaaggctaagaaggaattggacgcagccttttatagtatgcccagtccgtggtgttgccatgttccatggaaatgaataaccagaggttgctattctcattctaaccattctcagtccttggcaacacgaagttaggttcacctgaaaaataattttaaatataccagcgttcaggccctatccttggccaactgaataagaatgtttggggatatagcccaggtatctgtagtttttaaaatctcctcacatgattctgatgcacagtgagggttgaaagacaccattgtaaataattcagcaggattaaataatagaatgaatgtattgattgcatgcactgatcagataaccatctgcctttattttgacctgtaagcttttctgagacacctgctaactgaatttgatcaaacagatgtaagacataattgcagtgtgcagtcttctccaactaatgatagaggaaaacctagcgtgtggttcataaaatcaattaactatttctccccaattaaaccccgaatttaaaagttttgtcacagagttgagttccttcatttttttcccatttatattggctacacatgaggcatttgtttatttcaatgatttcaatctctttgagttcaacatacagtgatgcttttcaaggtaatgaattagttcattgattagtttatctattataagacagtaaattgatgtaatgagtcactgatagatatcctagtggttggctcatagatacaagcattttttatggttgtgttgatttgaacacgtgccatttctatgcaaaccttgacctttgtaattgacctgatgtgtacagatgacagcaaatagatcaatcagggtgatgtctcattaccatatggccagtgatttctctaggactaaagtatgttttttctctttagggattgagggccatttttgtcttctgttaaaattctaggtctagtcacaaaactggaaaggatgggaactaaagtgcaatactcttctgctagtttggcaccaagtttccaatgctgaaaagaatgattttccattgtccagactcttctttagaggggtcctatgtccccaacttaaaatttgagctacacagtttcagaaaatgaaaactgatattccagaaagaagaggtagataatgcagaaatgtcagtaattcaacatgttctgatgccaacctggccagagatggctttggtttcattgtagattgagatttcttatagaaggtttaaaatgcagggaaggtcaagttgagttttgtagaggaagatatcctagtacttttttagggaacccgtatttttgtcttaatggaactgctaaaaagatgtgcagtaatccaggccttctcttcctctcaaaaacaaactaggcactggttgtatttagtctcacattcgtttaatctagagtaaatggaagcctggcatatagatcattgatgtaaagagtatcatggaagaaattgaaatggaaacaaacagtagggggaagacctgtctggtagcacatcctctccatctggctagccgtcagatttcctggccatttctcattgtacacttcatctttgcttgcttcttacttcctttctttcttttttttttttttaaaatacaagtattttaaactgcaacctggaaagaaaacgagaggtatataacacatccttaaaaacaaagaggaaaaaaaaatcaaccctgttaataacttccactttgagagtttgggctggttgcaaggcccaggggactaatctgctgaatgtgggaggatatggagccatttgtcctaggagaagcactacattaaaaagaagaggaagaagtcatgggggaagggcgagggtctgctgatgaaagtagctgtcaaattagcaggtctggaagttgtagtgcatattgttatgagctgctcaagttcacaccagagcaaccagctccatccatctttctcagtttacattttaattggcttgtagttaagttttttaaacactgcgagattgctgacatacactgcaatatcacgtgaataatttatggaggttgctcaagacaagcttttttttttttttatgtgagaaaccaggggggagtgggggaagaaggatgagagggtctgtgggaggggccaggacagaagagcagacacaactgcatgtgctgtgctggatgttaaatgtttctgctggtgtaggcagcagcatttgggatttcagggaggtttgtacaatacgatcttattaataacaattctgtcaagagagcacccgattaaattgaattgggtttatgactccctcttggtttctgaaaatgtgtggatataaaacctctgcgatgtgaatattggataacaagggtaggtttctttatttatttatttttttggttggttttaatcattcctcctactactgagaatttgcttgtttataaatgcaggggtaggcatttttcccaaactatctttctgttttctgctctcaaaataatctagagaagatggaactggcatcagtgggcagttatcctaagaacgtgactgcttctaggcatggtttgctggacaactctgagtctagaatatcatctaattaacacctgtgggacaatcctcttcatctgctaaaatatactttttttctcattacaaaatgagtaaattatataaaatgtctagagtacaaagaggagaataaaaataacctgtaagtcctccccctgctaataaaattggtatggtttttgtttatatccttctagtcttttttctgttcatatttagtgaacataatttagtgaatcgtatatactgtttagaagtcatcttttttttttcactaaacattacatcacaagcatattcccatgaatggtctatacggaatgtcatttctaatgattgtagtgtgtatgtgtgaattaactatactttatataacctatctcctgcaactaaaatgcagtgttagtttataatttttatccattttagacaggcaagttataaatatattttttggtcaaatttcagtatacattcttgatcatttctttaggaaagctctgagaagtagaatttctacaagaagcagagtgagtctgagggaaaaaatcattaatgtctcaagaattttgtctcgaaaagagggataaagcacattttaaattaatgaaattaacagtttattctatttaaaaagaaaaatgatgataacattcaacatgaggttcttttaaattattgaattttttgccttgtggggtttcttaaccacaaaacctatctattaggattaatggaggctattttttctttaccaattgctatataactacttaagacttcatgtaatcagctgagatgctacaaatgtattgcctgtcaactccagtaaaaaagcgggcagttaattaaagggatgtcttgctgttaaacaaacttgcagtcaattgcttgtaagtaacatttagtttgatatgtagtcaaagggcaggaaaataagtgtttaggcaggactggctttttgcaacgtaaaaagagaagtgattatattggggtcaagatgagtaacctttcaactggcatattttccttctaaaaagtatattcacatatcagaagaaaggtgaaagacatataaggccttaaggttggtcagtttgagatcttttccacttacagtaactaagtcctcatcttcttgcatcccttgaagacactgttttaccctaatataaagcctggctttgaggtcagtgtgtgtgtgtttggacatgtgcgtgcacacagaccgtaagtagatgaggcaagaactccctaaaccaagtgccatactctgcagatgggaaactgccatccatagacccagtagaaaggctgcagtagcacagcagcacttgggacagctgctccaactcaggcccattacctgctcctcctaggagtgccccgatgctccctgcacctttgttcagctcttccttgataatccaggataggatcgcacagtttctggttggtgagcttgtagtcagaagcccttttcaagcttaacactttcagagggagggtttatccaaaagacaccatactgattcaatatgttaaatgttgaaatgcttgtgaaacaacgcatatatgatagagatttttttctatctcaaaatcacttggatatgagagaccagagctattagaagccccattgactttgctttgagattccattggaggtcattgaactttggagcctcactctgaagccaagaaatttcaactttgccagtaaccacattaaaatgtgtgtacctggcaatggtgaaccagcctcatttactggtttccattctttgtattggctattcattatttcatcaacaagaatttatttttttactgccaattttacgtccaactaggtagtatggaatgcaagagaaggtgtaagttatggccattcccctcatgggccttttaataaagcaaagtaaatatgtaatccacttacagtcagtcaagagcaatatttttatttgtaatgattccacattttagcttaagaaagtatttattattctgggaagaaaaacattggctgaattaatggcagattctgaatgggctttgagcaacatttggaatacaagtgtgtaaggtggggttggtgagatttgctttatttcctgaactgctatgaattagcaaattctaaaccagctgttttccaattacatacaataacttgtgcctacctaagtctgtctttctgccaagcttctacttgcaactcattttaaaacttattcctaaatacccccaaaccagtggaataatagtaggcatcaccttaaatcataatattttcacaagaacatgttcaatcttgaaataatggccaggttttagaaagtgggaggtgagaacggaggagtagtttgttttttgtcgttaaaaaaaaaaaaaagaagaagaagtgcttgaatgagcaagttgctcagatttctctgctgctttcttcccagatggccaaagggagagaacactttcactgaagaaagggataaatgaaaaggacacctctgtatccagttatttataggatgataattgatgatagggttggagttttaaaatgtttccgtgtgaacatcttgcagttcgctttacctgccttttctgtggtattaaacacattgcttaattcctattttcattttggattggcaaatttctttataaaaggtcagatagcacatattttagcctttttgaccacacaggtctctgacatatattctttgtttctctttttttttaaacaacactttaaaaatgcaaaaactcattttaatttacaggttgtataaaaatggactgtgggtgagatgtggccggcacaccgtagttggccagctcatgccttagagaaacatggggggatatcctgggtgggcatgagtatcagttaggtcagcaagatttccctcttactgctgcttgctttgttctcttctggtcactggccgtctcaggagctagtccctggagccctgctctcctgtgtgatgtaatggtgtgaaatggtgtttccagtggaaggcctgcaggggtaaatgctgtctctaattaacctgttcatttagtgctattatcctttatctcgaatgcagttctgctctgggaggataaggaaagtgcttaattatagtaacagtttcacattgtctttgtttgcatgatgaagtacaaaaagcccaggagatgaagctgtcagtcactaagtgtctttgggagcctcttggttttttgcatttaataatcatgctctgttattgcgtgttgttgaatgaaacctcaggtcacagtctttgtcaatgatctgacccaagacatctggcctatgtaagttatggctaatgtccacgaactggataatatcattggcaaattgtggcttcattgatgcctgtttatttgctttttgcctcaattagaatactttggattgttatttgtctttttactgtgttttctaactccctaattgcatgttaagtacctgtagtccagggaatgtgccccatgcttctttgaagcctaaagtcttttggaataccatcacaatatttttataggacttttttattaaccacaataaaaaatgtcctataaaaacattgcagagatcctcatactcaaactctgaggagccaaagtcagctgaatggtgtttgggtctcaaacaaacaaatataaatatatatatatatatatatatatatatatatatatatatatatatatagtgatatatatatcgcaataaaaatgttgtataaaatattgtaatggttaaaatggtaaaccatttatatatatttaaatagtttatatttaaactatttaaagccataaaatggcttaccattttaacaatttttaaatgtatagtttaatggcattaaatacattcgcattgtcgtacagccatcaccactgttcatctccggaacatttttcgtcttcccaaactgaaactccatgttcattaaacaataactctccattcttccttccccaaccctgccaaccagcattctacggtctgcctctatgaatttgactactctaggtatctcataaaagtagaaacaaatagtatttatccttttgtctggcttatttcgcttaggataatgtcttcttttttttttttttttgtgacagagtctcacttgtcgcccaggctggagtgcagtggcgcaatctcggctcactgcaagctccgcctcccgggttcatgccattctcctgcctcagcctcccaagtagctgggactacaagcgcccgccaccacggctggctaattttttttttttttgtatttttagtagagacggggtttcaccgtgttagccaatggtcttgatctcctgaccttgtgatccgcccatctcagcctcccaaagtgctggtattacaggcgtgagccaccgcgcccggccagcataatgtctttaaagttcatccatgttggcagcatgtgtcagaattgccttcctttttaaggctgaataatattccattgtatggatatgccacattttatctattcacttatgaatggacacttggttgctttcacattttctctattgtgaataatgctgctatgaacatgtctaagtcctgctttaatttcttttatgcatactcagaagtggctattgaaatatttttgcatctgccaatgtaacaacttttaagctctgtggaactttaaatattcttacggttctttcctatgttatctgcctatagtaaaataaattttataataaagaattcagttattagctatgatgcacaaaaagatctatgagaacaagcatgtattcatgctatgtaccaggcactgagattagctcttatgtgaattaatttacttaaggcccacagaatatgttatctgtgtgctacagaaaaggaaataaaggcttagagaggttgagaaacttgcttaagttcacacagctagtatgtggcagacagggttctacttcagagaccatgtttgtagataccatgaagccattcagaaaagtggattgcatctatattcctcattatattcccagcatggttagcagaaggcttatcattttccattgcatgatgtcacttttaaatttcaaaatcaaactacataaaataacatgtaaaattacttgaaagctttaaaagtgctatacatatgcagagtattaacagtaaatcctagtgatggacagatgttaaaagctataagtatatgattcagaaaccatctaagaattttaaactgtggtctaattattatggaagcttactggagcctatccttgtgatttgttagaacattgtttcatatgccattttattcgtatctcttccaattcttattaagactagcactgctgttatgaatttcatggctttttttttaagttgctggatataagccaggttatcatataatgccctttactacctgtagtcactttgggataggtactgtgccttcaaccatctttgaaatcctacaactcgtaggctaggtttagatgccaaatagctaaagagctatcatgttgaaaaactattattagggcgggcacggtggctcacgtctgtaatcccagcactttgggggagccgaggcaggtggatcacttgcagttaggagttcgagaccggcctggccaacatggtgaaaccccttctctattaaaagacacaaaaattagcagggcgtggtggtgtgcacctgtgatcccagtgactcagaaggctgaggtgggagaatcacttgaatctgggaagcagaggttgcagtgagctgagattgcacaactgcactccaccctgggtgacagagcgagcatccgtctcaaaaaaaaaaaaagaaagaaagaaaaactatcattagacttaatttgtgtcatttcagaggacagaattgaggccattctgtgtgtgtaggttctggaaggacacatttcagtgcagaataaaagatgtagttgtagcttggtagactggctgccttgaaaattagtaaactgtcaacagaaatattcaaatacaggctagaaaatcctctcaacaaggaagtaaaggggattcctacactaagagactgaatttattaatcttcagacttggtctattatgacatttacttgaagtgttctaagaacttcacctttaccattgtcttatgtggtattgttttcttcagcaaaagacaggagctaagaatttttggttggcttatttgctgtaccagaggcaaataactgtgctgtgttggaatgacttagaagtagaaaatatttcgatcaggtgcaaatcatggtcaggaagacaacaaggtcaactttttaaacccagattctccagggtgaggatgcatcatgtacaaaacatgactgacactaagcaaagagtctgaagtggtttgatcagtatatattgattatttgatttattgactttgctgcagtcttcttggagctcttcagcatccagtactataaaactcactttttcattgtaacatttgacttgagcaaggacttaggtatttggcacaaatgacattctctcctcttttctgattaatgtggctctgggatcaaacaaagttagtgcaaatactggaatatttgctcaaatagagaccaaaagggcttaaaattcagtgcaggtagaattgtttaagtatcagaagggcagactttggtaatttcagctgcatatgttggttcttatttcattttggtagaaattgagtactggagactgcctggaagccagcctccagcattgacgtctgacagtaaccgcaaaagcagtccccctttccgctggcagagccaggaccacgtccgtggctgtgatctcaggggagggctcccagtccacagcctgggcttatgactgggaagcctgcttcttgtaaggtggggaaaacagagccaaactgaccccacagaatttgaacttggagaaactgtcgaatccaaaggatccatcaaggccagggacaacgcctagtctgaactggcgaccatgggctttttcagagccaggtgtcagaaatgggtaaatatcaaattgtgtctgattaaaaacaggagggagcagagctccccttactcactgaggagccaaagtcagctgaatggtgtttggctccaaataattcaaaagccacagtctcatgacccaaccaaagaaatattcaaaactagcctgaaatagaacagcctgttttcagaaatatgctatcaaacacatttatctttggctaaaaaacgaattaagtagttttctcttaaaatggccagatatccattaacatagaagagtataggataaatacctcttatggagatggtcagattcatgatttcatttaagttaaaaatattggcaatgataccgtataaataatatttgctctcatccaacacttttggttgaattagtctattacctggggaaaacactgaaataggatgaaataatactaagaataacattagaattatatatttgaaaattactgattatatagctatttcaccaatgagatattcacaagataaagaagagggataatgatagcccaagtggacttcccaataatgcaatagtgaagaaatcaaaatccagccaacatggacatgtcttatatcttgattggaaggtagataacacagtacatacatttgtcaaaactcaaccaactgtacactttacagctgtgtgttttcctgtgtacaaactatacttcaaggaaaaagtcaaatcaacttatttatggagctacaatttatgagaaagtacaacattaagcaagccttgggagaaaaatttcccagcattcaggaaacttgcaaatcattcgttagccctagacacaaatgtaagaaaattttaataataaaaattaagtcaatgatgagggatttgaagattcttaatattgtggacctaaatggagcctctatgatcattaaccctccagttacaaatatggtaaaacagacattaagaaaattttagaaaattttccaaagaaaatcagagtcagaatttgactagatggcagaacgataagcttaaagctccttctcctttctcctttgtcacattgacttcctcctgctcctacctgctaaatattctcaagggtctgttttcagctctctttacctttatttttatattgcactcccgttgatcctttaatttcaaagttgttatttctttattcagtcagtaaacactttttgagtgtataccgtataccaagcactgttttataggtgggtgatacacagttaaaccagaaagactaaaagtcttcactcacagagcttactttctactaatgtctgtgtacctggaagccagatactgatttctggaacaagtattctcagcagtccagacaccattgccctacaacttcccttgcatatcacgacagtgtctcaagctcaacgtgtctgtaatctcctcttctctccaaatcatctcctcctatttcccccagcctgaagatcgtcattggctgtccttgttgaatctctaggtcaaccaatttgaaaaactctaaactcttccaaattgactttttcttagatcagttcagaatctccatgtttcctcacttctttgtaatgtccagtagctttctaactcatctctctactacaatccccaactctgatgtgtcctacacatcactgcctggctaattttcctaaagcacacctcctataccaactttttcccaaacacacacacacactctctcttgcttttcctttgatttcatctgcctttcaaattaaatggaaattcctctatctggcagtaaagactattgaaagcatggcgccaccctccctttcaaatctgacttctccactacaggtacctgtacctactccagctgaagtggatttttggctgctcctttggcaggccctagttctctaccactctgcctttgcccattgtgtttctatctggactcattatgcagctttgccccactccgtactcatcatcatcctctgtgtacaactcactcactgtcttttctaagactcctttctcattctgatcagcatgatttttccttcatttgagtgtagtcatcactcactgcattgcattatggtcattctcttccttttttattaaaacaacacgatggattttcataaaatgacacatccttattgaaaaaaagtatacagaagagtaatgaaagtaaaaaccacctgaagctgtatcacccagagatatctggttttgaacatccctctagatgtttctttgtgtgtatacacaatttatgaagtctatatatttttccagaactgagatcaaattctaccttttttcatgttgatatattctgatgctcttttaatgttgatcaatagaaaactaagctataatttgcagtggctgcaaggtatctcatcatttggctttaccataattttttgctttttgttgttgatttttttttttagcttgtgttcctcccagtagaagatgagaggaggaggtgcttagcatgtgttctgcccatgtgcttagcacagtcttgtaaaatgcaagtgagcagtctgtcatggtccttgacagggactgtttgtgacttatcactccatgcggtttgggacctgggaaaatgtttagagatcttgagaacaggttagagaggattgacctaaagtcccatagtaaaattttagcctttaaaaaaaacaattattactgctttgaacagccttatgcccccattgcctgtaagaaagccattcattatttcttgttacataatctgcagagagcttattcacttagaaagcagtgcattcatcatagcttctatcttatgagtagctaaaagcagaatctgttctgcatctttgaggcattcttcgcagcacagacctcatgctatcactaattagccagagcattcccagccaaaaatcccagtgcctgtccttgacaaaaaagtctgttttttccacagtaagggtgaaaagcctgcctctctgtctagggacatctccataagacaagcaaaaatagggtggtggtgagctctcagatcagccagcgcaatgaaacagactgcagcctcttaggagacttactgtttgctgcctccctttctctgcaaagtgggatctccattagacgatgcctttgtactctgacaaaatacctaaccaccatgagacaagccacttctgcattattctgtacattgttcctatccattccccatttttggcttcagaagtcatcccctagccaacttccagccacttgcattaatgatgaatgcgattagcagcctatgctagtccattagggaaaagaaagaaagaaagaaagaaaaaccatgagattgtttgcttgtcactgggaagtgaagcttgacgggaacatcctcactgtccctccccaccgcccctcctgccatgtgcctgtgatctgtgcgcatgtgctcatggttgcccgtgttccatggctctgccatttgctcagtggggggacgttttcttagctgagcagtgcaccactctgcctgagggattgagaacatattgcttggcaggtgggcctactcagacgcactgactgttgtttcagcactgacagggaacatacatcatgcaggcccattatgccagcataaatccatggtaacctgttcaaagggctgcaaccagcaaacaacgtgtttgggtcttaataggtgatatttttgaaacatataattgggatctgagaagtaattctggatgacaagccactccttctgccatcctaacagaagctgggcctacagcaaaataccactcctgtcatgctgcacaaagatgactgccattccagctcagctccaggctgctgtgcacggcgccaacggtgccaagagcttgtctgtgcagggaaaagagccctcaggtttgagggctttcctttgtgccttgttgctctggactgctggcaaaaggagctcctaggattgttgatagacaatgtcagagcctctttcttcagcctactattacaagtttgaaagggatctagagtttgtttggcgttgggtagtggacagataatcctcaaagcagagggttctgatcaaagctatctttcatatcccccactggcctccagtaggagaatgagatattaataaagtccttgaaccgagtgtgaaggggcttggtatcactagccttgctggctgcttccctacacagaagccagacatgtggtgccagcaccttggagatatagtgggtaaagtctggcacagccctggtcacaaaaaacactttttccctgcgtttctaggatgaggaggtgaatgattagtttacacgagtttccatccattggagtcatgatacagtttccttacaacacacttgctccatgactcatgttctgcattcctgttgtgcagactctcacaagatgcacctcaccgcacataatcatctgttgctttctgcttatccactaaactgttctccctaaagacaagtaccatactttatttgtacatagccaagtgctagtttcatgggagacacagaaggactgaagaaaggaagatgttcattcataaaaagaaaagccacaaggaggtcattgtggagttgttgacttttttatcttcttgatttctaagaatcataacatgggtatttcagtatgacttgccaattaaattacaactgggtggcaataatatattatttaactctcattctgccacacaattaaacaagtatcaacacaacccaatatgcatgctacacagcatctgcacttttctcttgctacaacagaagtagtttccttaaagcaaattagaaaatagtctcatgagaccaaggactttataaagtataaggaccaaggagggccaggtgtgcacctgcagtcccagctactttgggggctaaggtgggaagatcgcttgagcccaggagttggaggctgcagtgagcaatgctggcaccactgcactccagcctgggcaacactgtctctaaaaatagaaaataaaataaaattttccggaccaaagagaagactgttatgatgtgaacagtagcagtcaatatttagaaaagttgtgttcctggtagtctggcacagaatggtgattatgagagatatgggctgtatcacaccgcagcagtggcccagctaccactccaccagtttcaccactttcttgtttctactcaacagtatggttacttacaacacagagatttgccagcccaggtttcatagaaacatagacgttggtcctctgtccccagatattctagttataaggcctatacgggagcctgggattatactttgaaaatgcttttcaggtggcttagatgcagccagtctgtggactctggtttgggaagcactgattagaagcatacaatactgagaagcccagtagttccctcagtctttccactgccatgtgccctctatatgtcttccctgggccatctgtctaaaaatgcctgatgtcttagacagaggctctgaggagccttaagagctccttgcaagacataaaaccaagacgctttttggtatggaagggaaatatcatttagcacatctccatgtccatcatcagttctacttctgaaatattatttaaaaacacatttattgaaatacgattcacttatgaagttcatcctcataaagtatacaatttattgatttttggtatattgacagccatttagtaaattgtacaaccatcaccactatctaattctagaacattttcatcaactaaaaagaatccccaggctcattccctcctacccagaccctggcaatcactaatctactatctctgtggatttgcctattctgaacatttcatctctgaaatatcctaaagtgactgaacgtaagtccagttatatctgcaagtgtctctaaaaatgtttttttctaatattccattgggggttgctggttcttacatcttttatagtcagaaaggcttcacttatctctaacttttacctacattacccttctataacattaactcatattcccttgtcttctctgcctctctctcatcatttcaccaacactcaaattctttataaattcaaacatcattatcaagtcacctcccgacttttctgtaggatgaatgatctgaacagtcctatgccccttcccagatttacccaatatttcctcctatttcttcttatttaaataaccaagtgttcacccttttctctaaggtggatgccttcatttgtgccctcttttttattctctttctcctgttctagaacctggctttggactgcatcttcattttctttcttcaacctacagtaatactccacgttcacactttttaaaaaatacctctatcctgctgcctcctcaagctaccattctctttttctcattctcttcactgccaaaccttttgaaagcacagtttgctctctctgttggtgcttcttttccactcactcccacttcacttcttgcagccatgactctgctcccgttactttacagaaatgtctctccttgtagttcatggcatcaagcccagtacccttccctgaccccattccctgagacctctaggtaacctggagctcagttgactattcctccatcgtgaagcactctttttcctttggcttctctggcactccacattatccggctacttttggctccagtgtttagtgccttcccaaatatgggtgcccactcttttatctgtctattttctccctttccagcctcataacaccatctggctcctaactatgtggataacttccaaaactatcttcaccacttggatgtcctgccagctctttagactcattgctcaaaacagaactcaaaccctgacaggctttccgtctttcctaatgttggccataatgtgacccaaggttgcaaatttgacttttttctttctgtctctatcacctccttggttgccaagatgacaagccatcatgtatataatagcttttttattctattgaagctgtatttcttcatccatcgtctctacttctcaatgtcattgcccaggtccaggctttcattggctctcatttggactatcaccagaccattcgatctctgctcattccatcttctacgttacggccagatagcagtcctccttcaacacatatgtcatatccctaggcagcaatctttcaaattcttctaagcctactgaatacatcctaaacgccttatcctaaattacaaggccttctatattattttccattccttcatattctgtatgttctgtcctaagcaaagcactgatcattctttcacctccacaatttctcatttacaggacctttcttgtcctgtattcttttatctaaaatgatgtcctttatttctgccaacatgattctatgtgttgaaatcctctcatccttcaaattctttctcttccatgaaatcttagaacagtatttctctctcctttgattttccaaaattgtatgaggtggcgggggtgtggagggtaggaaaggacatttagcactttgtcttgtatttccattatttatgtgcttgtcttatccagtcccgccttggattttcattgttataactcctgtgactgctgataaagtatcttaaatatagtatatcctgaataaatgtttcttcagtgaatgaattttttaacttctataaaatatagaagatgtaaaaaactaaacttgtagatgacaggctttatgtcagtgtcaagagagttctcagtagtttccacactattattattttcagtcaatctaggtacaaggctgaggtgaaagaagcttgagagaattgtagcaaacctgccatcatcttcatattgtaatgcctttgcatttgcataatattttataccattataagatactttcacatcttatctgaccctctctatacttattttaggttagaaagagatagttatcctaatatccatttcataatgaggaaagtgtattctgggcagttttaatgacttaattaactaacgtcaggttattgattaggggcagacctggacaaggggacctgttggctgtctttaaatatttgaagaactatcatgtcaaagaaaattaaatctttttttttattctttatttcctcagaggactagaacaaacacaagtgaattcaaactcaatgaggagataaatagtttaactatcagatccacttcaagatgatattggctgcctctgttgttcaagaggagctcagggagagcaagctggccaaccaggtagaggacagtttgttggaaagagcctcccaaaaagtataggttaaccaagctcccttctaattttgcaattttgactttctttttaggtcagcactgtgttactaccctgcataatctaagttttgatttctgtcttttttttagaactcaaccttaagcaaatttagccacagtgtggtccaggtcctagattttttatgagatggccactccaccttatcctacctactccttgcaactgatattggaccacctacaggtgggaatctaaaagaatgtatttccacccaatccttcagtgcctagagctgccagcccaatggggaaaaaaaacacgaagttttcagaaaatctcacaggtgccatcatcacatgtagccggcccaatctggcaactccagaaacctgtctggtattatggccatggtaggcaagcctagtgttctctcagaatgccactctctcattctgttggaaggaggtgggtgactctaatgagctccaaacttttccttgaaatggggagttgcctaaaaaggcaactgcctccaaacagccaaatggaaattatgatatttcactgaactcagaaccaaatctgccttttttttttctttatagaaacattttatgtgccatgtgccttgggagccaaaaagaaatcatactttggctccctgttccactttgctaagctcagatactgtaaataccctcctctcctctcataacgttaaatttttcatgaattcatcataaaggagccactttgtagatttggctggtaccagtgaaagacttcattttctatttcacaggaacttttcagtgcaaaaaaaattacgggtgcaatgttgaaagactagaattattcatcaagtcttcactgcctgcaaatgaagagaatttttctaaagcctatctgggagaatgcagacacagacatgcatattttagatggtgcttcatcttcaccgtagccaccttatctttctcagaagagtcaggagtaagagaggatatgtgctttcttattgttttgtggattcattcaagagttcacaacagctcacacatttcccccttaccttccagtgtacctggaactcaccaatgcaccgaagaagagaatatttccttgaattacgcattgatagaagtaccaatagctttgtatgataaaatgcagtggttctcagactttgacatgcatccgaatcctctggtgggcttattcaaacacatgcaaggcctcatgccaagattttctgattcagtagatgtgggttgaggcccgggaatgtgtctttttagaaaggtgatggtgctaatgctgcctgtacaaggacaacactctgaggaacactaacataatgaaaagaatttagaaatcaggaaaccttggttttagtcctgagtcatctaccaatgatggatctgtggccaagtccctgggcctcaagagtagtgactcctgcactatgtgaactagtgttactttgagaataaaacctgagggtgtgcaaaagaacactcagcactcagggctctagagggacttgaaatgttataattacaggcatgaggagagttgaaggaaaacaaatggaagaagttttaagatgcattcattctgtcaagtccaagcagagaatggccggcactcaactgctatgctaagaaggggccagcgaagatgggaagagttaggtagttcccccattctgtgacctggctctgaaaaagtcagatactctgctttattcatgttctatatgatatagccaggccgtgttagagcagtggtcctcaaactttcctgtgattcagaattaacctgggacattaggtaaatacacaaaggcccaagctctttcctacttcaaggagcctgggccttggggtgattctgatacactccaaagtttgagaatgaccgaatctgtgctgataactgtaaaaccatatcctgataacctgtgaaggaactgaatgccctagacagttttctcagccttgtctgcacattggaatcccctgcagagcttttaaatcccacacgtacaggccaccatccagtcctgttgtatctgaatctctgggggtgaggccctggtatcagtaccttcttacagcgcctcagtaattcacatttgcagccaaggctgagaagcaagcactgatttagaaagagtcccctgtcactgtcctcagcaaatatgttttgtttgtgttttgttggcttgtctctttcccatatcatgtggtgagaatattgaggccatttctttgtgcccagaaaccaacacagtgcctcactctgtgttttagatgctcagaacatgttggttatttgaatgaatatttcaaggtatttgaatgttgaattaatgaatatgcaaataaaatacaacaaaactcaccgcagaagtcccctacattgaactgttttgtgtaagcacaacccgttgtggagttcaggccctcacaataagagagtatttattgaataatttgcagaatcacaatcacggagtatctgttgaataatctgtaaaactgttatcaaccccaactataacttactcttccaggtgagatgaggagtcggggaaacatttgcctggcagagtgttaagaatgctaaaaaataataacaataaaaataaaaaaataaaaagcagcaaattaagacatatttgacacctactacgtggcatacattttcatttgttctcactgaatcttcacagcaaacttgcattctctctgtttttttctgagggaagaaatggcaaaagcaaatcgcctgtgttgggaagcacaggggagtttgttggaccccagagcttgagttcttttccagtatttattttgctgccattcagagcttccctagccacccctgctgcttccctgacctgctcctgcatggctcaccaatggatcctagtcacaccagcccccacagagtgcttcctgacttctccagtgaagtttcccccgggaaattctcactggcccatgatttgattgcctgaccaccttcaaaacgggttagataactcatagtatgctatgctaaccatgttaaaaagcttattctcatagctttgcaatggcttctttgtatgactgttcctcgccctagacagaaggcttcttgagggcaagaatggtttcttgcctatctttatattccctttgcctagtgtacttcctagcccattggagagactcagttttttctaaggaatgaatgacagcagaaactcatccatgatgagcaaggacctcctgaaacatttcagcatgtgtgcatgtgttgtgcttcagaatattttagaaacattttccagatttaattgaggcttctgggaagccttgctgtgttcttccttgcaaaaaatagaaggtcgttaccaggaagtctcagtgtaccatatttatctggtgagttttgaaaatactgagtaatgggactaatgactcaacatagtattttccaaactgtgaggtaatctttggactttgcaagattattatattaagtgtactttttagtctgtcagtaaaaaataaaaagcctgtattttcacattagaattcaaagaacatctgctgcgtattgtaaataacatattttgaaaaccaactgatgcatactcagcctgcctccgcttgctaactatagcaggtccttaagataagattcagtttgccattggtaccgctcttgctttgacattccactgtttggtgaaccaccgttttccagaaatctttagacaccattcaaccctctaaacaaactgagtacagtgaggttttcagcttcctgttttctagtgggattagaaagggaccctattcctagatgatgatgtgtttttcaaggagttaaacttagagaggttttctactggggccatttcttacccccaaggacatgcatcctctggctggaagctcagctcttactgccttgcagagagccaccagttgccacaggcaaccgactgctcccgacaggaagggtagtattgattttgctggtctgcctgtaggggagcgggccaaagaggaatgctcagaggggctcctctgtctggggtgtgcatttgcacagcagccccattcatgtcctccagcctgtatctcacctcctcgggagactgaaaaactcaatcagcttttcccttgttccttctcagtttgtcttgttagcactctttcttagcaagtaagcaccatatgtcttctatgggaacttgttttcaggagattcccagcgcatgtgtgctggctgggaagagaggaattggtgttttactaaccagcagcgcttgccagagtgcccgcttttgagtcctgcccttcctgctcatctgccccatggtctagtttgtcctggacacagtatttcactggatcttactggggtcgcagaaaattgcctggcttgtgagggatttttctgaaccaaagagagagcctgtgtggatgcctctctgtggttcctcattatcctgggtagtctgtgtctcacaagcacctgttcattgatctggtcctctgtccttgcgaagacgatagcacatactgattataggggctctatgtgatgttattgggcttccttgctcttagccagccacccatgccaaagcatgcagctgatatgttctgcttttgaaataatttggtttctgtaacacgaagcccaccacccccctttcaacctttaatacctgtcttctttgaaagccagcttgttgagcatccaatttgtctcttttcttcttcactttcccccagtttccttgcactcaggctgtcttttatcaaaaacagagagtgagccaatgacacctcatggcaagcagcagcatgaagcattttcttctttcaccttgacatcttttcggcaaagaaaaagcaagggttgggaacctgctctattcactttggcttctacagctacctcttttaaaactgctggttgttattgcctggtagctgtctccctgaaggttttaccagttgttttggaaggctggctattttctattcccttgggaattcaccttacacagtcatagatgcatgtgttatgtgtatttgtgttcatatgctatcaattagtaatgaaaaatcaggccaagcctctttggtacttttttttcccctacagatgagtagtcagtgttcataataactgccaaaacttatcttgagtttcctgagtgccatggtctcatgtcattcttacaacaactttttgaagtagtccccattttacagatgagaacactgatgcttgacaggttatgcaccatagtggagctaagacttgaatgcaaagattctgccttgaaagcccaggctattcaaagattaactggattgcctgggcctgatacggtatctctcagtcactcatttgaactttgccaaccatagtcctaaatgcccaatgcttatccttggaaaggctagatatcagcaaacatgagatgagttgaaaataatctttgttctgaagttctaagggataagacgcattgctaccaacatatgtggcctattaaatgatgattctcagtggcacagaggagattgaccactgtggtggggaaggtggggcaaggactgagagagagtgggggacagttctgttatagcccaaggtgataaaggagttgtgataatcactggattgataatcactattctagaaccatagtgttcccctaatcataaaagctactattagccacgtgttgtggctcacgcctgtaatcccaatgctttgggaggccaaagtgagaggatcgcctgcagccaggagtttgagaccaacctggacaatataacaagaccctgtctcttaaaaaatgtaaataaataaataaatgtttaaaagccactagtaagtgaacacatactatatttctggcattgaactatatgctttcatttaatcattctcattaccctataagaagatactgttatctcattttttctctgtaaaatgagatttctctgtaaaatgattcttagtggcatagaggagattgaccactgtggtggggaaggtggggcaaggactgagagagagtgggggacagttctgttatagcctaaggtgacaaaggagttgtgataatcactggattgataatcactattctagaaccatagtgttcccctaatcataaaagctactattagccaggtgttgtggctcacacctgtaatcccaatgctttgggaggacaaggtgagaggatcgcctctcaccaagtttcagagaggttatcctggctcaaacttgccacatcttaagtgaaaaaaaacttagacttgaacccaaatgtgtttgtcttcaaagcctatgctctattctttcctaattatcagcgtctttttgcccattgtgatatttaatcagaatcattatcattaatagctcatccaactgataaaggaaggaaataaatgaattttgtatttgtggaccagagtatgtgattgagctgagtatgcaaagatttggtcccctggtctactggatgatcttttcacaagtgatctcagttagctgccatgtgcttaacataggttgaaagttagttgacagctttgcttcactgaggattgtttccagaattatcagtgcttagtgactttgaagataaacatggattacaggttcaaggagcctacgagagtcagaagagttgggaatgtgttcccaactctttaactagctgtacagatctgggaactgcacttaactctattcaacctcagcttttctatctgaacatcatgttaggtaattccaagatatgttttagctctgaatgataattgctgtttaccgtcaagcctgtttgttttacacatacagaaaaacactcttaacccatgaagtatgtagttaattgagaaagttaaaggaaaaagtcataaagaagaaaatatgctatctacacttaatttttaaaagcagctttattgtggtgtaattgacatatgataagctatgtatatttaaagtgtacaatttaataagttttgatcaaagtacccactcatgacaccatcaccacagtcaagataatgagcatcttcattcattactccacaggtccccatctcctttgtggtcccttcctcctgcccattcacccagcccctgccacatatacaaaaaaacaactgctaagctacctgatataccttctgtcactatggattactattcatgtttagagtattatataactgtaatcttatagcgtgtatacttttttgtgctctcacattctgtataattattttgagatttttttttttttttggaaacaaagtctctttctgtcacccaggctggagtacagtggcacgatctcagctcactgcaacctctacctcccgggttcaagccatccccctgcctcagtcttcagagtagctgggattacaggtgtataccaccacacccggctaatgtttgtatctttagtagagatggggttttgccatgttggccaggctgttctcgaattcctgacttcaagtgatccacccacctcagatgcccaaagtgttgggactacaggtgtgagccactgcacctggcctattttgagattcatctatatggctgcatgcattgaggccatttctttctttcgctgagtagtgtatggatataccataattatttaccttttcacctactgatggacgtctgggttgtttacaatttttggttattacaaataaagctgctgtgaacattcacatacaagtctttgtatggacatatatgtatttgaatcttaaggaagtatctaggagtagaatggctggaactggtaggtatatgtttaatgttttacaaaaatgtcaaactgttttccagagtggttgtaccgtcttacatttccaccaaccgtgtataagagttccacctcctcacatcttcaccaacactttgtatgtcttttcattttagccattcttttattatttttttttttttgagatggaattttgctattgttgcccaagctggagctcaatggcacgatctcggctcactgcaaccttcacctcccaggttcaagcgattcttctgcctcagcctcccgagtagctgggattacagaggtgtgccaccatgtctggctaattttttgtatttttagtagaaacagggtttcaccatgttagccagactggtctcgaactcctgacctcaggtgatccacctgcctcggcctcccaaagtgctgggattacaggcatgagccaccgagcccagcctcattttagccattctaatacacatgcactagtgtctacttgtggttttaatttttgtttttctaatgactactgatattgagcatattttcatgtgtttgttttccatatgtatatctttttgggtaaactttctatataaatcttttgcccatttttaacttaaattctttgttttcttattgtgagtttgagattatatatgaaaaaatattgtttaagaaataatctaaaataaaaataaatatattcttttatttatttacatatgtatacaactccttacatgtatgtacacacacacacacacacacacattctgcaaagatttgctcctagtttgtgggttcttttcatttacttaacagtatctttcaaggagtagaaatttttaattttgatgaagcccaattaattaatttattcttttatgtgttgtgtttttggtattatagttttgcctaactcaaggttaaaagattttctcctatgttttcttatagaagttgcacaattttagtgtttaaatttcagtctccaatttctgagttcatttttgtatatgatgtgagttcatttttgtatatgatgtgacttcaattttgtatatggtatgaggtatagattcaagtttgtttgtttgtttgcttatggatattaaagtgttcccgcactgcttattgaaaaggttatgcattctctactgcattgcctttgcacttttgttcaaattctgttgttcacatgtatgtgtttatttcctcaccctttactcagttccactgatgtaattttctgtctttatgccaataccacatcatttggttactacagctttatgatatgcttgaaatcagggaatgttagccttccaacttcttttccaaattgttttggttattgtaggtttatatatttccatatgaattttagaatcagcttgtcaacttgtatggaatctatagctcactctgaggagaattaataccttattgagtcaaaccatgaacaaagtattttttcatttatttagatcttctttcatttctcttagcaatattttgtattttttaatgcacaggtctttcacatattttttgtgtgatccctagttttttatattttttgatgttattgtaaatgataacatttttaaaatttaaatttttgattgttgctagtacagtttatttttgtatattgatgttatattaaattatgataaatgcacatactattatagttctagtagcttttttatagattctctttgatctttctacatagatagttattatgcctgcaaataaagacagtttaactcttccttttcaatctggattactatctcttttccttgttgattcacttttagaacctccaaaacaatatttaatagaggtgagagtggatatttctgttcttagggcaaaagcattcagttgttcaccataagtatgatgtttcctttgggattttcatatatagccattttccgtttgaaaaagttcttttctaatcctggttttctgattttatcaggaatgaatgtttgatttttgtgtgtgttttttgatgctttttctgcaactatgaagaaaatcatatggtctttcttttttttttttttttttctttttgagacagggtcttgctctgccacccaggctggaatgcagtggtgcgatcatagctcactgcctccttgaactcctgggctcaagtgattctcctacctcagcctctcaaatagttgggaccacaggcatgcaccactatgcctggctgatttttttttctttttttgtaggaacaggttctccctaggttgcccaggctggtctcaaacccctggattcaagcgatcctcctaccttagcttctcaaagtgctgggattataggcatgagccaccacacccagccaggtcttccttttttagtgtgtgactatggtgaattatattcatagatttccaatattacgccattctatgtacattgtacatacattgctaaggtctttttttttgcttatgggtttgctttttagagctctgtatcatctttcttatataaattctcatccataatgcattctctacattctcagtttcagtttaagtggaggcagatcttggacacttgtcaagttttcaagtcctctaggtttaagatttgttttgttttgccagtcttttataatttccttgtccacacctaagtggatagcagtttatctttaagtttctcacctttagtgagtgtctaaaacactcttgtttggtttgagagaagcaacaattatatgtccatattcatagttcagcaatgaaggtaattattaattaaacgatataattgtaatacccagcacaactgggtaaaaaaataaaataaaataaaataaaataaaaataaataaaaacttgggatggattacagctgagtgttggtaagcatacagcccagtggaggagagcagaagtgtgtagactagagaatagccaactagactcagatttagtgtgcggtggtaagctattcagagagtggaaacaattagttactccagggaattacagaaatggaaactaatagagcttctgtaattctctttcattcctataaacagtattcccttccttcagcaaccagtgggcaaaggtccagaggtcaccttctatacgaggaacacaaactagtcagcactgaattatcctcacaattagaaaaacacctgtgaccaagtgtggatccttgcaatgggctttaactatacctgtagcaaatatatggaagaaccctggatttagagtcaagtgagcctgggtttgaatagcaatgactgtctctgtgttgttgagcagccttgggaaaattagtacctcagagggtcatctcaaggaataagtgatagaacatgtatgagacagacacagagttgtaggtatgccttgtgtgtggtttggatccttgttgcaagatgtttacactatctagagtggtgtgttctacccaaccatatgatcctcctgcccaaaaagttccctagctctagcctgtcgcaacatttgatgcaaatggagaaggaaggacattgaaggcagagaaaacagtttgaccgaggttaggtggcaaggaaggagaaagcatacatgggaagatgtgagcagtcaggattgggcacaaggttcatgctgaggtaggggggcagacaagctgaaaagtcgcctgatgtgcgaccatgccaagccgtgaagattggctggattctctcacctctcccctcacaccttatataggaggttggtaagcaaggagagtcactgaaacttttctttttaagggaacgccatggtgagagctgtgccagggattctcaaaccttgactgtatcagaatcacctgggagcttgttaaaaaatacatataccttgggccccacccagacttactcaatcctaatctataggtttgggtcaaggcatctgtatttttaacaagctccctaggcaattctaatgcacgccaaagttgagaaaccactgctttagaaggttaatctggcagcagcgtacaagatggattggagctgagagagcctggaggttcagagacctgcttgcaacaacaatcccggcaggagataatgaggttaggggctgtgggaatggaaaggaagaatcagatatgggaggtatttttgagaggcagtcagcaaggactgggcaacgaatttgatggggaatgtgagggagaaatgggacttaacaaataatgtcaaggtttagagaagctgctctccatggcatgaagggagaggtaacagaatcccctggggaccttagtcaaattgcacacacctgctcccctttctgtgctcatcctccacatcttcctccttccctgcaagttccctgagatgtgtgccaggatggggcatatcagctcctcctggggaagcctgcatgtgtagtttgagggggaaacttttccaggtgacacttctgttgcaagccacttgttaggcatctttgagcctgtgagaatagtggtgtggtgagattaggaggaaggagggaccaagctggagctgaccacaggacatgaaataacctttggaggctgtggaaatgtgagttcagagctgtggagcaagaagtgggctgtgatataaattcaaaaggccactgcatggaggtcatggtgaagacagatgagaccgtggagagtagagaggaaaggatccagaatgaagcttgaagaaggcctacggttaggagtcatatgcagatgaagggtcaaagaagagcaggctgcagaggtgggaggagactgcttctgcttcaaggccaaggcatgaggcagacatctagaaagatctgcaaacaggagggcagaactctagctcctctgccatccttccaccagcgtgattttgtgcaggaagcagtccagtcccccaggagtatgtggcacagtcatgtaaaggggttaacgctgtataggaccacacatttgaaaattttctttacaaaatccagtgtcttttgagctgatgtaccagagactgacaggctgtaacttcttacactattccccccaggtttctgatcaactcataaccttctatacacatttttggcccagcacagccaaatgtaaggtattaaaaatcattatagtgctttggggtccttgctccccgcaaagttccagacatgctgcctgtattttgtgatgtcacactgtgaaaataggatgttgtgttttggaggcacctccagggtgcccagcaattggcacatcttaagtgaaagaaaacaaattgagtgagcaacagtagaaaagaaggacatttgtatcaacccaggaaataaagaattacgcagagatgctatttatgctgctatgaagctgtgacttgatagggacagcataaaggttgcccactcctgacattggcaagacttcaggctgaccagagccactccactgaagtggggtcagctgtctcagaaggtgctctgtgaagctgacgcagaatcacagtttgctgtaaaaagggcttacacatgtaaaaccttgtattttgtcttagaagtatcctggaagctatcgcattttcttagtagagacacagaggcatcaagtaataaagaaacgattccaaggttccagactcctgggtagttgggcaggagactcaacctagagttctggtttgtagggtacagagagaaaggcttgcatgcgggaagagcacatttaagaatcacttggggatgggcgtgggttagattccagtctgttgcttcttaactgtgtgacctggggccattcatttgacctttctgagcttcagtctccaattgtaaagggcagaaaatcatatttacctcctgagagtagtttcaagaattaaggatgaaggcaccattacagcgcttggcatgaagttgatccccccaaatcgatgcccatcatcataattactgggtttttccccagtcgtctgaacactcatgtactcccctggatgcacgcaaagagacactgctgttttcctttggcatccctagtttggattttaaatgcttttttcctcattaaaataatgttatagctggaaggagcttaggtgcagttgaaataatactgttacgaaggtctgtccttcaaggcatttataaactgaatgggactttttgagtgggcctggacaccaggattttacgggaaaggtaccctagcccccttttttacaagtgaacttttattaagccaccagctctcagaacttgcagaattgctggaaaattgccttgggcagggtatgtaatcacaaaatgaataaaagacaacaggatgtgagtctttccaaagcatgggaatagcacactgcaacttcttgccatccctaccctgggcaaagatgcagctaaccagctacattgatacttggaattaagtcaggaggcttggccaggggcccccaccattccacaccttgggcctgactgccactctcagtacaggttgctaatttaaatgccatctcctggcactgcatgttgaaacaaactggaaaatagcagggcctttccttcatcagatcatcaatgtctgcctggcgtctgcctgcctactgtggccaacaacctgccttcctgtgagcatcctccaatgtacaaatacctcaaggactcctgacctctgggatttcatggctcctgtccattcttctctcattctcttagcaaaagaaattacttaagaatgggtgagggatggagacatctctcagctccctatggggtcttctttcctgaacaaactgagcagagccgcaaaagaatacataaggaaggcttggcagaatgttttgatacaaaattcattacaggtttgtttatgtgctgggcagtttgggtcctcttacacgtgtgtagacactgcattccttctggttcaagttttgtgtttagagagaggttttggaaggagatcaaagatgtcagattgctggcctaattcttaaaagaactgatttggggaaaggcttgaaaacattcatacccaggtttgaaaacaagaagtagcaatgagtccagaaagcttggtgacatggataacagtatatttttaagaaaaagagaatttgaatgtcttctgcacaccttatccgtccctaatctccatatcttccatatgtatttttcttgttttataacactgtctaagactcgagtgtaaaatccatcatccatcacccaaccctcacttttgagtgggcagagggtgttgtggaggtgactggaattcattggggtcatatctaagcatgagttaagagatctatctgggactttgtcttctttcatgttttttcttccttctttacagtacaccgtcaatagagattgctggcttgtcatccagtttcctaaatttcctgacttctgccttgtctggcctttattcctgtctatatctctctggcttcaaggtgataaaaatgctcacattttcttaggaaatattcagttgtattctctttgttgtgaaggctcctttgtccactccgtctcctccatttaggggaggttttcagggataattagtgaactcagagggatatgatgtaccttttcaaatcagggtctacttccagtttttcaggtttgttttaaagtgtgtggctcaggcatagagagcagcggttatttggacacctggagttacttggctttgctacccactaccttttaatgtgaagatacctcattgcattgctctgcatatgtgcagaggaaatttggggggaccctgttcacctttggcatatcttgatagttgtatgtgcctgcttgttgttgttgtatattgctacagcaatatggctcatcatctttctacctaagaagatacaggggaaaagaaaacactgccataatcaaaactacagaaatgggtttcataagcattttctctaactactgcgtctacccagatccaataggaatgggagggcattggcatcgttagaaaccggggcaaaagttcctgctgcaatataaaatctatagattacgcttggaatcagtggaaaccattgccctttatgccagctgcttcctgaaggagccaagaaaagtgtatagttcaggggaaatgcaaatataagctccctcctacctatagcaggaaattagaaacctctttggttagcacaaacagattatgatttttttgcaagagagaacaggagagaggaaagatacttgaggtggcattgtataccataaagctatatttatgtgctaagacaagcaattgatgttgttctataaaatatagtaaacacctcctccctgcccttttgaatgtcagtcagaattcagaatcatgaaattttatagtattactggttagaagggcttcccactgggagcagatgccatctctgtcttcatagactcagagaaagtcctgacatgtttcatggcgttcgtacgtggaagtctgtgaaatggaaaggaaaacagctttttctgtcaacctgtcactgatacaagcttttacattccatcagaatgactaaactttaaagctgttttcttcagtgctgagtatctctcagaactcccaagtgttatcagattgatagagtcccagcatatgatagaagaccaaagcattttgtggcatgatattaaaaattcattcaaatactcgataaagcgtggttgacaaaagtgtgaaatggaataaggtagagtgaatttcttcatggtttattgcccttgatttctctccacaaaataaatagacagaatggactaaaatctcttctttatgaaggtgggatcctggcagctgaaggcctgctcataaaaatcctctccgtgccacatacccttgcaatgttcaaagttggaagcaatggaaatttattgctgttatatgtattcatgtttcagactgagtgaataggtaggggatgcttttatgaggttgctgagaccctgtgaagaatagagaaataaaacacacttgtttttcccttgaagcttgtttttttctaggggggattggtgattttagtaattatagtggtattggcaattcatggtggtggtggcggcctggtggcagtcctccccctgaaggtatttaaaagaaaacactcttttcacggtctccccttcctgcctgccatcttgttttgaaagagaagcataaaatagcaaatctttaaagccactgcaagccaagcctgtgttttcatctgtctccctcccttgccaggcctccctctgcctttctgacctgccacccccttccttccttctgtccctccctcctctcagaggacatggggagtgagaggcttccccctgtttccctgcaatggtgggacagaatgcctcattggtttcagatattaacttctgtgctgaaaacccggttggagctggtgtgacaaatggattgtacctgctgctggaaaacacagccctgtcccacccgcctgcacacacaagccctcttccccatcttgcagagcccaacctagggagcagggaacagagagctgccccgcggcaccatctgtttctgccagcatctatgttgggccccgccggttacatctgttgagaagaacagtgtacttgatgagttgttggaaagaaatgtttagtctcccccatcatctctgttagccattacgaggctgctgggctcacgtgggtgtatctatgtgtgcttcctctcaggcctcatctgtatcaattggaaatcagtcactgggagttagttgcagtcagcagggacccaaggcatttcccagtgacatcaattcgtcttctcttgcagaaattcaggaaacaattaaaattctgatgcgttccagggaggatttcaaataaatcagccgatagctgatatcttgtaactcttggtagcaaagcaaaattaacaacccagccgcatctgtgtacagtatgctaaaataaagaaattaaccatgcatcacctccaatagaggaagcagctggcctgttctcaaccttcccataagtacccaaaacctactgatttgttaagttgtcattctccttatggacatcaaggacttcctgcatatgccaaaaactgagctggccaaataatcggtaagttgcggaaaatccaggcaccgattaagctcagttataactcccatgttatgcagaggaaagctgacattttgaggcggacccagttgatagctgctgaggaggtaatacaggatgcaagtaggtttggcagcaggtttagccagaattttgtcagaatttgaagattttggaatcataatcagatagccagtattttctctctcccctcaaaccaaatgcattgtgcaagaacttgtgttaattatccctgttaattacagtgataccacctcagcttttccaggctcttttttgcagctgtctttgtggtgatttcttgtcttaccacttgctgaccaatggaactcaccattcttgctaggttctcttaaaaagcagcataacaagaaccggtcgggagtatgttcccttgaaaaataaaaatctcagcatcacacccaagtaaaagccatgtgccttattgaagttctaagtctatagtgtgtttgtgtacatgcccgtcacataaagtgattgtttattagtttcagtggatttttttcctagaaagatgcataaaattttaaagtaaaaagaatatagtgagccaggtggggtggcccacacctgtaatcccagcactttgggaggctaaggtaggaggattgcttgagcccaggagttcaagaccgacctgggcaacaaaatgagacctcgtctctacagaaaagtcaaaaaatgggccgggcgtgatggctcatgcctgtaatcctagcactttgggaggccaaggcgggcggatcatggggtcaggagatcgagaccatcctggctaacacggtgaaaccccgtctctactaaaaatacaaaaaattagccaggcgtggtggcaggcgcctgtagtcccagctactcgggaggctgagataggagaatggcgtgaacccgggcggcagagcttgcagtgggccgagatcgcgccactgcactccagcctgggcgacagagcgagactccatctcaaaaaaaaaaaaaaaaaagtcagaaaatgagatgggaggatcgcttgagcccagggtgttgaggctacagtgaattgtaatcgcaccactgcactcccacctgggtgacagagcgagaccctgtggaaaaaaaaaaaaaagaatacagtggctggaaaacaaaacatcacttgaaaattttcccaccttttaaattcccagcactgggaaggaaggggtctggtatggtagtgatcgtagggtcagctcaggaaatggttcatagggtgagctcagtgagaatcacattaggatgagaggaaactcttaagcagaaccacagtggggacattcaagagtggtggagaatgaatgccattcctctgcctgtaagagggcacattatgagaaaggtcaaagaagtaaggaatggaggaagatagggaggtctaatcagggcagagagaacaggaaagggtccacttaaccccttaaaaacagcaactgttgtcacccatctagtgcttacagcacctggtgcattctgggtgctcagcatacaatccctgataatcatcacacttttgccgacaaagtacagccataaattacttcccccaccacctccccagtcagcagggagctgcttgctacaaatgagtgaaaatattcaggtactcttacacctagagatcatggagagaagtagttaggagctgtgtactattgagataggaagctcttccacacaccttgctgtgggcttcctttgcacgctgcactggttacatcagacatgctttgtgctctgcagccttcctatttaaacatttgccctcaaaaacttcacgacaagcatatgaattagcagtttttccaacctaaagagaattatctactgtctctagatgattctcaaaatatgctgatagcaatttgaagcattataaatctatccaggttggttctgaccatgttgtagaagtaatttcaactggcacgtcacatgaaggaacagatttgaaaacagtggtatgcatgcccctgaaggtttcatcttggctaatggtctcaccaccttatggcactactttggattgtgacaacggtaccaaagaaaatgtctatagtctggaaaagatttatcactaagtatgactgtctatcactctggatgtacccccttgttataaatctccagcaagactgatcacttggtatacgtaagcatgtaggtacatgcatgtacaagtcaggagtgtgctgtgtacttgtctagtatcacttggtgtattagtatatatatatatatgtgtgtgtgtgtatttatgtatgtataataactcatagcaaatgtgtggacatagatgagaatataggttattagtttggagaaagacttaccagtttgtggacattgtatatacagaaattctcaagatttctcacatgatgtgtgtgcatgtgggcttgtacatgtgtgtaggtgtgcattccgacagtgtcttccatgagcgatgtagggtattattgacttgaggaagcaatcactgcttacatgaggaggcgtgtcatcttgaccagcatttaatgggaggggaaagcctaactccgtaaaaacgcaactgttaaatcttaactgccttagcctttcattctgagctgagacgttatactaaaatttctaaagcagagacattgttatttttcacgtattatgctaataaaaatagtgactggtgtgacttagtgattggagaaaaggggcttaggactgtaaatattggtagactttcctttcggtacacctttataagttatccatttaatcttaaaggaaattcaaatgccaattcaactgggaaatcaaactctgatgcaggcaactcagggacctgttctctgacccacgcacttgaacagtgttcacagtgagaacagttgagtgcatttagaagctagatccacttcaagaagttagcagtaggaagcatttcttttcctgttggctgggatgtagaggggtgttagaactttttccctctacttttgcaagtatgttttagggaactttataattagcttttgtgcatattttaattatttttgcccatcatcaggtgggattaattttgactgagagcaacagtgtagtggttggtttgtctcatgtaaaaggaaggctgggcctaggctgcagctcagtgatgctactaggaactgaagcacttcctattactgctctacctcttccccatgtagaatgcagtcattacttatgttgcctcacagtcataagttgaacttcagatttcatatcttaaatctggaaagtacaaaaggctctgtcttaggagggtttgtcttttatttatttatttatttatttatttatttatttatttatttatttcaaacagagtctctatcgcccaggctggagtgcagcagtgcaatcacggctcactgcacccttgatcttctgggcttgattgagcctcccacatctgcctccagagtagctgaaactataggcatgcaccaccacacccggctaatttttgtatgctttgtagagacgggtttcgccatgtctctcaggctggtctgaaactcaggctcaagtgatccgccctcctcagcctccaaaagtgccaggattacaagcgtgagccactgcgcctggctgggtttacctttttattcaggtaaggacagtctcttctgggatttgtagcaatcattggccagaactatatcaaatagtcatcccctacatatgaaggaactaaggaaataaattattattattattattgttattattattattattattattatgtttgagatggagtttcactcttgtcacccaggctggagtgcagtggtgcgatcttggctcactgcaacctctgcctcccaggttcaagtgattttcctgcctcagcctcccaagtagctgggattataggcacccaccaccatgcctggctaattttttgtatttttagtagaaatggggtttcaccatgttgggcaggctggtctcgaactcctgacctcaggtgatccgcccgccttggcctcccagagtgctgggattacaggcacgagccaccgcacccagccagaaatcaattatttttaattaaacatatcactgccctgaaaaaaaaatgggattctccttaaaaaggaagaagggagacgtgtacctgtaaaagagcactgctggatgatatattcccctggcctctgaaaatgcacagtggtcaggccaaccggctcatttctattgcatgatatgcacaaatcaccattgaacttcaaaaaaatcctaaaagagcaagtctcaagacaggtaaatccacagccacaattactactaaatgagaacttttagtttggaaacaagcacctagagaatgccaaaaagtcaatgttcctgcagatactagaagggcacagcataggtaaacacactttatcaagtactgtgatactgggatgttgaagcttgcctggtcacatttaaaaaaaaaagtgtcattttaatcagaaaagttttaacataacatacagtcaacttataaaattcattacaccaaaaataatatagatactacatataattagagtcagatattttcacagtgttaatggatgattccaatcctcagtcaacagacagttattgggaacctactatgtgctcacagaccataggggaatatagactatctgaacagataactatgacaacatggcaggtactaaactgggatatgaacgaggtggttttgggaaacaggacaaaacagccaacgctgccaaggattgttgatgaaggagtttaaactctttccttttttttttccttttttcttttttttttttttttgagacagtcttgctctgtgagcgatctcagctcactgcacctccacctcgtgggttcaagcaattcttctgccttagcctcccaagtagctggtatcacaggcacccactaccatgcccagctaatttttgtactttcagtggagttgaggtttcaccatggtggccagactggtcttgaactcctgacctcaagtgatccacctgcctcggcctcccaaagtgctgggattacaggtgtgagccaccatgccccgccaaactctttcctttggtgtttatatcctagaagataaatttggccttcaacaaactatcccttgataaccttaccagaatacctgggagcagaccagggtagaagttcttatatagtcttatgttcttatttttagcttccaggaaattcaagtttgggaaagtaaagaatgcctggattgatactaagagaataagtgaactccaggtctcaaaattttgctaagtaaatccttgtcaaggatcttcgtagagcaaggaatctaagatgatttatgcatctgtagaataacaccataatgaagctgttaacctagccaaaagctttggtggacatgacaccttaaaggtggccattataaagtgagagcctctgacagctttttcatggttttagataagtgggtgtttgaaatcattctggcagctcaccaaatgtttctttgcatcttgactactggatgaatcttgactacaagtacagattttatgtatacttattaaaataatataatttggctgggcgcagtggatcacacttgtaatcccagcactttgggaggctgaggtgggtggatcatggggtcaggagttcaagaccagcctgaacaacatggtgaaaccctatctctactagaaatacaaaaattagctggccatgctggcgtgcgcctgtaatcccagctattcgggaggctgaggcgggagaatcgcttgaacccgggggtcagaggtcgcaggagccgagattgcaccactgcactgcagtctgggcgacagagtgagactccatcccaaaaaattaaaaaataataaataataatataatgtatgtcccagccaccccatgccctgtctggcactactgccagcactggggaactgggaggagagctgaggaacagctccccttgtaggctcctttgtcttcattgattgacatatccaaggagtcctgttcccagcagtggttccaatatgagcaaaagcaaatctttgctcatcttcaaatagccttgtgtatttaagtaaccagaatgttccacatttctgaaatgactatctcacctatctagaatataagttattctaggcaggtggcacctgtgtcttattcctctatcctaaaacagaggagggattcagtaaatgattgctgaaggggtctacattagagccaaaggtggtctgagcaatccagcctgttttagggacctgggtgaaaagtcctggggagtcagaagctctgtgaaaacaagtagagggaaacagaaaagacaacaaaggggtgacaatgtttcctactttccatttgacaaagaacctgggtgtattgtagttaatatccctggggggttatcctgagagatgacatagaagcttgttgtttttggtataaacccgcaatgtcttcttatcttcattcccctttctcattcctccttagagttacctaagcacaatttcttttcttgttttgttttgttttgttttgtttttttgagacagggtctcactttgtcacccaggctggagggcagtggcgtgatctcagtttactgcagcctctacctcctgagctcaagcaatcctcctactcagcctcaagtagctgggactacaggtatataccaccatgcccagctaatttttgtgttttttgtagagacgggatttcaccatgttgcccaggctggtcttgaactcctaggctcaagcaatatgcccgcctcggcctcccaaagcgctgggattacaggcatgagccaccatgcctggcctctctttaaacactttttgcttacacactgcttttggaatgaaaagaacaaggagacttcagtcatatcctcctggatttgaatgctaaggagctgcgtaacatttctgaaatcttcccatgtttattaataagagaataattctacctaccttgtagggttaaaggttgagtacgatagcatggaagaatttgcccagcacctagtaggctgtcagcgcctgttacctttcctttccccaatgctccctaaagctaagttcattggcccatcatgtagagtaatgggtccacaggcggtgaattacttgtgatgctcttccaaggactgaatgaggagagacattttaatcaaagcaccagcaaagcttttgtagcgatgaacatacaattagtgaccttctcctatcagggataatcagcagtgggactggcagaattggaatttttttacatgggtgatctgggcacagatactcagtcagctctgtgtcgcttagaactgggaggcaggaggcatttgcaggttggtcacaaactgggtatcagacatattaagcctgcattcatctgacaggcctccagaacgtgatgtcaggagagacgtttagcagtggggagacaattatgagactctcagaggtgagaaagaggattctgctcactgcctagaaagagagaatatggcattggaaagggggtggtaaaatatgttgcctgacacacaccgaaaaggcctgtcagttactgaggtcccatcgccgtctcaggcttagactgcatgagaggatctatttaggggaaaaaatgtatagcttagccccagtggctgctggggtgaatctccagggctcaaagcacgagttacagtttgtctttagtttacttaataagcttcctggactgtctgatttctttacagcctggaacagagggtaacaagtctcccagtgcagtggatccaaagttggtgggcttcagtttgggagcaaagagctcactgtttgggactgggttgatgtcatcattttatgacagcatattaacacagagtaaatagtttattccccagggtactcacccattccctcagaggtgagtgtcaactccttcgagagaggtctgctcacctaacctgccaattctcaaagagccccacctcaggcattctcatagcctttctctggccttcgtaggtctttgtcccattccccgatgataatgccttcatgacaaagatgaaatgaaggttgggggcagcctaggctgtagtcctggtgctgcaccactagccgtagagccttggccaagtcatgcccctctctgattttttcattatgtcaactggaaaatatagtcagactgcctgccctgcttgcctaacagcacagtctgaagcatgagctgatggaatacatgtgtaagcatattgcatagtttgaggaagtattcatgtatacagtggtgatattagacttaagattttcattttttcatgaaattgaaactagaccatctgaagtcattgaaataggaaaaacacatacagtattttaaattagttctactcatgcagacaaaaaaaaagtgtcctggtacatcgttgtttaagatctggtgatctgtagtgtttgtctaccaagtggctaccgtaagtggcctccacttgataagttgtaacaagatcacagcaaccccaacatctctgccactttctctttctctcttctgttttgggtggagagacatctatattgtggctgtctcagagttacggggagagcaagtcaacggtaacagggaaaaacaagccttgtgtgggttggaccagaccatttgtaaggctcttggggcatttgtgtgcacgcacacacagacgttaaccagtccagaaatgagtgtcattctcctcacacagcgccgacagctgagttcttccctgatatttgcagacctctctgaagcttgactttgaaatcctcttttccttgaaccctacgtgtgagagagaagcccttctttgccactcaagagtggttctgtggtaacagtggctctgtggatcttttgtccctggctggctccttcatatgttattgtaaggttttagtttgtgctggcatgcaggtgtgtttttttctcactcagattttctcttagatgctgtaatacaatctataatttttggtacaggagcaagtttttacaaaggaagatatgtgcaatttgtcattttccagcctgatgacatataattaaaccttcaatagtctatgccttcaatagcataactacaacaacccatcacactttggaaataaatttgtttcatattttatattatctggactctctttgtccagtgtgtaacaggcccccaggaaacaggaagtcccccactagtgagcacccctaatgtgaatgactgcacactcagcctattttggtgagaacaggcagcttgctttcggtgggctcttttgaatgggccttgcccaagctcaatgctctctctctcctcttggcttgtggcacctggccacagtagcaggcattgcctgcttgaaaagaggctgtccttggattttcctgcctcttggaacacagagcttaattcagttccctaactccgggaagaagcaatgatcttcagccctatgaacctgtccggcaacccacagcggcccacaaaatatgttctctcgcctacaacctcatcccagctgctaccacagccctgccgacgcagcgcctgctgcggtcacggtccactcccaagggacactgccttatgtcagcaggccctgtcttgattcccaggtgctgggaagacatgattgcagcctcctgcacccctgctcccctcctctgacacacacactctgagcctgcaaggtacagcagcccactaaagctctagttaaaagtaccaagttgctggaatgcccagggaagtgagaatgagcgggtctcacacagggatgatttgaaacaagccttgtggctttttaataatgtgccaaagcggtctcagtggtgggccagcagggcccccagtctatcttctgtgaaaggagaaagcccagcaggccctgccgaatgcagacagcccctccactctgctggaggagacagactccgagatggcaatcaaggcttgatttgccaacacatttccaatgattaaaatgtaattagcacaactgagtgcctcctccccagctaattttaatacatgctgtgacaggcaggcagccggctgtgcctttagcccagcagcagatggaggcagaggcagcgggagaggaaaaccattttgcaatgtgactattcgcatcacaaaaccatcagggcgctcagctcttagaaggcccttgatggcagcacatcaaattggcgctgtcatagctgaccgtggcaatggcagtcatccttcatactgtcccagaagcacagcgaggcaatttccaggcgtaaccctttaagatctagaaggggagagagagacttggagagcacacttgtcgtcttgcagtgacaggcgagagctttgcaatgtgcgctgtgaaacccacgctcttggcagcttgcaaaccgttacttacatgttccttttccaaggcacagtggagtgtggttcagaagctttggaaatagctgtttctccaaatgggagacaggcgtgagctgccttctgtgtgcattatctgaactgggaaggatgagcttttcagcctgagatggtatggcaggttggaggtttcctcttctattccattcatcccatagaagcctttgagcctggggcctctcatcatgaccatctgcttttctcctatcctgaagggcatgtcagacaagctgcaaagtccagaagaccgtttgcctatgctcctgttctctcacctcctggcagaaacactgggccctcaccactgttgtttggcctgccctctccttccaaggcaccacctgaaaaggaggcaagctccttggaggctaaggatcatttggacctccctgggattggggtgcacaggataatcacagggggcacttgtgatctttgggatctgtcacccaggcttggtggctaactttctgtgtgtgtgtgtgtgtgtgtgtgtgtgtgtgtgtgtctgtgtgtgtagacggggtcttaccatgttgccccagctgatcttgaactccagggcttaagggatcctcccacctcggcctctcaaagtgctgggattacaggcatgagccactatgcatggcctggtggctgactgtcatagaacaccaaagctagacaagcctaaataataacagtgacgatgctaagcatgtattgggcatttaccatggctgagaactatgttaaatctcttaaatgcattaattttctcacttcatacccacacaaacctaggggctccatattattattcccattttacggatgaggaagcaaagtcacagtaaggtgcagccactttcccagcttctgctgttaagtggcagaacccaaatccaaatacgtatctttctaacttgtgagtgggacaaaaaagtcatagctgagacatgctgcaccacagagatgcttcaccagtggaagcctctgagcagagaaatccgatctgaaaacaatgggattattctttgccatctaatggcctctgaagatcagcagccatgggaacctccagaactccatcacacgggtgacgtttacatgccgttgtgcatgtgtatctttttctcctctaaccgaaaaataatatgtaatcgttaaagatcaaaaacgacagtaaatgtaaagatgaaaataaaagtgacccaaactctttatcactcagaaataaacagtgtttggtgcatttttttccagtgttttttttttctttctgtgtgtatgcttagcaattttaaagtaatattgtatatataactctatgtatcttgtttccttcattgtagtagtaataataaaagtagcagtttttaatgtattttctccttactgctaccttgagaggtagttactatcacccccgttttattgattaaaaaaagaaattgaacctgtgggagggtatgtgactcacccaaggtcacttcagttaggttggtgaaaagtaattccagtttttgccattacttttgcaccaacctaatatgattttttttaaacttccctatgactgtgatcacttttccatttcagcaaaattctttatgaactttaatttaatgagtgaacacaaccctggcaccttgacctgttccccaatttggtaacatttaggtttatgaagtctgtgtactaggttagtgcagagagttagaaacaccaggattcaaatgcctggatcttcctcttatagatttatgactcttgacaagttgcttcatgtctttaagactccttctttcactgtaaaattggaaaactaaaacctacacactgggggctggggggtggggggagtttgctgtaaggttaaaaacgtgaatatatgaagagtctatcttagcagatttcgtggcccttgctatgtgctgacagtagccatataaataatgtattattgggtcatttcctaattccataatgaaatttttaaacaaattattatagacatttttgttcctttttgagactagttgagctagacagtatggaaaatatgaaggctcttgatgcatgcttctcttcttctgatgcaaattgcaaaattattttccaaatagaaattgacattcctccagaagtatatgagtgtctgcctcacgacagccttgccaacactgcatatcagcatttacatgtttttttctaatttgattgatgaagagaaatatatctctttttaatctgcatttctttgattactagtgaggtggaacatttttttcgtatgtttattagccatttatatttcctcttccgtgaattgacctctttgcttttgaaaggaaggatgagtctccaagggctagctagagaaaagatgctccagtgataattatctcagagccctggggtgaggagttgcaggggagagaattaaaggtctcctggggctatgaggcggctactaagtgagcggctttctacaccagagcgaggctttctacacagtcagcttgaaatcagtatttgttctctacctttgtatttgttctgttaagaaatattttggattttttagtgggactcttcacattctactcaagccagcgcttataattctttcagggcagacaacgagcatgcctgttcagtttgggttttttgctctgaaagtcccattggtttacagtgaagttgctgtaggtcttgcttgagtcttttatgatccctgccatccagccaggagctgtgactgctctgtaaccttcttagatttaaatctgttgcttgtgttctcctcatagtgttacagagcagcagaggccatccatactgatgtcttaatatcattctctccttagatttatagggtaaaataaaccctctgccatagaagtgcttattgattactgaagtacataataaagcctaagaataaagtaagaccaagtaatcggttctgttcctgggggatgacaataaactctggccgaggcagcctctgaaggttgccttttgccttggagctaggaggctcctttttaattggttgtcaaaatagtaagcagtgactgatagaaatcagacaaaaagagtacatactgtatggttccatttatgtaaaatttttaaaaatacctactaatctgtagtgacagaaggcacatcagtgatacggtaagggacctgagagagggatagaagctttggggagggatggacaggttcactgtcttgatcgtggtgatggcttcacaggtgtgtacacatatatgaaaagctatcaaattgtgcatttcaaatacgtgccttttaccaatgtcagttatatctcaataaagccacaaaaaaatagtgaacagtatcccataaagagacaatccatggctcactctgtgctagaaaaattttctcttttcttagaaagctatattttgacaaacattcagggggaattgtgagactacatttcaccttcacctttagctaaataggggttttagaagactgaaagatgccaccggaaattaaaaaagaaaaaggcataagaaggtaggatagccctctttcttcattcctttttctttcctacatctgaaccttaaaggtgccttttaacataattttttagtaaaacaaaaaaaggtatttagaaaatattaattcttttctctcatcccccccaacccttctgctattacatttcccccacccagaaaagagattctacagtgcagagtaaaaactactccaaaatgttggcagtctaaaagtggacaggcattttcaacacaaagagatgtttgttttccttgcattttaactcttaatttttgacacagtagggaactccagcatggctgccatttaaaatgtaacaatgccatgcagctctgattgcctctgtcacaggggtgttgtgactgaaggccaggagacaaagcaaatgaggccagagacagtgcctgctgctgaagtgctggtccatttctccacccgcatttgaatttgtcttttctctggctaactgcttttctgccctgatgaggagtcactcggggagactgaagctggaatttgtacaacctctttcagtccccttgattttaatcagaaatacacaattattcttttcctccaaatagagaaactcaatccccattttaaattcaattattgtaattgcagcattcagaaaaatagcacattcattttctaataagagattgtggataccaaattactgcatatagtatgtcaaaacaggaaacttgagactggcaaaccagtgggtgtttttatcttggcaatttgtattttcttgcagacaatttatagtaatcctacccttccttgtttatgatatagaagactaggttttaaagccatcctaaaataaagactgtttttgttgggtacagtttaattgaaaatctgttatgagtatgaggaattctacaaagggcaaaagtgaaggcagatacccaataaagggaagaaaaaaaaggaatcactttaggatcctatgtgacggtagcctaagatgtctttggatcttcttgaaccattctcattatctcaagccatatttatattcctttagccaagtttctcactatcttgcatttgtaaaaaaacaaaaaaagaaatctggttggtgagaagttgataatgtggccattatgtcttagcaatatgagagcaccattgtccctcttcctgctcaattccagttgctctagttggcttgaagtgaatcaaatgtgaaaagaaatacagtttttttattttgagtttcctgattttcataaaagagtaaccttaagatgtgatttcttcaagtgcatgctgttattttcttaggatttactgtcacctcaaaattatatccatgtcagccaggcatagtggctcatgcctgtaatcccagcactttgggaggctgaggtgggtggatcacctgaggtcaggcgtttgagaccagcctggccaacctggtgaaaccctgtctgtactaaaaacacaaaacattagccaggcatggtggcgcatacctatagtcccacttatgggaagctgaggcaggtgaatcgcttgaacccaggaggcggaagttgcagtgagccaagatcgcgccactgtgctccagcctgggcaacagagtgagactctgtctcaagaaaaaaaaaattatacccatctttttcatagacacattcagacacctaccacactttcagatcttttagtgttcatgccgccaaccactgtctctctcttgatctcttcactcagacactctccatgctaccttccctcaggtattttgctactgtaatttattaattctttcacatatatgtattgagcaccttctaggtaccagcttcaagtggagcaagatatgagcaaactctgagatactgtcaaggaaactagccaacagtgttggaggtgctagaaaccaacagttaaggtacagccagtgaagtcagagccctggaaagcttccatatggaagaaggaacagtcatttccatgtgtcctgaaagggtggtggtctgttggatccttgagtgcctactaagtgccaggtactttagttatattctctcagcaaatccccatttttgcagttacctctgggaatttttatctctgtcaagattactctcctggttgattttggtaaatcagtccttaaatcaatcttgaatataaataatctgtgagtagggctatcaaaactatctcctaattctgactggtcagaatcgctagacaaagtttaaaatatgtagcttcctacttgtaccagtaatcacctagtgtttttaatatccattctatttatctgtgtatttatttttccaacttaactttgaacattttaataatgtcaaagcccatatgcactatgcatagcataacttacaaatttaaactccaaatcttgtacctatgcattttactttagtccctgtgtgcaggttactgactatttgaagaataagtccaagctacttccatcccaaaaaaaaatgttcatcaagaacctaaagaaacacttcaaaatttcagctctaaggtgtctttcctttttggttttttatcagtgaaataaaactattagttacctggaagattcttcttgttgctcacttcgttgagagggaatgatggtttctggttttgtttgtctgggtggttgtttctgttttcgtgtagcatagtattgagtctttaaacacgtcctgagcagaaatccttgcagaatgtgacttcccctctggcaataaaacggtacaaaaattcaacccaacatttaaataattagtaagttaccctgttgttgtgtgtgatataacatatctttcatggaaataactggaaaaatgaaactattggtatgtctttctggctgctttcacatacctgaactgatttaattctcacaaaaatccggtggggtgtgtatcatcgccattcactggttaagaaaggtagactccaagaattaagttcctttccaaacacagcatgattattaagtggagggggtcagaatttgaacctacgtcagcctcagactgaatgagcacttcctgtgagccagggactgtgctcagtccctcttaagggagagctgtcttctgtggagcagaaatacggctatatggctgcattcactgctgcttgtaggcgctgcaatctcttttcggtttcagcttgcctctgtactttgccaagcaatcaatcaggaaaatattttgaagtagtttctttgtatagcctgagagagagagtgagatggtacgttatactggctaagaacatgaactttgaaggacataactgggttcaagtgccatctctgtcactggaagccttacttaccttctcatctctaaaatggaagggtggtagtataatactttcttctagagctgttgtcaggattcttggtgttttttgtttgtttgtttgtttctttgtttgtttgttttggacagggtctctctctgtcacccaggctagagcacaatgacatgatcagagctaactgcagccttgaccttccgggctcaagcaatcctctcacatcagcctcccaggtagctgggaccacaggcatgcatgaccatacctgctaattttaaaattttttgcagggacaggggtctcgctatgttgcccaggctggtcttgaacttctgggctcaagagatcatcccgcctcagtcttccaaagttctgggattaaaggcatgaggcattgcacctggcctcaggattcttttttgatgaatgccagccaacagctggcatttctagaggaaaacatgctctgccgttgttcctgtggaggaaccctgcaagatgtgaaatgcacttcaacaaccaggcttttccaaaatagagagctcagggctgccctgccatcatggacaccccatctctcctttagcttgagatggacattgaccctttggctgggaattgaatcatgttggtgatacttagcatggaaagccgtagctacattcagtgtctcacaaccttagtggtggaaggaagaatggttgcagcagcttcattacctggggaaaaagaacttggaattccaagcactttaagaaagatgcttttactttgagtgttggagaaaatagagcaattacctattgaagacaaagtggatgaaaaaacacctctgttcatgctaccctgatcatgtaatctattcatattcattctgccttcctgaaggtgattcaagccagactggctgttcctgctggctgtgcctttccttccccaggatacacagggcacatggtgatcacctgagattcccagctaaactcagacattttctactccaagaggagattcctcaaagggctatagcacacaggcagcatcagataatgtggaatgagtggaaggagggagggaggaggaatccataaatcatcaaattgttgttgagcatctttgagggtcctcaagaatacactagaccctgtgatgattccagggacaaccagcctgcactttctgaggagttcactgcctgcctggggagcaagacttgtatatgttaaattagcaaagaatttatgcaagacgtatgtgaaatcagtgaagaattctattctatctagactagagccagggagatttccaacacctggctcatgtatgctttttaaaaaaagatattcagtcttactgaagatgaatagatggatggatggatggtttctaacatctattgattgcttcctatgtatcaggcagtgttctagacatttttatgtttattacatatgtacttatacaaattatatgtttattaactcaattaacgttcttagcaacactatgaggtacatactgtcaatagccccatttaatagatgaggaaactgaagcacagagaggttaagttccttgctagaggtttcacagatggtgtacagtacaggcaggctttgcacccaggcagtctggctccatagttatatatgaaggataacgatgtggtcttttcaagagctgttggcatcttggttcacactgaaagctaccaggctttgttatctgttcctctggctttggcttcctgagtcttaagcacccttctcttttctagaacatagaccagcttgaaccaaccctctgtgattccaccccgcctctcccctggctgcaccaggcctctcatttgtagtttctcttactgagcacatttctaaacgaggacggttgctccactttaaggacatacaaatggcttgccctcacctgtcaagcatgatccttgtattttaccaggcccattatgaacgcaatctttctgttgaaaatttgcatacctcctttcttgaaaagtaatgacagcaatttctttccctccgctcactttctgagtgtctcatttaacggcacctgtgaaaccgacaggcacagagatgagaagtgaaagagagcagttgattaaatcatcatcaagtcgggcctcagaaagtcaattctgcttgccgtctgcaatgatatccttttatcttaaagtaatgagctatggcacttttgcatcgggtaatgcgataagttctattagcatgttccatttgcctcacaagcaagggcaagtcattttagctagctcatatcactgcaatcaaagcaattggcttcccaggcagagaagaaagggaaaaggctcagggtgatttctatggatcacaacacagcggaaaaaatagactcttgtattattttaacccataacatacttttcctttttactcatcagcaaatttgggttttattagcttacacaggactccaaaaagaacccagcatcagttgaagcaaacctgggggtgggggctcagaccccacccaaagcaccaagaaactatatatgggaagggaaaatcgccccattacagaggggtcacaaatagaattctgccaaagcacacaggcaaagatgtcttcctgatagtaacactgtggtctcataataaactcttgcttcacaccatcttcaaagtcatttgtaataggtccccaggcaagtacggattaatgctattgatgacttagaatcagtaaatcaatgacagagaagcaaaggatctgttccttaagcttaaaagagatcatttacaaatcaccgggccccagactgtcagttttacctttggacaagatacttatttttctgagtttggcaaccactgaggtttgtggactctgggttttaagtaaatttcatctttggggtttatgtatatttatacttggcaaaatgtgacttcctttcttagaggaaaacaagctgaactccccaaagatttgtgaaatattcacttccaaccccacttccaataactcaacaatactttaatgatctgtggaaatttacaacatacagattgttttatgaaatacacttggatttcaaagtgacaaaaaggaaaaaaaatattagaatttaatttatgagctttaaaacttcaagtttggacaacctgatttctgtcaatatatttgcacttctaatgggtggtagaatgaacctagcacatagtagttacctgaacattgttggttgaatgagtgtgttattatctgagacactggagggggaataagaagtgttcccttagccccctcagatcacattggttatttgagctctggccagttcaaactgagaacttgcaaaaatgtcagattctgagaactccccattcagaaatgctaggttatcagtaccgaattccagaggcttctgagagttgattctcttgtatctcctgaacaattgaagattggtggacctcatattattttcaaatgggctcattagtgattaccaaaagctttattcttgtaaactgttgtttggaacatgaatattttaattaggctttcattttatctgagctattttatttgatcaggcgtagttactgttaagatagaggggaagagtcgacgacattatttcacagtcagtaagaatatggtctcagtaagaacattttcaggtttaaaaatttaaaaatttctagggccccagtagctttaaatttcacttagtccaaaaccaatatgagagcaatgtaaacagtgtgaaattagggctttgtggattgatgaaaaacagacaacatcagagctgccatatgtggcacaaaatggcggcccatttttacatgagcaaaggattgggcagctgggcaggggatggtgaacgtgtttttagtcaccatgctgctatcttacttctttaaataagaaaataagtgtcatgttttctgcaggtggcttcttctgaaattgcttttaggtgagggatgtctttaaggtcttagataaaccgcctgccccaaaggagaatcgatttgttttgtcactggcaaagttaaattatacttgatgttagatattgtagtttacaagttggggttctccctcattttcctctcatttcctttaggcagaaacaagaataaaataactttgttcagcagtggtattcagccctgacatctttggtggcaatgataaatggatttgagatacgaaataactgttccagcaaggtccattgagcagaatagagagcaatgccctcctcaatgtcattgtatgtgatatattcaatgattgccactctgtgcttaagaatgcattccatcacaaggtacctagaattccatcttgttgctacattctgaatgaaacagagagatgtcacagaccttgactgatttcaatttggaccagagtcttaaaacacagataccgagattcccaaatgaaaatgaaaaatatttgcttttgaataaatataataaagtcataatcacatcttttttctgagccttttaatggaagatattttcttctgggccccaactctaggctctgctaacgattttaacctccctcagtatgttcacacatacatctctttgcgttaagcagtcatattagtgtttcttgtactttctctttggaatcacctgccttttaaatcatactttgcttatgctgcatggaatcaaccacagtttgaacaatactcaagaagaatgagattgacttgtcagtataattgagcatctattgtgtcccaaggcctagagatacaaagataagcaaggcactgtccttacctacatggagctcattctctggttggaaagactgttgtggcaaacaacggcagtacagttttgtaagggatggagatagaagcaattaagtctttctggaaaagtattggaagattcaaaaaaggaactgtgttttgaaggtgaatgtcaggcttttaggtagaaacttggaggaatagaattcccagtagagggaattgttaagtgcagatggctggtggcatgactgagcgtgagtgggcgtggttgaagcaaggtatgttaggatagtgccacacaatgcgaggatgccaaccagggccggaccacaagctgtttgcaaccaacctgctgtgagattagtatggggagtcaagagtaagcattgggaaacttttagagtaactcagtagcataattttgtgtttcataaatctaataattttttaaatgtattatatatatttgtttttctttttcatttttcaagaatttgactttttattatattttacaaaagtaattgtcgtaacatattagaaattaaagaaagcaaaacaaaaacaaatggctcttcaccacagaaagcttaagaagcattgtgttgagagagtggttgggatttgggagttgagggggattagaaacagaatgtgaagggtcttcataggccttgtgaagcatctgcatcaaatagaaatttaggaaatccactcttgtcaataaggacttggattagaaaaggaagagagcatagaccttggaaagcagtcattatcctcttgtaatgacaaaataaaaccctgaactaacgcagtagccatggccacagggatggagagttagaaagcagaatcaataacgtggggtgagagaggaagataagtccgctcaaggatggggtcaaggataaggctcttcacttacgcagttgagtgattgcttggtgatgctattaccaagggcaacgtgggagaggggcagtttcaggtgagcaaagatgttgagtccagatttagatggatacttgagtctgagtgttcgctgcacttcaacagggggcacatacccaacggaagcttaataatacttaacatttatcatctgtacatacttggtaccatgcactaagttgtttacatgtattaactcattctcctcttctagccatattttacagagaaatatactaaggcccagagagtttaaataacttttccaaagttacacagctggcaaatgtgggcatagagatttttgagtttcagcatatacatggtagaaaggaccaagggaatctttaaggtctcccttgaaagtcacatagaaacaatagaactccagatgcaactctggggagacagtgacattaaagaatatgcagaaaaggaagggccttgaaaagacagtcgcagacagcaatattggtgaatgggtgcaaagggaaaaattctaaaggatgtgcaattgaaacaatctaaataaccagcactggggaattttttaattagattatgttacaatccacatagcagattgcagtgtcgcctttttttttttttttttttttttttgagacggagtctcgctctgtcgcccaggctggagtgcagtggcgggatctcggctcactgcaagctccgcctcccgggttcgcgccattctcctgcctcagcctcccaagtagctgggactacaggcgcccgccagcacgcccagctaattttttttgtatttttagtagagacggggtttcaccgttttagccgggatggtctcgatctcctgacctcgtgatccgcccgcctcggcctcccaaagtgctggtattacaggcgtgagccaccgcgcccggccgtgtcgccattttttaaagtgatgttacaggataaattttactgattaaactgaaatatttgacgtgttatgtgaaaatcaaagcaggttccaaaatggtaggaattcatttttatttcttaaaatgtatgtttaaaagacgagtgggattatatccttaagactggaaagacttacaaaaatgtattaacagtgtttacctaaggattgtagatttatgggtaatttttaaaatgtatccagtaaatatgttttttttgtttgtttgtttgtttttgagacgaagtctcgctctgttgcccagggtggagtgatctcagctcactacaacctccgtctccctggctcaagcgattctcctgactcagcctcctgagtatctgggattacaggcgcgtgccaccacgcccggctaatttttgcatttttagtagagatggcgtttcaccatgttggtcaggctggtctcaaactcctgacctcatgatccacccgccttcagcctcccaaagtgctgggattacaggcgtgagccccgtcacccggccgtaaatttgtattttcaaaaggagaaagattgggtgggttggtttgttgtttaaggggtaagacttgtctgggaaaggaagactgtgcctccagcagttcacttttaattcatgaaaccaggggaagagacggtgaagatggaagttgagtggtttcagtattgagatggctggaaggactcaggtttaggaactagtccctttctaactgtgcatttgaggcctttggccaggcgtgcacacgtcctctttctctccttttgtgtgtgatggtttgggtcatgtctttgtctgaaggccgggtgaccatgaattcttatctgtgattgctgtaaggcctagttgtttctttttgtctcttttcatttcttgcttttaaaatggaggatatatttttagcttttcacagcgggctctgaaatcttgtcatggagagtacttcgtcacctcaagctggtagttagtgtgcaacctgtttgctaataaaccaaagcaggaccccgatgtcaaaatgcttaaaatggtcaaatccgctgggacgccgtctctgcatctgacatgccttttccatttcccagcctcatgcagaacataaacctgcatcaggaggtggctcaatgtgaactcttataaattggagtgggtatctagggattgaggagcagacacttcttcttttaacctttgaagaccaagaatcacttggccaaaaaaatccacagtgtattgaacttagggtgtgaaagctatacagtgtattaaatgtgaatttgagaccatgaattctacccacactgactctataaaacagcctccctttttcataaagcaggcccataaaccgctgccagtgaagcagaaagactccttaggactgtggctcgctttccgtctggggttgtcaacaaaccccctttatgagtggaatagacctcttgtatgtgtcgagcttctggctttttacagagtgtgttaggagccaggcaaggcaaacgttaggcgctgtttgctgagtgcatttattggctttgcataatttatgagctggaggggttgaccatcattcgtctctgccaggggctggcactcgaggctccagagagtggagctgtaaattggatggtgcgctcctgctgagctcacggcaaagtcctcaggtcagtatgggaatttaataccagaaatggaactgttttctcagcacaccatgtggaccccagtgcagcagagactgttttggcagactccacgactggccttgtcgaggagctgtcactcacccggcatgttgtgtggggagcctgagcatttttaatcggcttggcatccgtgctgcttccataatggataccagtaggtctcagttcttcaccatatgcttaactctggagacaaggtgcttctgggtatatcagtaattacttgatgcagaattaagtggaccttgaaattagaactggactgttggaaagcaggaagcttaacactttgatagaaataaccattcccagggacatactgccgttaggatagggggcacagtggtggttctttcccagctaccccactcctcgtcctccctgcacaccagatccttggggaggtgggcaaatgcgatgccacagccttcagctgtcattgattacctcacaaggagcgctgtgaacatctgggaacatgagcctgcctggcaaaatagtcttctgccttccacacccctcttgaattgagcgttgtcactcttgaaaatgtgcccagatcttaggaacctcacagagggcttaattaaaggcaatggagagatcacacaatcaggacagtattgttcctcatccacctgcggttctaggccttcaaagtcttcatctcatccaatttctttctcaactcatttgacttattacaataaagaaaccactcatcaggtcaaagaatgtaaatgtagacaatctgaggttggaagctgggttggaaatgatgcaccgtacttggttaaatcgctgtcactgaatatctgactaccctgtggcactgaggagccaatgggagaagtagaaaatgttctaatcctccagtctataagactgtgatataagttcctaaatgcttttactacggagtgcttagtctgaaaagaataagtagtccccaggttgtctcataatagcaagaagtccatttagatgggtgttctgttacttcccattaaaagctctctaataggagcttaaacaataaggtaacttagtgttttctgaataaaagtcctgaggcaggctgccctgagatgggttcagtggtccaattctgtcaggcattttttcccttggtcccactctgttgtttttgtactgagtctttttgcctcatttttgcaagatggctgctacgtatctggacatcacgttcttatacactcatgttcaaaggccaaaggcaggtggttccttcttttctttgtttactggggagacaaaattgtttctagagccctcagcagatttcagaatctcattggccaaagatgggccttcaaataagcgattacaatgcccagaggtttacctcttttcccatctttagcctcaagaaaaattgagaaagaaaatacctggcatttttaacctcaaagtgtcaggagaaggtacagactagggagaagggagttgtgaatggctgtggggatctagccagcagtggctgccctacaagcaaatttatttcctgtttctgttcaaagctataccaactcccatgtccaggtggccacactaaaaaaccttggcatcatcctagacacatccctgttacttgcttcccatatccatgtgttatcaaatcctgttggttctaccttcagaattgctgtgccatctgcttctgccttcctaaaccatggcaccaccttgggttagacagtggaatggctgccaaaccactctccctgtgacctgatttttccccactgtgcactctctccacgttcccacagaaagtcatcctcatggaagcagctctgatcatgccacacccctgctagtgtttgtatcccagcttcatgtcttactgctaaacggaaggctcctttagagccaggcctgtatctcaggtgaatttcagtctagtttagcagttccttatcaagggctgttgactgaatgaatagatatatttacctgctgagctttactctaacaaaacacatcccccagtttttcattgaatattgaattaacaaaacacttcattttttttaagttgtgttcttttttcccttgcttatcatgaggatcccaaagactggggttaattattaattatcactctctgcttatcccaaaccaaactcagtggttggaatttgggatctgtttgatatggtctgagtctatggccctaaagcatacttttttgcccatattttttatttactaccctgacctcttgtctttggcatactttttatagggaatgttccttctattctctgggcctctaaaccggaaaaggcagccatcacaagtggtgagccttggccattatgttctgtttccttcaaagttcaaatgagtgactacaacgcccagaggtttacctcttttcctgtagaaaagcaccggtagagatacagccattcacattagctgaagatagaatgtcttcgttaagaaattgattttgctctgaatttcattgaacaatcttgattcaccttaatcctgtggctgactcctagaggggcatcgcctctaccctgccatggtgggagggaagcgctcacttgtgtgattgagcaccttgctggactgacctgaggaagagccacagagtacaggcatcagatgaaatcaacaaaataacttttttgcatctggatagcattttgtttcagatgctgtttactagcacttgaactggagaaactctttctttccaggaagacagcattttttatttcctttacttatcttgcactttttttgtatgggggttgggggaggaggcatcaaaagcaaaaacatactcagttcttgcactaacccttattctcttgtcttcattttcagtgtgacagtgacagtgaccaggaagagaaggtaagaccccccctcccccattgtgggcacagcacataacacactgaacaccagagtcctcccacacacagctgcagggtaggatgccagcttcatgttgacaggaccttttctctttaggaaagatgggcattattcacacagtgacatttcctatgctatgacacgtttaatttgtcagatctacctttttttcatttaaacaagacctttaatattgcatatatgtgacactgagtttttactttatggaagatgactcatagactcaaaaacattttaaaagacaaaattatttattttaataaccatctgatttttaaaaatccatgatgagaacgttaaacttgctagtttgtgtttataatgtcatttctgcatttattttactgacccatatgcttttctgtacctattggccttcttgatagaaatgttaatggtctgtgtctaggaatctcatcatggggtacgggtgggcaagggaggtcagatgggaactgccctcttcccatccgggcggaccgccaggtaggaggacagttcttccagcaggtacatgctctgtttcgaggctcatgggcaccagcctctgtgtatccagatcaacatggatcaagaaaaggaactcagtttctgaggttccagaagattggatcacaactcggtaaagtgagctttctgctgcctgaagcaaagggattatttgtctgtttggtctttctttctagccgttccaatccccaaccaaagttccttccatttttactgctgctttatgttattttgaaaagagttacctgaatatcacggtttctgtattgcttggtatcaaaaggatggactcggcctcccttcccccgtttctggatctgtcctgtgccctgtgctttgactttcacctcctacatgcttgcggattttattcagaatgctgcagttagtatttagtgggatctttccaacaaacccagaatttttctctccttctctgctgccagcctccaagagagatctaaaggctcttgttctgtactgtcgttaatttgaattcagcatatgtagcctgttataaaatgcgagacatcatcatttgagcaggtcaagcatattcagatgaagacaaatggtgcttatttgatttccttaaaatcaggaaatgaaaaaaatgctctctggagaaatcatgttctgcctgacttggatgatagaccaatgcatgtcccccagataagaacaggctctcgccttgaggtttttatctctgaaggacggccaggactgtcagcttgctgacatgtgcattatccatgtcattttaaacaaagtgacctatggaagggtacgctgtgctgtgacatggtaatgggctgttggatgacagtgaaagtacacactggaaagggggctgtggattattcttttgtttaactgacaagtaggagctgcctttctccagcccccaggagccttagctccttggaagtaggactcctggtgtctcaggcagccagtgtgtagtgggtgccagggacatgtgcacagcagtaatggttagtgttcaagacacggtcattggcccccaaacccccgaggccacattcccacatggtgggcatcactggtacccagggagggactggtaccttctggccattccagatctatcagcaatggttgatctcactttctaagtctgtgccacttttccaaaaggataaatcttattcagggtcgtacaaccaagctgacattctttccttaaaaggaaatgtggggccaggcgcagtggctcacgcttgtgatcccagcactttgggaggccgaggtgggtggatcacgaggtcaggagattgagaccatcctggctaacactgtgaaaccccgtctcaactaaaaatacaaaaaattagctgggcattgtggcgggcgcctgtagttccagctactcgggaggctgaggcaggagaatagcttgaacctgggaggcggaggttgcagtgagcagagatcgcaccactgtactccagcctgggtgacagagtgagattccatcaaaaaaaaaaaaaaaaaaaaggaaatgtgaattccaaaaccatcaccagtcttcagcagtggtagaaggtggtaaggatgcccggttttgtgttccttgtaaatgtcttcaccagtggcctcaaccttgacacccaaatcacctagggagctgctacaagttccagtgcctgggcctcatcccaggtcaatgaccttggagcctttggggctgtcttgaaccatgggtcttgatgatcacctaactctggtaatttctaggagtaatctgcctctggttgtcagagggatctgggggccaatactgagagcaccccaccaggtcctttcccatcacctgaattcctgagtagttattgcctgggtttccatctctaagtgcaagaagtaaagtgtcggaataatgggtattgggaaggtagctcccacctaccactctgagcttgagtagatttcagggtaataaagcggatacatagttgtttataggcgagtccaagagtggcaatggcaagaagggaaggggtattaggagtgttcctcagattcatggcgcacctcctgccctgcacccccagccattcttcctttctactgtggtgatcctgcaggtcttaagtgggagccacaccataaccagtgttgacatcatctgcctctgttctgccccatgccatttctccagggggctcccaacaggagccattgagactctaattgccctcgcacctgcttggccctgttgcagttaagactgttaggcttccccttttggactgagattgtctggtgtttatcgccaactttaacaccatcctccaagacttctgctctgtcggagcctgggtccctgtcagcctcctctgtgaagaaacctcttgcctgtgcccccctcgaagccccagagctaaccagggctgctttcatgtgttgcttggaggattcgcattcgaatctgaattgctaatggtggaaaagatgccactcagtgtcctgggataccttcagcaagccccaccagggatgctgttggaggcaaaagtgaaacttgtcagggacccactgggatttctctctggaagacctgccattctcttactccatagggatctgcagaaccggcaggctaaaattagggtactgtgtttcacacagctgactgaattaagataaactctgctttcctctgatatgaagctgtaatttataaaatgatacccttactaattaacgtggaagtgactccgaaaggggctaaaaaagcagagctttccctaaatgcaggagacacacttgtgcacaaaaaggctttgatgagacactgagcaaagtatctcccttatcctcccctcccagccacgtgaatacattgcacattaatgtcagataaccacaaggacgttcatgaagagtagaaattgggctgggtgcggtggctgatgcctgtaatcccaacactttgggaggccaaggcggggagatgacaagatcaggagttggagaccagcctgaccaacatagtgaaaccccgtctctactaaaaatacaaaaaattagccgggcgtggtagcacgtgcctgtagtcgcagctactcgggaggctgaggcaggggaattgcttgaacccgggaggcggaagttgcagtgagccgagatcgcaccattgcactccagcctgggcgacagggcgagactccatctcaaaaaaaaaaaaaaaaaaaaaaagatagaaattgggtggggaattacagaaggctgtgaacactgcatcttagatgtgggattgttcttcactgtagtgagagctaagaaaagaggcagcacttggcacccttaatcacccaaattaagcaattattctgatcccccattcgaaatgaattggtatcatgagaacaaagaggcaacatgcaattgccaaatatttggcctatattttattgtttcctttctttctccagtactggcagcagcccatgatgctaagaaatatcccgtttggttatgaagttaatgtggagattaaaagtcattccctgttctacccacaccctttttcttgtgtatagcatgtgactgagctgattggaaggcatatagcccagtggccaagcacttgggcctcagtgtgatggctgacacatgtttctgactctgtccatttctattttgttgtggacaagccttggctttctcagctgtcaaatgggggtgacaacagctctacatatagtcctgtagcaattaaatgaaagcatttagggccaggcatggtggcttatggcggtaatcccagcacttagggaggccaaggcaggacaaagtgggctcttgtctttgagccctagagtttgagaccagcctgggcaacatagtgaggccctgtctctaaaaaaaaaaaaaaaaaaaaaaatcttaaaacttaaccaggcatggtggcatgtgcctatagtcccagctagtcaggaggctgaggcaggatgattgcttgagcctaggagtttcaagactgcagtgagctaagatcatgccactacactgcactccagcctgagtgacagagtgagaccctgtctctaaaaaaataaaaatatatgaaggcatctggctcagtgcctggtccatagtaactgctcaataaatgttagcttttgttcattttacttgagataaaatgagagaggacgcttgaaaaaagaggaagactagcatcctctttggaaagctggggttcttctagagaacctgctagagggtttccccagaatctgaggctcagcctttatcccaagggcccttctcctggacacaggctgaatggaagtgttaaattttgaagggttctgaaacagtgtctttttaaaccccttatccaaacatcaggccttcctctgagcagaacctggagccaagagcacgtgtactgtcctggagggatcaaatggtgattaagtgaattgtatagctcttgtcccttcagcaactgttcccaaatgccaaacactgtcggttcccagaaacccatcacaggagagatgttctggggtagggccagagcatctgtattttttaaaaagcttcctaggtaattttggtacacaactggttttgagaactactgccttatagtaaatgtcaaagggaaacatgatttttccccgtgtttaatgctcttgaaattttgactgcttaggagaaaaacttgaaagttgtggagatgttgcctgtgtgtgcagacatgtgccacccatgcttatgtctgtagataccgggcataagtatacatgcagtacacacatacacaatctcacagaaatgaatccttctccttttcctatcaatcttttaacatgactcctgattgcagttttttctctctgtgctgttagcagtaggaacaaccacctggagaaggtgtttgtgctcctgggctttgctttggtactgtgtcctgtacccaggacagcctactggcacaatggctaactgcaaatgcagtactaccgatttttcacacctgctttccctctttccacacactttttggtgcattcccttttttgtttagagacagggtctcgctctgttgcccaggctggagtacaatggcataatcttagctcactacagcctcgaactcctggactcaagcagtcctcccacctcagcctcccaagtagctgggactacaggtgtgtaccaccatactcagataacttaaattttattctgtagagatggagtctcactatgttgcccacactggtctcaaactcttggcctcaagtgatcctcctgccttggcctcccaaagcactgatattacaggcatgagcaaccatgcctggtgttcatttttaaattcatgctaaaagttgttgtgtttgatcattttatgttcacttgtgtgggaaggggcttctaagaaaaggagcaaagaaaaccagcaaagtcttatgttcctaactcaacacaaaccacatgcctaacttggctcgtgcaggagtcagaaactgctgagatgtcaaactgaagactgggcatgtggtttgtgcttacagtggaagagtcccatcccttggttggccatgtttcacactcggtaaggtttgtgcaccctcagcaacattccagaagctcagaaggccctcattgttgcttgtggaacccccagccttagttttcaaataggatatattttggtcaggagacagtttggaggtactgtcctattttgtagctagaaaggaatatctccacctttccagatttcatagcagcaaagcagacagccatcacccagggaaagagaatggatccatgttcttgtctttatatccctaatactttgcacagtgcttgatatgaattaggtgctcagtgttttgcaaaatttgcattttctttcctggatactcatctccaaacggaggggataagtgaaccaagttcagaagactcatactcaaacctgattgcacctcatacagtcgcaatgtctacttcctggacccccaaaatgtgtgatctcttcctcaggcttctatatttcatctacagttttctcatacaatatatctaagccatttataagtttcctaacttataaatagacaatttcttatggttcttggctgagtctcaggagatttttaatttatttttgttttttgaaatggagtctcgctctgtcacccaggcagaagtgcagtggcgcagtctcggttcactgaaccctcccactccttgattcaagtgattctcctgcctcagcctcccgagtagctgggattacaggcacccaccatgcctggctaatttttgtatttttagtagagacagggtttcaccatgttggccaggctgatcttgaactcctgacctcaggtgaccggcccatattggcctcccaaagtgttgggatgacagtcatgagccaccgcacctggcctaagagctttttattttggatgcgtgatttccgtgatgcccatctactcaacctcttcttaccccttcaggattttgtctgggttaaaatgacattttattgttcttccaaaatcatcatatttccaattggcttaattacattgcatacatcccaaatacacattgatactatccttggattaaatttctatggtaaattattttaaattcagaatctcattatctttttcatatgataacattttcaggcaaaaccaaaaattacttcacttatactgaacatgtatgtacaataatctgttcattactaccatgtcatgcacctgaaaaagaagttataaatgtacagattttcaattaaatataggtaagtcaacagaataaatacttgttattggaaatatgtcaggcattttcagctaaggttttgtttcttgaaataaacagtgagaagaaagaacaggttctagatgttctattgctcgcaataggtgggtggtggagaagggcactcagaagacccaattcctgatttctcactcaccagctgtatggccttgggcaagttacctaatggtgcctagcattagttttgtcatctggaaaatgaggcagtattcaatgatccaacattgactatccagattttccaaatagctatttacctaggccccaacagcatggcagaacccagagggaaattaatatgtgattgtatcttccctttgccaatgtggaaagaggattatataagaattgtctccattctttcgtctctctcagtcttccaagagagaataaacatataggggacatactcgggtatatgtgtgtgtactctcaagcaactgaaggaaacttacatacagacctgatgtctaaacagggtccttatctgtttgttggttcagtctttcagtcatacatatccactcattttttcacaagtgtctactgatgaactgacatgagaattatagttgcttaactctgatggaactgtcaccatgtacctgtgagtaagtagcagagcagttcatttaatctgtgttcctcaactactgtaagtatttaggaaagcatggggactaggtggagagctagcttacggaatgtgtttcaagaactcacttgtttggtaatgaccattacttgatctataaaaggaattgttccagaaacatcaaggttgagtgcatgattctgtgttcccacagaaaagttcctgctgcttccccttgggtgaatgagccatcgccttgggtgtcatggcttacctgaagggaaagttgtaaagccaaggaggaggctgggggaggtgatggctatcagccccatgaaattgaccatgagccctgagccacctgaataccaggagggtcatgagcagaggcatttgtacaggtgatgtcttgaacaacatgcttcatgttagtggcctctgatagagtgtaacctgggaggctctttggttgtcagagaatttgtcttatactgtattagggttgcagagtgttctgtcttcaatgaagatagaactttttggtcatgtacgtgtgtgtgtgtgtgtgtgtgtgtgtgtgtgagagagagagagagagagaaagagttaatcccccttgacaactcctggatggcaagatagttacagataaatgctcctcagaactgtgccattctagtgtgacaaatataatcaaatatctatattaggatgtgttaataattatctaaactttatactttaagaagtccccagattcaacaaatgaatggacttctgttttcttttttaattaaagttacagctgggaaggtcaaattggttctcttttatacaggttagagattttccctatcagtttccatgaggagcatgttgagaagttctagctgtagacctgcatgacctcttcaggtacccgaagaataacccaaagaaagctggaagcagctttctcccttgttgttctaaaccaggcttgactcatatacttacggagacagccgaatggggtctttgaaataaggaaagaccagtaagccctgtggtgggtggttgtagtactcaaggagcccagtttgggcttcatcttttctttctagtgctcttagtggtttttgaagttcctaatttcctggtctaaaaatatagatgctactaatgtcttcggtcagtgaaaaactaagattagggtcaataatagcaactaaatagtaataataagcaccacttcacatgaaagagaacattgcattattcaaaacacttttaaaaacatcattttataagatctgtttaagtatttattgtagggatctatatattctcacatacaccatcgttgaccatgtgccaaactctctgttagggcttttcaaggctttatcttctcaagcaggtgtcattgttttacaaataagaaaaatgaggcataagtgatggagctgagatataagttgtgtcttaggattccagaatctgggccctcttcccatgccgtgctgcttccccgtacgtcagtgtgagttgggataagcctagcagtgccattcaggagctcatgctgtcatcccctctgtgtctcacctacttgtgctgcaagagacctggatcctgtttatctatccaccctcacccccacccaaacaattgcactaactcctaaaaattcaaacatggcggtttctcaagaaacatggaacgaataaaatttgggtctactaacaacttagattgtacaggctcttctgaagtgggacttttttcttattttagcctggaatgcagttatccaaggtgagaagggaagggctatatacaaggtatatattttaactcttacagatgggtagcaaagtcagcccatgattaattagggatgtaggctacaccagtcggtggacttagcatgaaccatatttggacacagaactcagtcttcctttaagtgtctgtatatgtgtaaacatttaatattttattaaatcatagactccctgaaagcatcccatgcctagcatgtacttgacacatacggccctgtaaatattagtgttatacccagaagttgctttattggttatccaagtctcataaaggagaagggccttgcctctgtcactcagaaagcacaggaagagcagggctggagcagaggaatttcttctgagcttccagtccagagcctcatgaaccccatatggtccctgcagaccattttcttcctacgaccccacacaggagaaggggccatggttccatggtggctcctgcactgcaccctctaaggtagttttgttctgagttataattcgccccctcaagaaccctcttgtccatccccagacactgattctcaccctgacagaggtctgggtccatcagggccacagggccttttcttttttaacagcaaatgctgcgtgggctgttcctgcagcccaaatgatagtaaatacctgaagcagccatgtccatgttaaagattatgtatttgccactaaggggagaatatagtgtttatcggccggagtgcgtgccggctgagctgattacggcacaacactctgtcagccaatgatttgtcctgtcctttatcatctgtgtcactcagcagtgtgctggcgaagggaacggatcacccccttccctttttttgtacccattttgtgtagaaaatttgtatttactttgggagtgtaatttgttcctcatggataatgtgaccctgagcggagctggatcatgggttagttgaagtgatattttccgctaatggtagtcgtacatcattgctgtcagctcgggttaggaggcaagcacattacagctccattttacctctgcaggcatctgggattatttgccataaccgagtatgacatgaccgcactacagagtgcattaaaattttactggcttctcaggcaagttccccagctccagtgtgtgcttcaggcaggcggtctgatggggagtccaagggccctgacttcctgctcagaggtgctgcgggcagtggcctaagcaggggctactctctccttgccctgagaaagaagcagggaaagactctgtggggagccacccaggggatgtttatgtctctatacgtcccggactggcaagtgactagctgccttgtgtacataaccaggtgccgcccacagtggctgctgccatctgctctctctccttgatgacttcagcccccagggtggattaggcaaaaactccttctctaaggagagcccagggtaagtgcaagtctctgccaagccttgggctgatttgtattgttcttgtctgcctacgttcagactgaagaaaggaggcgtaagtcctcattatggcagaacccacgtccagccatgtagctggactgagcctgatagagtctcatcaacccagttagaaatgtttgccaaggtgttttacacattatcttatacagtcctcacaccaacccaatggagtgtaggcgtgattacctccattctacttataaggaaactgaggttcaaaggttctgtaacttacattatacagctaatggtagcagaaatagccttctgacttcaaattctatatggtttctagtgttcagtgctacagagagataaagaagtaactattgtttaaatagtgcttagatgtgctatacatatgttgacttgtttagtcttcagtacaatcctaataggtaggtgctaatattatcccccatttacagaggtgggaactgaatcacagaggtattaccgaacatgcccagtcttgctcctggttaatggcagaggcaggtttcaaacccaggtcagtgtggcagtgctcttagccgctaagctggactctcccacatgccacattccaataagcctgagagctgataggaaaagaccagtgaaaactgtaatacgttggaatacaaggaaatgttcaaagagtattttatcactttctgttgtaactctaacatccaacaaaatatcactcaaagaagatgttttgtgatgagctttaattaattaataagtcccatttgcagttagcacattacttgcatgcaaatgatgcttctaaggtgcttgaaaggtatttattttgataggttaagactaagcagtcactctggcaaatgctttattcttttatattcttattggaaaggctgtaataaacttatgttgaatcatgttctttaaaaggacaatttaaggttgtctcccagtaattagtgggatatggatgagggcccataggctgccatatagaataaaatgactgcagattccatattggtggattccgaatgctggacacttgaatgtactctcgtgcctacagtgtggacatgactttttgttctgacacggaaatacccctttttacctctctagccgcctcatcgctttctattccaagcttgaaatgttacccctcctggacagaatggacaagccattcttaccatcacctgtgtacatgatagggttgtaattcatgaatttattcaataagccagacataaagtgagttgtaccttcagggcagttttttaaatgctgcaacagaagagccatagataagcatggcttttctcactgagaaatttaaaattaagttagcacactaagaattgtcctccctgcccccgctcccctccttgggctcacaagcacacacattgatcttccctgctagattaccataggtccaggggattgaccttagtttctcctctagccttagatccaatcactcaagtagtaaagaataagaacaaaagtattgatccagtcatggaacagtaattatttctctcagatggtcgtttagaatgcagcaataattttaaataatgtattcctcagagacagcatgacaacatatgtggattatttagttggtgcgtttaagtaagttacacttgcaccctcacccctttactggacgtccaatgctgtgcaaggaggcctactttaagaagagtagacattgagaaaaatcagagtttacccaacaaatcaattaccaagcaattgttcattataaaggggcttatccattttctgtagctggacaaaataatggacctccacatgctcacatgcttacagtgcaactccacccttccgtatgaagagacttcatgaagtcattggatccttttgaaactcttaagttgtaacagctttgactgtgtttatgttaatagagttaccttttaaagactctttttgtttcaaataacatacattaaactaacaaataatgaaatgtttaggcttttggaatttaaatgtgttaaaataaccaaaccatcagaagggcagagccaggcaactggatatcagaaacagtgagcagagggctaaatgccctccttgctttgtctctacttatttttgcccgtccacttgaatcttgataatttcggagacttcgtttctccttttggtagaaatcatgacccatccacttttcagttttagctacaggcagagagactgtctctccttttccactgccattgctaagatccaagggagagattctgactggctgagattagctcaggaaaggattgtgggttggtgtaacttaagccaggtgcttacacctggattggtcagttatgggtagagagacgggaccatgttgtccaaatgtgcttctctagaggtgcctctgtacatggtgctggagtcagtagagaacccagaaagttaggagttgggcctgcagcagtgggttctaggaagcaaaacctaatcttcctgccatttggatgaggcactacttacaggcataaattcttgacagccatagaagctgcctgggtcatccaaagttgacactttatagtgatcacaaaatctcaaatatggatacgtatttacaattatgtataataattgcctaaatattcatagagtcattttaagtgctattcacagattagttctatcttgcttaagctattaaaagccatagaaatacacaggattttgtagagtgagagttcatgtgtacatgcacttagaaaagtccagaatttattaatattttaagtacacctatagtagctaatgaattactcccctgccccacccaagtataagacagccaccttgagagacacaaagatctcaaggaatgtcaattagtaaattacatatctagggtacaaaatgaaacttctttgtccaaagggattgtggtcaacctggagaatccaatttgcatgccatgcagtactacttaaacttcagcaggcagccttcctgaagtgatgttcctaagactagaaaatagtaactcactcatagcttctttcactcatgtttcattcaacaaatttaatcctcacttgtatgctaagccaagcactgtcatgggaactagggatgggaagaagacaaagacatagaaaaccttcagggaaatatggcctaattgaagggaaagctgaggtacctagatgaattacaagaccccgtagcgtatgctgtttctgaggaatggcatgatgtctgaatgcaaaaaactgagccatactctgtaagggaggaagcaattgagttagatcttgctgcagcacatggaatagatgttactaggtagcaagaatggggtagatcacaggcaaaggggatatcatttgcaaataacagagttaggaaaggcttagcatgtggagagaagcatgaaaacttctgtttgtttggtcagggtccatggcagtgttggggggaagatgagactgtaaacatatgttggtatacacagttccataaaaacaggccttgcacggcaagatgagagtttggacttgatccagatggaagccactgggtaccttatgtaggtgaatgacacatcagaattgacattttggaggaggattcaggcagtggcatgaaggatggagtgaaagggggtgaaagttgtcataatgggggatttgagaggtgatagagatctcaaccaaactaatgtggaaagaaggagtctgattttagaggcatttctgaagtgatgattttgtgaccactgggaaggggggtcaagggaggaatcgtggatgactcaggtttcaagtcaggctgactgggtcagtattgatgatgccatcaatcacacagcgaaagtggggggatggagaaaataggagctcagggaggggctttcaggaccttcagctggatgaggtcagaagagagtacatattgatgatgcaggagtgatcccaattttagttcagtgtctgggagacaaaactaccttagtagcagagatggagctataggggaatgagtgggaggccagccagaacactgggattttgtctgtgtctacaggaataaatatacgtggtgatgataaccattaaaaacaaaataaatactggggactagtagagagggaaggtagggaggaaggcaagagttgaataactattgggtaccatgctcactacctgggtaatgggatcattagaagcccaaacctcagtatcactcaatatacccatgtaacaaacatacacatgtacccccgaatctaaaataaaaattgaaattattttttaaactacaaaataactgtatattaatcgtagcacttgatatttgtatagcttttttttttactgtacatatctttattttttcatttgtggcaaaatacacataacataaaatttaccatcctaaccatttttaaatgtacatttcagtagtaatggtaagcacactcacatggttgtgcaacctatgtagtttttttatgccacatgtgttaaagtaccatatatagttcatttaaacctcataagaaacaccctggatgaaaggatgttaaatatttattttagaaatgaggaactttgaaacgggatgaactgaaacaaagtcgtaatgctttggtgataatatccccatgccttctagggtcagtattggggttataccacagtatccttagtgatgatattttaacatctaacttccagtggaccaaacagtaactcacttatagcctgagatcctattgctttccttaaggaaactggaatggaatcagccccacagcatgaactgggccacccagcagcagccaggtcgccgctctgagaggtctggttctgaggggctctgtgggagtaagacagcatgaggccatatagctttggatataggaaacgcctagaaaggtagagagatatgataccacacttccagctctagcaacatagtgctgtgtgactgcggccttgggcagtttactaatgcttctaagcttctgcttttgtgtttttttgtttttgttgttgttgttgtttttccttttaaaaatctagatataaaatacctagaattatatggcccataatagtaactactcaggtcaggcactgtgactcacacctgtaatcccagcactttgggaggccaaggtgtagaccaacctgagtaacatggtgaaaccccatctctacaaaaaaaataaaaattagtcagatgtggtggcaagtgcctgtagtcccagctaattgggaggctgagggaggaggattgcgtgagcccgggaggcggaggttgcagtgagctgagattgcaccactgcactccagtctgggcgacagagcaagatcctgtctcaataatactactattaataataataaggattcagtaaattttacatttcagtcccttccaccctgtttcctcctgctggtcccccaccattgaccgacttaccctgcaaaaaaccataacacacattagcaagattcatttattacagccaaatcagcaccccaggatcaggccttttaggaaatgggatccaaaacataagtgtcttaaagaggtagaagatcagagggctttgaaacatggccatgtcatcagtctgaaatttagaaagaagttccctgtggcaagagaatccgcaggaaatcactaagctttggaggcccaggatatacccagtaaagcacaggcggtgggcccccaagggaagatggacagcaaagacagcctttataatctgagtagatttcacccatgtccccctccacctaagctctggttttcctttagaggaggcttttaacttaattcctgttgaatttactaatgttgtgtggtgtgagattttaagtatcttctccagcctcctgggcccctctctcctcccctgtcccttccccacctccctatcctgtcttgaacttccaaccccaagagctcttctttacactgtttgctaaaatggagcctcttgtgtgatgcatacccaggaggtgaagctttcaggggtcctaatgtgtgcttcaggataagggcaccatgggtcccctgcctgccagtgtgcccctcaaagaatgtgggctttggcaacatggcattaattcactgccaatgaaacaatgatgggaattttaatgatagcgttgctgtctaaaagatgacgggggagacttctcagcgtctgtgatccagaaaacacactttctagtaagtatctcttatggtcagaagtgagagtgaaatctctgtcagtccttcctaagcattaccttggcaagcgctacagagcaatgtaacataggatgtgttcagtttaagtaacagaatgcctgatagtggctttgtccgtgtattagtttcctgtggctgttctaatgaattatcacaaacttggcggcttaaaacagtagaaatgtatcttcttggcatgctggatgctagaagttaagcatcagtttcactgggccaaaatcaaggcatcagcagggccacattcctcccagacgctctaaaggagaattgttccttgccttgtccagcttctggttgccaccagcattccttggctctggcagcatcattctcatctctgcctctgtcttcatgtggccttttcctctttcgtgtgtctcatctccgcctgcctctctcctataaggacactcgtggtggcatttagggcctatccagataatccaagaaaatctcacttcgggattcttaattagtcctatctgcaaagatactttttccttgtaaggtaacatttgcgggccttacaaaacacattcaaggcagacaaggagacaggcggtcatgtgtcctgtatgtccccttggctagaagagtccattcctaagtgtgagagagaaaggaaaagcaaagatctggcaaagaggggcaaggatttccatgacccatcatgattgtcccctgtgggttggcgttgtgctgtcttctgttagcaagaaagaggcggaggacatagtttgtgggtggtcgaagaactatgactgccaccaaggatgcgggcttccacacccccagtgtgtcagacaaaaagatctgaatgggggtctctctttttttggggaaggtaacgctgttttttaacgctattaaaaatctagatataaaggccaggtgtggtgtctcacgcctgtaatcccaacactttgggaggccgaggcgggtggatcacctgaggtcaggagttcgagaccagcctggccaacatggtgaaaccccgtctctactaaaaatacaaaaaaattagctggacgtggtggcaggcacctgtaatcccagctactctggaggctcaggcaggagaatcgcttgaacccaggaggcagaggttgcagtaagccgagatcacgccattgcactccaccctgggtaacaagagtgaaacaaaaaactccatctcaaaaacaaaaaataaaaatttatatataaaatacctagaatgatgtggcccgtaatagtaactactcgggccgggcacggtgactcacacctgtaatcccagcactttgcgactgagcgtttccctgctcagtcacactgataaaccaccatcgcctttgagtttctaactctgcctatctctggaatccactgaggaggaaagtgggcttaaggtttggtcttggattctgaaggtgcagacctcatcaccacctgctgctgtgcaaagcacactactggacctctctagaacctcagcaagaattcatacctcccaaggctgtggcaaagatgaaatgcaggcctcgggagtgctttgagctctagaccattccacgagctgctgttcctgttgtcactggacagtagggcccactgctgcttcatagcctaaagccaggtggagggagtccagtacccttgttgattctttgcttccctttcccttgtcagccacacccaccacacagacttccacatacccatgtgttgttgttgtttgtttgtttatgttcgtttgccagttctgacttaggagcaagcctttggtgctgaagttggtactgttctcactcctgaatgtaatgcccataatggatggagaatgtcaggggaattgtgggtaatagtaagattactgtcatattcccaaaccctggggtgggtgggaagaagcccctaaccatgcagctttatttccactgtgcttgtggtggggcctggaccaccttattcctggtggccttcatcttgggtgctacaggtggcaatggcaaggactgaagtggggagagtgaagatgcccgcagcatctgtgcctggccctggctcattcgtctgattggattgttagcaagccaaatatgacctggcctgcagggtacaagaagacatggaatacctggtaggcagctagataggaacgcgggacttcccagcagctgagcgtggagaggtggttccctacctggctacacatcacagtcactcagagtgctgtgctcagagaggcactttggcaataccctggacattccgattcagaagtttcttaggcaggtgtggtggctcatgcctgtagtttcagctacttcaagaggccaaggtgggaggatcacttgaggccaggagttcaaggctgcagtgagctgtgatcatgccactgcacttcagcctgggtgacagagtgagactctgtcgctacaattaaaaaaaagaagtttccaggtgaggtacaggaatctatatttctaaaagcaaccctgggactactgatgcatagcctgcctggcaaatacacagtttttaggagaaaaccatgagctttggggtcagggaaacctgtttttggtaacagctgtgctacttactagccatgtgagctttgtcagtcacctaccggcctctaaacttcagtatcctcagctttaaagctagtgtggtactaatacctgcctcacaggattgctgtgaggatgtaataagatgtttatgcacaggttatatgtatgcacatcatggtgctttaaaaaccctcaacttccccctaacccagcacggaagttcaagggcagactggcccactggctttggctctggtgcccccagccacttcccaccaactccatccatgtaagatttacatagccatggccaaattgttactgcaattaacaatcacacctaaaagcttttacttttacttttactttacttaaagggaactcttaaagagtgtttacttcatatcattagcaaatcattgttaattcttgtgatactcaccgtaataacatctatccaaatgaacatgtttgctcttaatgcgagtgtcatgtgcaatttgggagaaattctgttgtcatttagcattaattaatgcccacttactgtaaagtgttcagagacaccaatatcagcgagatttccagaccacatagacaggacagaagagctgggaaggggccagaagccactagcagggctgcactgtgactgaaggcagtggccctgggcacacttctctgctgagggcaggcaggccagccttctggctggaggatctaggtgtccacccataggtgttcagagcacacaactgggccatcccagcctggctccactcactgtggctggaaggggttctgcctctccatccccagcccttcaatcccacacaaccacctctgatgacctctcctcccagctgcagccaccttggatgttgatttttaacctgatttcacctggctgcacatgtcagctggtgggccctggagtgtgaagtgtgacttgcttgggcccctgcagccttgcctccctgcagcgacttcctgcagtttgactttggggcagcggctgccggagaagcctgaaagttgagctcaggaagtcatcttcatctccacccccaagcaggtgcttgatcaggactgtttattaatgtgttctattttctcaaatgcgtcctccaaaacagagtgtgtgtgagatactactcctgtgcctgggacagtcagtgtgacagtgaacagtgctgctctaggtgtggggacacagccttacgttccctttcttccaggcagctcagtgtagtggaaactacaataactgaccggggctgtgcccaccagctgtgtgagggggcctcagttttcccacctgtaaacggggctcactttacccaccccgtggaatggtttaattaggtgtgatgaagtcctgcatgccacaggtggtgcttagtagccatcgccttattaaaaatgccagtgatcaccgaggatcatgatttccctccccttgtgtccacacctcagacacgtcctctctccttctggaggggtaggaacagaggaacagtgcctctcacctgaggagggaacttctctgaatccaccaggaaacccagtcacaaatcacacagaagcagtgttcattttttctgtccacaaccaatatgactaaagtacggtggaaagacaagtattttttgtcctggtgaggaaaggtgccttgatatgtactttttttctgccttgtggatggactgcattggacagaggtgggggtggtggagggagtggaatttaccatggtggtacaaatgagtcagtctgctcaatagggatgtgtcccatacagagccgcagatgcctggtttaaaagactcaggctgcagttaactatgctaaactcaaattttactgagtggaatttagtctttctctgatgattaaaaggcccttcagaatcttctgagccgttttgttgaacagtgcttttttgttacttcctgggtgtaggaaatggtggggaacagagggttttgctggaacacccactggacttgtgtgtcctcctctcggtttctaagggcccctcaggccacacgcctcccatttccaagagagtgagaggggcctagaaaaggctgaacacaaagccccacaaccgccaaattccctttcaagggtgttacttagtaaacatgagcccttgagcccacattcttccagactgtgtctgcctcaggccacccctccttctagaaggagcagtgggggccctggcaggaggctgccggctcagcctggagtggcccacagcaatgctccaattcacagtgaaatgatttcctctgcctcgtataatttaacctgcccacattgctaaacttctatattacacatttctgtcaggatgtcagaagaaatgataagcctccttgaaacagcaacctctattacatgctaagagcattgcgcctggctccccccagctctggtccttctggtatgtttctgagatttttagcatggtctctcaagtataaagaataccctacttcatgaccccagcctcttgttagctgatagatgaaatcttttctaaagctgactctcttgtctattatgttttcaaaattcaaggttttagattcttggatggctgccaagtggccgggctttcttagtaggtgaattgctcctctctttttttgatccttaaacaggaagtagttgttttttagggtggagggaagcgggaggcatgttccacctcccttctccctttgttgatgtttccaggcaattggtggggaattttttcaggaatttctcctcggggaccatactttaggaataaacccaaacacggaaaagccatttccttgtctggtgggagcttgtgttttctcgctagattgtgtcacccagaatttgttgtggagcttcttgacaattgtgctgtgcacgtgactgcagcatggaccactgagggggaatagcaccaagctgctccatccacacgggagacacttgcgagatctcagggccatggacagtgcagctgcctgtcgctccctgcaacttactcccgacccgggcctcctcagagacagccacaatgcagacagtccacacataggatggctcaggactctcttcattattagctgtggttgtgtggtttccccgggagagagaactaagactgagtttcatttaaacctaaaagtgaggaagaacagatgccatattcctacccttagttgttaatttggattacaaacacccatgcttttcttcaggtcattagtcatgtggcttttttcttctttgtctcactagattctgtgggaacagatttctttctgcatagcatttagtggtgggaaaatgatgtttgctgaccatccttgaaattgaggcacaatgtagttcttgattaggaagactctggaataagcgcccaggagaaatggaaggtgtttggtttccaaaagtggtaccttcaactctttttgtaagctgagtgtgtttctctccaaagttcctagcccattagtgaactgtcatacacttcaaggccagctcaccactccgatagctaagctgtcatacatagtccagggtccgtgtgagccccagctcttttaaaactcctggctggctgtgtccagagaagacattcttatcagttttctcagttacttttgggaaaccatctcagagtgtaacctaagtctaaactcagacaaggcactgtgtgttttacaaaatacacatcccactcacctgggcttaattacctgtaaaactgaagtaatgaaagcagtgcctcaggcttctttgcagctcaaaggggatgggccagggattggaatgtagacctgggagcttcctttgggtgcctcctggatgaactgcactgtaggttcagtgagactccttccgggataagccaaggacaacagagccagactgtggggcagagggtctcatggtcctcatggcaaagccagccccagccctcagtgtgccctcatgactatgagtccagtctttacaacaggaacataacaattctacagaagggtggaggatctaacactgaacaagcaaggccccatggaccaggcccccaatagacgttacttcattcagtcatccccacagccccgggaggtggaggcatcactttccataccgtatagaggagggaactccccaccaactagtgaagtttaaaaccagcattccaagcagggctgcccagctaccctgcctactttgtcctgttgctgcatcttctctctgattcccctgaagtctgtgcgaagtgccacaggaggtcgaaggagggaccagaaaggtgagggtttcccggaagtagtggaagcggaccgtgtcctgagaggtccccagcccgagaaggaggcagccaacctcagcaaggacagcctggtctttttttttttttttttttttttttttttgagatggagtttcgcttgtgtcacccaggctggagtgcaatggcacgatcttggctcactgcaagctccacttcccaggttcaagtgattctccggcctcagcctcctgagtagctgggattacaggcatgtgccaccatgcctggctaatttttatacttttagtagagatggggtttcaccatgttggccaggctggtctcgaactcctgacctcaggtgatccacccgcttcaacctcccaaagtgctgggattacaagcctgagccaccccacccgctgagcctggtcttagagtggggtcagcttcggcttcctattgtgagaatcaggcctctggcacttatcagccctgaggcctggcttaatttacttcgaatgtctctgtctccatttcctggtctgtaaggtatcactggaagtgttctcaaccctttagtatgctttagtgtgagaaagcttgtaaaaatgcctgcatggtgccttgctggtgcccagtcagtcctgcatttctcggctctgcaaaatcacagacacatggaatgggatggtatgccccagaagaactgggggattgggagacctggcaggtgtgagccctgggtttgggaagggcagaaggtaagtggtgacagataagtctaggaaggcatttgggtgtcaggtcataaaggaccttgaaaaaccaacccctgggttagttgaagctttggtttagtttggtttcacggaggaacaggatgatgagatttttctttaggggaagatgacggcagcaataagagtgttggaaaagtcaccctgaacaacttttgtaggtaacttaagggcagaaaaaaggaactctttatttttcaagtggcatcatggctatcacagctcatcagtgcctggaacaacacctttaataatgtcaataggaacgcttcgaactgctgcagaaattctgcttcctgaatgtttgaacttaccctcccatttaatctttaaaccatcccttcaagagagggaggacacaagggtttttctcaattatgtaccactgtgagcttggcttagttaccaaaggctgatgatgggctcagcagtgggatccgagtccctgcgttcccacccaggcttcccaccattttcctcttaggtgcgcatccgctttgaagctgcattctctctgagacatgtggtggtaatgataatgttaatactagtaatgatcatagtaatcgctaacattgagaaagcatttacttattatatgccaggaatacgttgctagttttgaattgttttgtgtaattatcatctcctctttccaactaagaaaactgaacggtaatgagataaattaccctaggacacataacaagggtgtggtaggatagaaccacacccttcccaggtgaggagttgcctgtcatttctcagggtcctccgtggcacctggggacaggtggaggtgggcgtgggttgtcaggacatcaggggcctaactctgactctgcgtcaatcagagaagcttgatttttatctgtttcattggcctttctcaaaagagttgatttgagaaagtgttttttaaatagctttttaaagcggaaaggggccgtgtgcgctggctaatgcctgtaatcccagcatattgggaggctgaggtaggcagatcacctgaggtcaggagtttgagaccagcctggccaacatggtgaaaccccatctctatgagaaatacaaaaattatccaggtgtggtggcatgcgtctgtagtcccagctactcaggaggctgaggcgggagaatcacttgaacctggatggcggaggttgcagtgagccgagattgagtcactgcactccagcctgggtgatagagcaagactccgtgtcgaaaaaacaaaaacaaaataaaaataataaaataaagtggataggggttgattggggtttttcttttttggaaaaaagcaattaaaaagaagatggattgatagatacataatgagctgggtagatggggagacacatgataaagcaagtgtagtacagtgttaataaagtcagtggtgggtatataggtattcactctaaaataccacttttctctatgtttgaaaattttcataataaaatgttggaggagaaactagccaagtaaataatttctaagggcccttccaattttttaaaaaattttatttcctgcacttctctctacatcctatagttgtgatcatgtacaaccatgacgtgatcattaatctagatagatctcctagtcaccactggatgttgccactaaaaaaaaatctaggctgggtgcagtggctcacacctgtaatcccagcactgtgagaggccaaggtgagtggatcatctgaggtcaggagttcgagactaggcagaacaatatggtgaaaccccctctctgctaaaaatataaaaattagccaggtgtggtggcaggtgcctgtagtcacagctactcgggaggctgaggcagggagaattgcttgaacccgggaagcggagattgcagtgacccgagattgcgccactgcactccagcctgggtgacagagcgagactccgtctcaaaaaaaaaaaaaatctgctggggagaacaaagtcaatcatcactcatttggttctccaactacctgagcctaaattttgattggcaagtttggttgggttcagatactttcactagaaagccgtaggcctgtgagtctccagatgaaaggtgggtttagatctacacatctcctgtttcagggcagtgagctgttttggacccatctctagtagaagtttcttggagctctccagccacaataaaggtacagtgttcctgttcactcactttggcagagccttgaaaaggagcacagagacggtcaaatagtaaaatctaaaaacccgtagaaaaccctagcagaaagtattcttaaagacccagctgtatttttctgttcataagacccagataagcatagtcttcccatttgacattctgactttaacatgagagggagtttcatgcccccttggtaggacattggagtacttgttgcagcgtgcaagaagtggactttgtccagcttatatttagaataaccttgccagcacattccagggagttgatcaaggagttttgccaaactgtgataaatcagcacattgagcagcctctgatggctgataagcttgggagtgccagttaattgacaagaaccgcacttgtcaatcttttgaggtcatggaaatggatctcttgtctttctgcccttccccaagtcttcacccgcttgctctttggtagattgagcatggccttgcactgcatggagcacacctcccacctttgttcttgtgtgtttgctgagtaattaatctcattgtgctagtatggaaatagtctattaaaacattccggaggacaccatggagagggaggaaggaggatgaagactggcggagggagtagtttgctctgtttaattggttctttcacctaatggtagtttgtcaattaaggggatacttagagaaagtgaaattaatccatgtgggtcaaatgcagctattaatttttaatcaaaacacaatgttcaacaaatctgtagctgtgcttagtacaaatgtaagcatgccaccagcctcttcccaaaggatgtgggagcaggcacaggaaaggggggcctgttaatctagcaaatgtttgcctcctcccacactccctgtgaccctgaggtaagctccgcagagcttcgttcttgtctcttcaccatctattgcattgcctaacacatggtagatgctcagtgatattgctcttctggaactctttccatccctattatgtgcacagctttggagtacctcaaataggttttaggcataacagctattctctaagagctcctagcctgcttgagaaagcagaggaggcagttatgaatgcatccccaagtcactcagagcaacgtacaatcaagtacaagaatgtgtgataaaccgtggcatttgttgagcacttgctatatgccagatacttttaagcacttcacataaaccaagttttttaatctttgcaacaacacaataaaataagtaccatttttatcatcctattcataaataaggtcactgaggcccagaacatttaggtaacttgcctagggtctcacggctagtacaattagtctgctagagggttgcattcattacctaatattataagacccagagttgtcccaagagagctggcattgatcaggggttaaggtatgagtttattttggaaagtgccagaataagatgctccaggtagttggaatggtaatcagcacggttttgtggaaaaggagtgcatttctggttaactggaatatgaggttggtgaggttgaggtaggtctaggttaatacactttcagggtcttggataccaggatgagaaattttcatgtcggttattctgggatttctttattgtttatgggttgtttcactttggaggagcaagtcccgttcctctatttctgcacttgggcattgtgccctcatcattatctctcttacctcctctgcctccctccatctggcatctttcttctcatttatggcatccttagctcctcctgcttcccatttttagagagagggagagagaagagaaaatcaagaaagtacaccagccggcctacttctactgactttcagaggttgaatgaagcttttctcagccctctgccctcacctcagtttggtcctggaactttgagaggaaaaacaccagaaggacttggcctcaggaagttttcttctgcctccccttactgagcagaaagcaggttggaggaaccacttggctctgtgacatttatagtgacatggtttggagaggtcaggaaggactgtcccagtggtgtctcttcaggctgctcacaactgcctgaaacctctcagtaggagaggtttctcatgatccagtgaaaaatcaggcttcaggtgtacatagtttaggataggctacagggtatgttaaattccttcacattggccagaagctggagaaatgtgaggacaggtaaaatccttggatattttcttctttacttccaaggtagcttacaacctggcctcttgaagtcattgggctgatgataactggtggaaatttgcaggtaattgccaatgacaatgagggagagaattggggaatagaggggccctatgaagaggatcctctgcctcgtattccatgcagtcctatgggctgctgcagtaaacctgggaggtcatcaggattaccacaaagactcgtgattgggtgggtgtccctctgggcagcctagtttccctagacatacaacacgtgttcttctccagcagtgcaaagctgagaaggggcctgagtaatcgttctggtcttgctccaggaggcaaagccacagctgtctgtgtacccccatgcaagtgggcaggaggggttccagcaaggctgcttgctgggggagacagggtggagggaggaacagcgactctggatcatagagcagaggtcagggaagcacagttaggatggaaagtctcgggcagaaggtgggtagaggtggataggcagtgtacatggtgtttcaccatgtcatcttgaccaggaacacggtggagagaacagatatagctgactctgtgtgatcagtgattttaaaatgacactagtgtcagactcttaaccagcaagggaacacatcttgtaaatctgggaaaactaggtagcccaaagggacacccacccaaacaagagtccttcatgttgaagaagaagaagcacttcttgataaacaatgaaacaagctgatatggaagaaattgttatgtcatgggaaggaggacatttttggtacctaatgattaatatgaaataataattatgtagtgattatatccttgcctctcaatctaagaatactcagaacattgtcatagtgaatttcagtatcttctatgtgaaaagcagcttagctagtgatatctgttattcatgcattcattttttctttcctttgccatatatttaccaaaacctaatctctgctaggtagtgaataaggcttttgggatgcggcaacaaacaaaatgggcatgttcactgcccttaaaatgtaaggtgaaatacaacctttatagtgtccactttcctgcgatggttaaggttttcttcgtggacaaatacatgatcaattctatagctattccatgcacatataaagaaaagtgaataatacctgttcacaatctcaaaatacctgttaaataaaatgtatcaattttaaacattagtgtgagacaaaaacattaagtaacagattgtgtgcgtgtgtgcaggcatgtacagttagtcttgaaaagatcaattgggagtcagtggagcatttaaagcagggatagacatgatcagatttgtcatttaaacggtaactttggcagctgtgtggaggacggattgagggaggccagagtgaagatcagcagtgaggagagactgttacccaggtgagagaggatggtgactcagagtaggcaatgtgggggctgagagaagaaaaggagctaaattcttcttggagatcaaataagcaagatttggcaactgatggaagagaatgtaaaacaattatctacttcctaggttggttgtgggaactaaatgagacattattcgcttcattttacaaacaaggaaatagagactccaaagtgattgagataaacgtctgacttccacacagcctttgatctctctactgcacaaggcataaaaagggtgtaaacagaggtagattcacccaggctaatggctgaaagcctcaaggcccttcacttgctgggatctcatccaaggcctcatacctaattttatattcataactttgtattcattttcttaaaaagcaccctccacaagggtttaagcttcagactccaggaaacctctatctacctctggccaagtaagtaacctcattgggtaggactgaaacttgatgggatgagacctaggatcaaaatctgacccagcaggcagagaaagtagtgtgtttaggttgggatcaactgggagagaaacagatgccatattggaggcataacaaaaatataactgttagtgtttattgaatacttcttgtgtcaaacagtgtatttattgactttgattttttgggggaagtttcttgtattatatcacttaattcttatacaacccaacagggtggttgctttcattatccccattttatatgtgaggaaagtaagccctggtaagagtaagtaaattaacaaagtatcacaatactaagcaggtgagcagcactggcatcttacaggcctgactttgatgtttgaggctgtccttaacctccactgctagagggactgtggtccgaagccagcacctctgatagattcttgacatgtgctgggcatttcctctcctagaggttggaggaagcaaggtctaattctgtcctgctcctttccaaaaaggaattgcttggtgaaatgtcagtgggagaaagtaatcaccccaccttcagatacagagttgaggacttatctgacatgtgccggagaagacaagaagattctgaggcttgaggccgaaggagggcatcaagagactccagcagccttattttgttattatgcggttgttattttgactcaacagttggctctggtgaaggggagagatggggcttatatgcaacaacaagtgagggcgatttgagggaaaacatgtgacccagactaggagcattgtgtccacattaactgaagctcacagaaatcctaaggataagtagggttttcagcgtaattttgttttttatgttctgatcaagattaagaaaaggaggctttgtcctttgatggaaggtgtggtgttgatggatgacccagagaaagcagagaggttcacctcctgctctaccttcctgtccagaacatgatctttagaaggaaaggtatagaattttcttggcttaaagggactttagatccaagatcagtaaagagattgccttgaagatttaaatgagctcacgttttcctgacctggacaagttacctccccacatgctgagagatcttgtaaatgaaatcactgacccctccctgccagagatgttggagaaaggtgggacatcaggagagaggctgggagactagaggggggcaaatacattgcgaaatttttaaagagaaaggagtgttctgtagccacaggtcagtgagcatcaggtgctctacaggatcctagacccggtcagcatggagcaggctggtgaagaggaagcaggaatcaaagagtcgggtcactaagactggtcactggagcttagcacctttttttttttaacaagcttactaggcagttaccaaaagtggaaagggcagtcttactccctcttctcaaggtcttcgacaaggtcttttatgaagcctttgtggattcggtgggaaactgtggagtggctgcagcaaattggtgaatttgttgaactgaccaagttgatggtcgctctacagtttcgtcacgggactctgccctatataaaataatcgtcagtagttgggtaataattattctgcaccaaagttgcagaagacagaaagttgtgaggaaaacagatagcttcagatggccaagtcagaatttgaaaaagaaaactcattcatacagtcaacaagtatttgagtgtctgttacatgccagtcatatatccatcacggagcagctacttctgggttgattctcctagtatggatggtaagcaatgaagaaatgtgtgtggtgtctgcatgcaatgtcagatgatggtaaagaatatggaggaaaaatttaaagtcttaggagataagagcaaggtgtgaggggggtgctattatgatacagtgatcaggggcagcttctctaaggaagggcccaaataaagagaagctggtagatacccacaaatctgggggaaaactatacctggtataggcaacagcaagagcaaaggccctgaggctggaacatgtttggcatctctagaaagcctgagtagctggatatcagtgagagcaagcatgagaggtcagagcacagcttgtccttgcaggctatgggggatatcagatgtcctgagggagagggaagccactggaagcttttttgatatataattgataagatccgactcgtggtttgtttttgttttgttttgttttctttttaattgagtcagagtcttgctctgttgccccgcctgcagtgcagaaatgtggtctaggctcactgcaacctccacctcctgggttcaagcgattctcctgcctcagcctcttgagtagctaggaatacaggcacccgccaccacgcccggctaattttttatttttagtagagatggggttttgccaggttggccaggctggtctggaactcctgacctcaggtgatccgcctgccttggcctcccaaagtactgggattacaggcatgagccaccgcgcccagccaggttcatggttttagagactcagtctggagataagcttagcacagtgtgatgggctggctcttcaaggatagcatgacacacatggcttagcaatggtagatgcgagaaaggcctagaaattttagtaaaaattcaccctaatattagcaacagtgttatttgcctgaggaaaaaactaacagtattaaatggtatttggtatttacagtgactggtagggattggtttttaccctccctcccctgcccaatctctgaagtcttttaggataagaaccgattggttaacaaagcttcctggatgaactcagcaccttattcagctggccactgccagccccaaccaacagagaaaggagcatcagtgaaccagttctggtgaaccagttcaccccactgtgaaaactcaaaacccaggagatgtggtagatggaaataaggatgtttaaggtaaagagagcctcatggtcaaggtgaatcactggattcagatgtttggaagtctgctcaatagagagaggagattaaatttggccacagcagttagtactgtgacagatttcttttccatatataaaatatgcttcctagagtcaacgctatctaaacatggactgggcccacgcagcatctggctcatccctggacgtgtatgtaaactgaggctggataagctttgggtgcagttatgtagagacttaagtcagtaaatggacacaatgcagtctgataaaggaaagagggtggaggcggggagacaatcaggaggagaaaagaggcagagaagtagaagcctgtggttgtggagatggtctgtaaccccaccgggagcagcagcatctgaactggttctccccttgctcccctttcttttgccctccagccaaaccagtaacaaagggcattgtctagtagtctgtgtcagcaataaaagccatggggatctgacccgcggcagtgtgtttcagcctgcgaacttcctggatatctttacggggaatcattcccggggaaggaagggcaggctggaaataatataaggagatcaagaaggaagtcgagcaagtgacacctttaaacaggccaagcgagccgggctcttccccctgggacagttagagttatgcagagctgtaattaacccagcagcccactggatatgtctatttcaccgcacaaaggctgttgaaagaaggattcttgaagaaagaggttccaattcaaatggtatttgagtaagtcccttgtcggatatactgtttctagagtttatggctataatcaacaaaacatggccattctttcatgcaggtttctcatgactttctgaataccaatctttagaaagaaaaggggaaaaaaaaggcatccagaattgtctaggggtagaatgggggaaagggaaggagggggaaatatggctcgaatcaaattaaggacttggttttcttttcagaggatgttgaaaacatttaaaaagcaggtgtgtccttctttcataaatgaagactctgagatatgtaagaaaattttcagttgtgtattcaagtccctcaaaatcattttatcaacctccctaatttcaattaattttttaacaaatattttttgtatgcctaccctatattaggcactattataggcgctggggatattaatatctctctcctgccttcctggagctaatagtggggagagatagacaaaaacgtttaagtatgtagactaattggtgtgtgagatgatgtgctatagagagaaaaatagcagggagggaaatacagtggggagggatgcaaggaaggccttgctgagaaggtggcatttaagcgaagatctgaaggaggtgagatgtggatccggtgggtgtatgcgtggtggggtcagcgggtggggagagacagcagtgcaggcagtgtgcacagggattcgtaaggtagcagtgtccatggtagtgtgtgtgaggaatagcaagcaggctgaccgggccagagtggagagggggagagccagagcactgggagatgagggcagagaggtcagttatggctggagtctgcctttgccctcaataaggcacccattcagttactcaagtgggccagcacacagtggtgtgtcctcccacatgctctgagtactggccattcagaatggttcccatcacacttaaaaccgtagagaataaaattacattgtcactgtgctactcttcacccttggatagtcctagagtcctttggcgtagcttttacatagtgtgccacatcccactgtactccctttcctgagaacagactgatggaccgagttacgatttatatgagagaaccccaaatcagaattcctagccatgtctaatttatatatcagcaggcaagttgttttgtttcttgtttgggttttggggcttctgttttggggtggggtttttttttttttcccagtaccgtaacttataatctcagatcatggaagagcattctctaatgagctttctaaagccaagagctctacccagttgctgggtaaaggggggaacatggagaattagaatgtttacattgtaactgatttatgtacactatatttgcatgtaagtgtactaaaatattttttaaaattaccagccattaaaaatgtgtttgctaatggggataagaatgctggatacaatgaggtaagctttgtttaaaaggatttaggagactcacaattcataatcaatatttcaacacactcgtctgcatttttagggcaatagatctgtaagtagaaacaggcgtatttgaagaaaaacattagtttctgagatctggccagctcctgttcttaccactctgtcatctctgattggattagacgtcacagaaagggcctcagatccttgtttcacgttaagtttaaccactccagttgaataccatccttgtggagctcagtggagagaaattaaatttctatcaccagaagtatggcactgaatcaggtatcaagggggctacatcagtaaacttcgttggctacaagatgtatgtccttcctgaggctctgtagctgttaagttggctctttccaatcacagtctgatctttcattttcccgtaatgcagttagacaacctagttattcaggcatagacttctctgtttttcattatccctgaataacatttgatgctgaaatagggaagacgggaaggacgggggaggggagccaagcatttttcacagcttgtgtgaaatgcttaatatttgaacgtctttaaaatatactgtacacatacattccaattttataagactaacataacatgttcaaaagttttatgaatttcagcatgtaaccagagtaaacgttagcctgttttaaataagccataatggcctggcaacaaacctgcatagttagcaaatccctcctctgtttatgggcagccattcctcaccaggtcactacaaaatacaagttttatcagtttctgtggactccgtaagttggtctgtgtactgagttcagcatgaatctggttttaagagcacaaaaccaagggcatcatgatgaggtgatatttcgttttgattttaatgaaatggcatgaatctgacttgcttaagaatatgtccaggcctctcgtatcctgtgggggcaacttggttcctaaatgccttccgtaagcacagggccacacagacgtagcaggcttaccccttcctcactggagtcaagagagtgctttgtgcctagaaaatgtttgtttttttggtggggcttttttttttttttttacttaggttggaagcgccccccagatgatgctttttaaggtaggatctcctcttaacaagtgagagcatcaaacatgctgggtcatgcccagttccatcccatcgtgtgtcctgggtctaaggtattagacacagtcatgcctctcaatggtgaaggttctatgttaccagatcatatatttcatggaaatctgctagctcaccagataaaatcctcccagcttcttcaagcgtggcagaggagagagacttcccatgtgttaaaaatctgctaaactttgcagccccaactcttttgcccgtagactcaccctggcctcagccatccctcaggaatcatctaccgtagaccaaactggcttcaggggatattccaacccctgatgtactctggcatcaaaagctcctttaattacaaataggacaccagagaacaggttggagcatttaaataagactgatctaaaggctgtgggccaaagatttctcacagagggcaacacgtaattaggtaatctgactcacaagatgaagtttactcgctttcattgtggtgccccccagggcagccttccccacctgccctctaggcctgtgtccttgtagcacttaccacttgtaagcccagccttctgggagaccctcagtcaggtccagatgcttccagaggccgactccagactcatccagtttcttctctctttgtcttataacagtcatggtcctcattgctccctaaaacatcctacttagtatttagagctcactatacatctgttcaaagcttggcttttggaagtctttattgtaccagtcttcttacctcctgaaataaggaaaatataagtataactgcccacagaggcatataaaactcctttccatttacctcatttattcgtcttatttaggggaagcgcagttcagggtgggcagtctagtttaagccattgagtctagtttaagccgttgttcaccatcatgattttatagcctttagttttattccctgtcagccatagacatccccagagatgcaagaactcatgcaggaaaacccatttaattaggacccactgtgaaggaccaggaaacagaccctaaagcactttatgacggaagctgttgatcaggaaacaggatgttttcctttccctgggtttaggtctggctcatactcctttggggagatctgggggcctgtctccatctccacggaaacagaacctgtaaccttcccagaatcaggttaccctagagggcagtgacatttatatctgcttttttgtttgttcgttgttctctttcctaagacatgtaagtggcaggttttgaactcctggatctctgcccaggggcctggcatgttgtatatctgccattctgatgtgtggagggcctcctgtctacactctctctgccccatggctagagacagctcattctgagagattctttttttataggaaggcaaagctcacctatccctaacatgcaaaaattttcacttgaggaggcggggaactggtttagtaaagatctttgcgtgaaattgaatccagtccttgccatccttcatgttcaactcaagtcctccttctataatgaagtcttccccagccagaagtgatctttctctttccattacatcagggccttttccacattcccacctttcccccctcatactgttgactagttttatttcccattagtgctttgcaccctagtgctcctaggtccatttaaagacctaaatggctgggatcacatcttctacttggttatttcccccacagcattcgatcacttataaactgtgttaattttccccacagtgcctcacatagagtggtgctcaattacaacttactaagtccatttgaaaagaaatacactgttggtcaagaaatctgtgtgctgagtgcttcaagggacacaggcagtataaatgagacatcctgccctcagggaatgtatagtctgagtggggataagacgaggccacatgaaaagtctactaatagcggccagggaccatggcttcctacaatacaagcactttgggaggccaaggtgagaggatcacttgaggccaggaatttgagaccagcctgggcaacatagtgagaccctgtctctacaaaaaactttcccaggtatggtggtgggtgcctgtagtcccagctactccagaggctcaggtgggaagactgttagagcccaggaggtgaaggctgcagtgagccaagatcacaccactgcaatccagcctgggtgacagagtgagactgtgtctctttgaaagaaaaaaagataaaaaaagcaaccagtaatacaattccatataggatctgggccagaaaaaaataagtactgattgtcatgatcatggtgatacgttagttatcttgggtatatacactgtttttacccatccccataacaactctacaaagtagatggtgctagacattcttagtctcagctctcttgtctttagagtgaggacaaatgattcgtccagtgagtacagagtgctgggattcagacagctctgtgagccctcacgtgaggctcaccctgggttccaatggctcagagcttctcctcttgcttctctctcattacccttgtgccctgcccactcccaacctttcaaatatattaaggaggattaaccatattgttcactgctattaaacaagaccagagacagagtctttccagcagaggtgacaccttggtgtctgaatgagaaaggagttgtccaaagacatctgccccacacagaagaaaattagacatatcacatgcctgctttgttataatggcataaaagtatgtgtatgttttaataagtcatgtactgagtgtactcagactatagcatatccatgtgtattacggtggttaagagctcatctctttagtaacaaacaggggttcaaattctgactttaccacttacaagctctatagccttcagcaagctagttaacttctcaggacctgttttttcattgataaaatgagtggggtaatacctagctcaaaaatttgttgtaatatttaaatatgaatgtaaagcacagtgcctgaggtcactcagtgaactgtgattgtggtgagcatactgttatatcccttcctgagccacagaacttgaatttgtgttcagagctggagactccagaacatctcccaaagggaagcaatttaaagttgaagtagcctctcccttctgtcagtgaggatgccaggtcttttctgagtttcctgtaagtcctctaggatatgttactttggataaagtctcactactttgacctgtggaaagaaattactgtccaagtacacaatttattttgacctcccaacacctttggacaattccaggctggctccaggcttcatcagaacaattatgtcctctctgtggaaaacattcctttcaaatgaatcagtagttactcaccttttcttttcccagccatatttttcagttgccaacagtgggatcagtgaggggtagtggtgtagctaacattagcccaatatagataagctccagattatccgtcatcttgtttgaaaaaaggcaggcctgccaaatttgcctacagttcccagtgagggaaagaaacaacaggttctatgaagaggaaggcacagaactagtcgtggaagtcacttttccagactccctccgttactcaggaggaaacaaacccagagtgtcttcttcaaggttaaactccctagaagctgatggaacctggccagaggctgtgaactttgcacagagggcatcatcagaatcaccctctgctcagtggatcgctgccctcccattactctgctggcacgtacctgatttggttgacatttccataattaatttataacagcaataaccctgagatgagcctatttataggtttgtgcaagctaggtaagaatatagattaaatctcagatcattaacatacttaaaggacttgggagagttttgtgattgtcaaatgatgtgattaaaaggcctccaagcttgatgtgtactgggaatccacaagtttactttccttgccaagctcagaaacaacaaaatagcaaaagataagcttacattccacccattcaccaaagatgttgggtcatccggggaactggaccagggtcatcactgatggtctacagctgctgccccacagatgaggatctgtgagcgtggttctgacccttgatatgccagcaagtgtggcaccaagagtcccatgggaagaattgctgtgactgtccacagcaatagagatgagtgtgagaagcacacctattagttgaaaggatgctattatgacctggactgctgtgcagacccaatcttactttctttcctcctttttatgttctgttgttctggttgttaaccttctgaaaagtaacatggattgcttttctattataaaagtaagacgtgttcaatatcaaaaataaaggtaagtacagagaagaaaataaagatcactcataattccaccacccagaaatacccactgctgaatttcagtgtgcatccttctaatagagtcttcattctgacatcatgctagtagaactgttctctggacacagaggcctcccattcaggtgcttgctttgacagatgtgtttcctactgaggaaagcatcttatactcagggggtgagaatccatccatcaagaagaaggaatgactaagggactccctgccttgcctgcaggaggctcttcaaaaaactaccacccagaagtagttccctctctctcttctttttacatttacccagaccactcaaccctatttatccttttcttacctgtatatgcaaatatgatggcaccaccaacgtcatccacctctttcgttcaagaccataacttcttttaaggctctcatgagtccttcacaccaccctccagcatagagaagggctcttcacccattattcccattactagtgttcaagacttgtttttttttttttgctccagttttttattagcaaactagctacaaaatgctgaaaatcaagttaaagttaatacatataagatcatcataaatgattgcacatgtacacagataattattactttcatttgttttattattttaatctacaaactttgagctctttaaaagtggagattagatgttatgtcgccagacccttaacttcgcacttggcataatataaatacttgattaatatttattgaattaagatgaaaatgaagagaaaatttaattacccagtctactttttttttttctatctcagtagttaagtgcagagaaaaaggaggtcatataaaaatgatgaaaaaatagtaccttagaaccatttttatggtgtatcagtgcattttttgtgctaaggtatcactgttaaccctagtgtggaccctttttaatgactttttaaaatcttgacgatgtccttttcacttctttcctaaatgaacattaatataaagccataaaatgttccttggagggttttatgagttactgtgttgtaaggttggggaaaggacacttggagccatttgttttatggagcttgattctgaagtccagcaccgcccctgacccttcagaggcacgctctgaggcatgaagcctttcttgaggacagtgagcactgccacttctccccgaaatacaccagccacactcctacacttgccacttccccggagtccacagtgtcaacctcaagccctgccctccacgagtagcctagacaccgtggagcagacgttactgatgatgcattgaacagctcttcttccacagtgcagatggattttccgttcaccagcatgaatcgcttttgccatatataatatcatgtagtacctgaaaaaaaaaaatgatgccaaagactagagatttggtcgaggacattggtttttctggctctttttgcctccggaactcttcttcagtttatatcagatgtggaagggaagcctaatctataaaacaaagatgggggtttgagtccccggggtttcccctcaccactgtgctaaccctaaatcagctttcaccacttacttgaaaaacccagggcccagagaaaccaaggtgtgagagtgtgaaaggtaagtgcaggacagatagacgataacgagggtgatataaataataatagcttacatttttttaggtcttcttgtgttccaagcactgtgctaaacacagactgtccccccaaaatatggcaaattgtgatgcctgaggcagagtatggtatggctgtctgggaactcttgaaaaggatattggattgcttgcaggcaagaaacaggccagattatcttggcagatctcgctctcactgtggttcttagcctttattacactgttggaatgggtttctcacaagtgatatcaagggaaaaaactagacggatatgtccagtgtatgtgtacgtgtgtgtgcacatgcacttaggacaactttgagccaggagtgtgagccggattagcacactgagttgtactttattctaacacatgcagctcagtagaagtctcatcttaagggacatatagaatgttgaggtagaaatagctcagaagaaagttgataaagtaataggatacgtgcttttgccaatctacatggccatatccttgcatgcttattttgacagaagagtcacagaacagagcaagttcttaaggctcattcattcccatttccctcttgacattttgagcaaaggactggagggaccaatccataaggggaatgcacctggtcatcttttcctgagcatcttgggatcaggtgctcttgggaataagatgatacgtatacccaagagcacttgatcagtcaggcagtgagtccatcaatccacagccctgttctgtgctggatcccatacctttgtacctgtgtggcaggagacaggaaggatgtgtggtggaaactccaggaacttagtccagctgaggagatgatacagacattggaaaacataatggaccaccaggaaatgataagcttaggaactcagagaacatcatttctaggatgaccagagaaggcttcaaggaagaagagaaatttaagcagtgcctcaaaggttgggtgggatgtgagttactcagctggggcagggagtagtctttgcagggagggaaactgctgaggaaagatacggaggtgagccgtgcacattgttcctgttggaaccacacatgtgtaaaggctctgagatgagtttagtgagagttgaaggctcatgttgaaaaacactgtgagaggcacacccagtacagactgtggcaagtgttgaatgcctggcggagaaacctagagccttttaaatagttctgagcagggaagggaggcaaggaaagcagttaaactggttcagctctcaggacaaatgtaaaatgaagggctcatgcttgtgtgtcagattgcaggtttgcttagaaagcacagtgcagggagaaacccgaaggagcaggattctgtcttctggagccctaaccaagggaggccgaagttggtgctttcattgaacgtccatgttctgacatgaataaatgccacgtcatgagtttgtggtcaactcctgtggtcaacttttaagcaagctttaaaacaacagcaaattgcttctatggaatttctcttacagcatcttgacattctggaaaagccagtgcagcagtcaagggagtaggtcctgtcctgtcatttacccaggcttcctagattcaacacatccctgtgggtcccgtcacacatctcaccctggcccatttaactgagctgggcctactgcagaccttcagatatttaatttgtaaacacttaataaagcactgtcagtaggtcggcttgtcttctctgtcggccacatcaaaatcaatacgtcccctgtgtattctgccatgattgtctgggctggggaatctaataggattaagtgtttggggtcctatctgacgccacagtccacagtcctagttagatgaggttaaagactggcttgccattgtggaggcacgattgcttaggggtctgaaaaatcattaaagcttgtcctcttaaacgttgattgttccctggtgatttattgacaaaacacaaaaaagtgctctatactgcactctaattatatgtatgaggccataagatctcatgggaaattaaataaaatttacagcttgatggttttatgctcctgggagacataccttcttaataagatcttatagctgggaatatttatgaggttaaagtccgtaggcttgagcaaaagacctaacctttccatgggaggtggggatggggtgcgttttgatttctttgaagataaatgatcgtaatgaaattttcaggggtttaggaaaaagtgttcagtaagacacatcaagcatttctccttaaaacctctggaggacaaagctgtaagggcacggggatttactgcgaccatttgtctcacataaggcccccatagtcctactccccacctctggggcacttcgtcctcctcctgtactctctgtggcttcctcgtcttattagcccccatcacactttgaaaaggtggggaggatcctaattaagggcaatgatgtaagaggtcaaggaagggaaaggaatttgagtaaggaaaagggagaaagactgagagaatcaatacatgttaagacagcccccagaggagtcactggacatttagtattttaacgggtcaccttctctttatgttaagggatggctgaggaccaggctcagattccacaaggattatcctgtgctgttctagacaaagaatcagagcatatctgggataagagggatttggggggagggcctctgcaggtgtcatgaagatgaagatgatatttatttgttacctttcttgactctgaatagagtgcttatcccaacgtctccgtgaatcctaaacgaagcttcatgcttgaaagtgggctgtttcaataagagtgaggagcatcgtttatgcagccccattcctgctgctttctctaatagttctgaaatggcaagaaggaggtaggtaggtagatagagagctgtcatatatatatgtgtacacacacacacacataattcctatgtattgaattatatttttatctactcaaaggaggataattgtgtggaactcaaagcggttgggacatgtcatatgtgatctatttttctgtttattttttctattgagttttttatatgaaatctgcatggccccttctttgtgtggggggttggagatggggagggcattgacagaagggttggagatcaagctttagagggacttggaacagatgggcacatcacctctctggggcccctgaatttgagagctctgctcccagccttttcccaccaggggagctcatgactggctgtcttctactgtgtgctccagtttatctccaagggtcaagcaaccccaccttgagagctccctacctaggctcatgtgaaaagcaaaggactatgtgatgaggatgaatggatacagcgtttgacctgctagggtgaggcaagtgaattgagaagttcctgactttcctcattgccaactagtcatgttcctcggcttccctcttccagaataaaccaaaataaaataaaagggactgcaaatgcccatgacttagatgtgttagagtccagcttctgtttcccccatttggtcctgattttcgaagtgaaggggagacaggactgagtggcatggtggtgagcaacccgtgtgcttagcccagcggctctctggtttgtcattgtggtatccctctctggaccacagtttcctcatctggaaaatgaagatctaaggctaggtgattttaaagtccctttcagctctaaaatattattttacagttgtaggatttatggaggagaacggcattccgctctatcccttgctttagccttttgaatgaaagtgagatgtctcatcagctcagatagagccagctcaagcccagtgtctcagataaaaggagaaagaaaaaaaaaacttattaaagatagctaagttcccttgataagcagcaagtgagaaatcctgatttaatttaaatatgatatttctgtcttcattaatttaaagcatgtatatgataatgtatccttttttatttagtggtctgccctgaagggaaagaaaggcttgattgtgaagcagaggggcaaaagcttgggtatattttaataaagatgaatatccctaaaaatgcttgaattattatggaagtaagatttgttgcaagttacaaatcaaagcctgaattgtcacttatctcctaatgatacttctacacagattattaatttcattttagaagcccaatgaatgttatattttatgacattgattaaacatcttgctgccatctaaccatccatccttttcattttcaaaaatccatatcggaatttaacaaaaacagctcataaatttgtattttacagcctagcaaagttgactggttctctactctacttaccctcgggcccattctgaactctgggcttgggccatttccactcttagaagtcagcttttccaaactgacatcatgttttgtggtcagagtagtacttggggatttgtttggaagagcacgtgtggcttctggagctgcaaagccaccaggggagttctgaggtggttggggttagcccctgacgggaactcagggtctcagctttcattctcattcttagacaagctagttacctccctcctcagtatcctagggataattatgccctccccagggggctcccagtgccactgtggggatgaatgagacagtagatgtgaaaggtcttcttgctctttagaggcaagcagtgtggtaatggatttaagagccaataaagaacagtgagattgtaggtttaggatcaaccttaggcattataggaaaggtgtaggatgacttgaaagcagggataaaagccttttgaaaatatctccaccatgttattatttatcaaacgtttgtcaaaagaagtacctctggacatagacagttctcaaaaaagatatacaaacagccaataaacatatgaaaaaatgctcaacatcactaattatcagggaaatgcaaagtaaaaccacaataaaataccaccttactcctgcaagaatggccataattcaaaagtcaaaaaataatagatgttgccgtggttgtggtaaaaagggaacacttctacactgctgatgggaatgtaaactggtacaaccactatggaaaacagtatggagattccttaaagaactaaaagtagaactaccattcaatccagcaatcccactgcttggtatctatccaaaggaaaagaagtcatatgaaaaagacatggcgcacacatatgtttacagtagcacagttcacaattgcaaaaatatggaatcaaactaaatgcccatcaatcaacaagtggataaagaaaatgtggtatatatacaccatggaatactactcagccatgaaacaatggcctttgcagcaccatggatggagctggaggccattattctaagtgaagtaattcaagaatggaaaaccaaatgccgtatgttcttacctataagtgggagctaagctatgaggatgcaaaggcctaagaatgatatattggactttggggactcgggggaaagggagggaggtgagtgagggataaaaggctacatattggatatagtgtacactgctcaggtgacggctgcaccaaaatctcagaaatcaccactaaagtacttatccatgtaactaaaaaccacctgtaccccaaaaaactattgcatttgtaaaaataaatttctgaacccttcaaaaaaaaagtatctctggtttcacgagactcatatgtgtgtttcctcaaaaccactgtgggctcatcctttccctggattggctcccattaggggaccccgtgtgttcctgtcacatttccttctttataattgtgatctttatgattgctgttcatttccatccagcgagggtgctggcacctggatcgccatgcagggtgcagctgtggccagctcttcctccaggaaggagacctgaagagacgtattctgagaagcctgaattcgactctacattgaaaaattaaggactggcaaccaaaggctgtcacttgttgaagaaaaaaaccttaattaaaaaataaataaataataaataaataaataaataaataaataaacctaatgaagctgagggtcaaggggcatcgggataaactgttttgcaagggttgatgacattaggaaaaataactctattaaatcagaagtctgcctctgccaggtaatccttaccaaaagtatgcaagaagcttgagagatcagccctagaaggaaaggtgccaccccagtcctccaagggcacagggcacaggggttagcatgtaagcttgctagtcaggctgctgaggctcacatcttgtctctcgctgtacccttggggaagttatcaaaccttgctgatctttggtttcttcatcagcaatagccctgtcacctagggacattgtgaagattaaatgaagtaatagtagtatatgtcaagtgcttattagtgcagtgtcaggccaaagttagtgcttaataaatgttagttgttgtttggccaggcacggtggctcacgcctgtaatcccaacactttgggggctgaggcgggaggatcacttgaggtcaggagttcgagaccagcctgaccaatatggcaaaagcccgtctctactaaaaaacaaaaaacaaaaacaaaacaaaacaaaaaattagccgggcatggtggcacatgcctgtaatcccagctacttgggaggctgaggtgggaggattgcttgaacctaataggcagaggttgcagtgagccaagatcacgccactgcactcccgcctgtgtgacagagtgagattccatctcaattaaaaaataagtaaaaataaatgttagttattgttgtcacgcgttggctggtagtctgtggtggtggtgctggtggtggtggtggtagtggtggtagtggtccttttggtttcgtttgttttgttgtttttgtattcccccccccccaaaaaaaaagaagaaaaggttgcatatcatcactttaaaagctgaagcagagcttttctaggccccacagggcctttccctgtaggcatggtggtaaactggtgtttagggacagagcatccttgagtgaggttggctgctgaggacagcccctccctatttgggaggcaagggagttggtatgataggagcgttactgggagaggacggtagccgcttagtgtgaagacttctccagcatgttgtgaaatgttcttgagtgacacattttgccctcctttttctgactcatctacctcatccttctcctttcctcccccgcgcccccctcccagccaaccctccatagtgtgctccaacactggcgatgttgcataaagggaaaatatggcgtgtttacagagagaattttcaagaagtgttaatttaatatgctaaagtgttcccttcagcattttacctttcttgttgttttcacaaaacagccaagactaaataatgagcccagggctgtgccctttggtagcgtgatagctcattacccactagcggcctccatctgccctcatggctgcatagggagccattacgattatgatggaaatctcagaagccattaccaagatgcaacagagggcctactgcagacagcctaatggactaatttgtaattgggagagggaaatgagttagcgagctggggccggttttgatgagagtggaagtgcgcatgctaaatgtgataaatgaataggaatgtgtgtttgcacagtgggctctacaagctttccatctctcctggggactggaggcgtgctgacaagccgtgaggagcgaggaggaaaggctcaggggaggcaagcaagattcaaggagagtagctaaggataaatcggtgaggaaaactaatggcagtaaaaatccaaggaaatgactgcatctgccatgaaagtagtaattaggaagcattcggtgtgcatgtctttaaccgttaaaatagggggatgagtagatggaaggctggggcggtggtgggccaagagagaagcccctcgtagagggctccgaagggagagcatcctcagacctggtggtctgggcaaatgctgcctgctcagaacggagccgagtccagaaacaccacgggcaccgcccttcgaggggcttctggaacccagcaatgggaaggcctagcaagctcacaggcagccattgtgcaaggcaaggaggccaggctgcagtgccagacctgcagaacatctgtccttggagggctggagagtcgcttcataagccctcgtgcccggcgctctaagctgaggagtgctgggcaccagtgtggctatggacagatttctgaaagctggcctttccttctgtttgtcatttggctcccagcatttcatctgcccagcctggagagtgcgccaggtgccctcatggaggccggggcttttgtttccactcacactgatggacctggtgaagggtaatccccccagtcggtctgaggccaagtcctgcttggagctgtcctcattttctgtttctttttggcattttctgtttctttttggtgtatcttctcagttctgtcccctaacctccaagccctggtgttctttctcctcagtcagaccttcttagccctgaaagctgcaggccaagccttaatgggcctctttttcccagcaacctgccgtcctcaaccctttctctggatctcacttttcctcatgggccagcctgaattgagcctcaggatcgtcctagctctcaggattcctcctgctcccaaacattctcatctcttttcctgggaggacctttcagccttcctaaatagcctaagggaagacgcgtatcccttcagggaagaaggaagcactggaaccaattaactgaaccccagcccagggctcttagaaccctttcccaaggtgagacagccacgtagctgactctgcctgcagtcccacctctgtcccacgggctcacttttcccatcacattccctagtacacaggaaaagttcccattttcttcaccaagcactagaagaggtttctaattagctccctaatgggatgatgacagtcctgttcagcaaaattttattgtcagcctatttgattgattatgtgagtgattgatcccacctactttgaaaatgaatttgaggaaaccaacaaaaaacacagatacattgagaccccaaagcaactcattctgggagaaggcaatcaataaatacaaaaggcagaaaaacattctcaaaacatagtacaaattaaagaaagttattgaaaaaacacaaatgcggttctgctgtgacaagcagtcatagaaaaggaacaactggatgaatgtcatggattaacaatggaagcatattatttaatcaggggcaactgactttttcccatccagtgtccgctgttaagtatagcattggttatgtcatcaatatccctaaaccaagagcctcatcatacagtcccatcaatgttgtataaaagacctagattttctgtgtaaaggtattgcttagatatccttcagtaaacccccccagaatgtgtcaacctaggacaaagccgtagagagacgacaaaaatcaggttcctgctgtgcccaagttcccactttagtgacgtagagatttatacttgggtaactctaattcagttacacagacagtaacaaagcatttagaaaatgcacaggaggacatcatcaacacatttgacaaatgtttcttgagtacatcctgtgggcaggcactgagctaatcactggagacacagcattaaataagtgggagaacatggcccatatcctcatgaagcttatgatgatcgaattctgacccaaagaaggtatggtgtgaggggagtatttgagctgagctgtgaagctagaagttcattagaaatcaacaacaatgagatacccagcaaaaccccaaatatttagaaattaaacaacatatttctaaaaaatccatgggtcaaagaggaaatcacaagagagattagatactattttaaactaaatgaaaatgaaaatgcaacacatcaaaatctgtggcatgcagccaaagcaattcctcagagaggaatggttgtgttagattacattaatagaggaatgcttgtattagaatagaggaaaggtctaaaataaatcaaaattccaccatgaggaggtaggaaccgaagaacacagataaacccaatgtgagaaggaaggaaataataaagaaaatagcagaaattattgaatagaaaacaacagtagagaaaccaaagccaaaacatggttctttgaaaagattaacaaaattgagaaacctgtagctagaatgaacgagaaacaaataataaaaaaaagaacacaaataccaattcaccaagaatgaagaagatgttatcagtgcagatcttacagacattagaaggatcatcaggacaggagctcgacaagcagaggggaggtaacgagttgctagttctgtgtgggtttgtggggtggagagaaggagttgccatagcaggcaggagctgaaaagatgtgaaccagaattgttggtttctacagtgacccaggacctgtgtacacagcccagttgactgcaccctataccagcagagttcccaccgttgagtggtggtctaatgtgcatgttagaccatagatgccgagactgacaggtcaccaatggaccataatgcttggctttcagggcacctggacttgctcaaaacatcgttgagcattggccagtaagtcaatctgatagatctgggtccacagcccctagaacataggggactttatttctccctgccaacttctggcttctgatcattcagtctcatggatatcaaaactgacctgatgccatcctgaggccatgatatcatcctttccacagtttatatgcttctgaaaatggagctttctttttaaaagattaagtctgaatattcatggcagaagaagcttgccaaagctggctgctcacctccagctcccaagtcagtatcagcctgccatggcttattccagacccagacaacatcaagagagaaggcgggtgtggcatgggccagtttcatccactggtcacaggaccggcacctgtcagccatgaggctgtagacagggtcctaaagtgcaaagaaaaagctgtcaaagcttagttttctccccctgctcagatgtttacctggcaggagtgcctgccgtgtctttgtgtcattgttgctctttgtgcaactggccttccttattctctcattatcacacactctctctctctatctctgtctttcatctgtcctattattcatctgagtgtggactcaaaagaaccagattctgatcctgggcaggctccctttcctttacatatcttaatgtgaccatccataaaatgagggaaatgagagtgccatctcataggctcatggcaagttaaatgacttggtgtgtgtgcgtgtgtgtatacacacacacacacacacatatatacacataatatatatgttatatatacacataatatatatgttatatatacacataatatatatgttatatatatacacacaatatattatatatacacatatatgttatatataatatattatgtgtatatataatgtatatatattgtgtgtgtgtgtgtgtgtgtgtgtgtgtgtgtgtatttttttgagacagagtctcactctgttgtccaggctagagtgcagtggcgcaatctcagctcactgcaacctctgcctcccaggttcaagcgattctcctgcctcagcctcctgagtagctgggattacaggtgcccagcaccatgcccagctaatttttgtatttttagtagagatgcggtttcgccatgttggccagactggtccctacgtcctgacctcaggtaatccgcccgcctcggcctcccagagtgctgggattacaagtgtgagccaccgcacccggccaaatgagttagtatattttaaaagcactcagaccagaacttgacacctaggaagcactagatgttttaccaaatcacaggcctaggtgtggtgttcttcagccttcctggcgcctgtgttcctcaggctgaccacgctggattcctcttctgttggaagctcctccaccccacccctcccagtggagacctgcctgcctcactgcctgcaggcagcctggcccaacagctgcagtataggcacagggggcattgctcaggggtgcaggtgttccctaaccctaagttgagacctgagggtctcattaggtcctccaaacttccaagattgtatacttaatgaattggagggtttcaccttcccccaaatagccattgagcgaatccagccaccactcccgtcaggtcctggctgttcatgttgacactgatgctggcgagaggggagtatcttgaaagggcagaacaattggggtgaggatggggaagaaaagggagaaagagatgccctcaggtggggaatttaatttagtcacatgatagtagcatcaggcacttgtgttttacttttctcagaacattctcacatgcattctcttactgtatccttaccacaagtctgggagctagctgtggccgaagtgggtattttctctagaaacaaaagagctgaagcctaggaaggctgaaggacttgctcaaggtcatgcagctacctagagacaaagcggagaccataagcccagaagtgctgattcccagggctccctgcaggggatcatgtatagagagtcactgtgaactgctgtctgagcaaactacgtgaccccctcttggcaagacgaaaggccttggcttggagcaagatggatggagaacactccgggcccacactatgctgttttgaaactgtgccagagaagaggagtggcctggaagtgcagccccctctgttgggtgtttctgagaaagtgtttttctcctttgctggatttaatgaataaattataataacttttgcgtttttatccacattatgcatgtttatctgcccttcccccgtaaaccccctttcccacttccacgtagtactatatttcttttcatgttttatctttgggaacttgccactgataattatttttttaaaaagctcattcctagtgattgctggtaaagatgcacacctcttcattttctaaaaatgtatatgctcaggaccaaaaattcagggaggcatgtgtgggaaaaggtatatttccacttccaaagagagggtactttttcagaagctcagaaaaggaaaggggaaaatgttatatgagccctggtggtatgtgagctccttgggggaatacatggttgtcttatctgtctccagctctttgaatagatcttgcatgcagtagcatgtgagtacattgatggaatgcatgtaccaaggagcagctggatggctgatgggctggatggctaagtgagtgcatggatagatggatgcccaagcaacaaagtgaaacctcatttggcttgttgtgtcagagagccttcttaattactactctggatttcactgctatattctattctggccaagtcttggaatttctttatgttctaggtgggaaaagattacttctataattcatcaaggaaaatactaacttgctcccccagagagctgggggaaaacacattaatataaatataattgaggagtggaaacaaagtctaggaggagttaaagcataagtatcagcctggatgtgaattctaatataggaattagaattcctatattaaaaattgtattagaaacctttactttcttgtgatttctgttagttcagtaagtaacctttcttggaaggtctactaattcctttcaaaaaagatatttattttatatcttactataatatactaagcactgttattgctagggtgttttgaaggggcaggagatggtatttaaaactgagttgcagttctaggcagttaaataaaatccactgaccagaaaaaaatatgtaaaatgataaggcaggataagtattcactgccaaaaagtcaacaaagaaaatagtaaggatttatgttcagcaatccctgagattaaaatttaaaataaataaatagggatagtacgatttgaaatcggcgtcctctttgaactaggaattcaagactcagaataaaatggtccttttcattgcagagctgatctttgtgaccaacatcttgtctccaccaggaacattttagttgagaagcaggagaagtcattgctaagaagcttggattttcaaagaaacagatatcaaattgagaaatctctactaatctttcccttcagagtctaggcttgggtattttttttttcaaaactacatttattttacagataatcaagactctgacagagttttatgtctttttatcactctttatcttgaaaagcattgttggcctaaggttgaatcagccaaacactcagcctcatgaagagcttgtctggggcccatggcgaggaaaatgccagaatgtaagtgctttagagacgggagccataattgcaatgagaaggggagctgtggctggctctgactgccctgcttcccacattttcttttaacgagtgtccccacgtccccaccgcccctcccccccgacactcagatcccttcagttcccactggctgccattttcccttgctctgcagcctccaactccactccacttaagagaacagactggagactgctggaggccctgaagtgatttattgcttagcaggaacttcactaaacttcccaagttgattttttttagttttgaaaatcaaacaaagttcaaaaagtaaacatcacaggttgacatcccagcccaaagctgaggaaaaatgtctcttgttacattttttggcacataatagaatttatgagcattttcagtgttttgatttttttccccagtcactgttattccttaccctccagagttaggtgtggagagattatgttggcctgtttccatggtgacactgaagaaaagtaattttttaaaggaggtttctactgtgttatttcacatgcatgaaacatcaacatctatgctgtgtggctattacccctaaacataaagacacagaaatggttggagtattttatataaatagacaagtagggtgatattttccttggtctcgtgccgaccctagtaacaaaagtctctcagttacccagggcacctgggagagagtgagggaacagttctgttcagtgttaagcaagctcctctcctgtgaataaccttttctttaaaaaaaaaaaaaaaaaaaaaaaagctcaagttgaaagtccaccccccttctacttaaactagggaccagatgaaaagttccttttggggctcactgttcaaagaaccaggattaatctctgttttcgatgtagcttacttggtcaaccactgcaagtattccccttatctgtccaaggcgttgtctagaatcttcttgccccagtaaacagttgcttacagtctcctagagtgaggttggttagggtaagtatatacctttagcagcagaaatttggtgaaactctttccgccaccctacacatagacacacaccccccgcacatgcacacgtcacatcagcatcaatcacacaccccactcacacacaccacgtacacagtcgcacacacacaccccacacatgcacacgtcacatcagcatcgatcacacaccccactcacacacaccacgtacacagtcacacacacacacaccccacacatgcacacgtcacatcagcatcgatcacacaccccactcacacacaccacgtacacagtcacacacacacacaccccacacatgcacacgtcacatcagcatcgatcacacaccccactcacaccacgtacacaaacacacacacgccccacacatgcacatgtcacatcagcgtcgatcacacatcccactcacacacaccacgtacacagtcacacacacacaccccacacatgcacacgtcacatcagcatcgatcacacacaccactcataccacatacacagtcacacacacacaccccccccacacacatgcacacgtcacatcagcatctatcacacaccccactcacagacaccacatacacagtcagacacacaccccacacatgcacacgtcacatcagcatcgatcacacaccccactcacacacaccacgtacacagtcacacacacacacaccccacacatgcacacgtcacatcagcatcgatcacacacaccacgtacacagtcacacacacacacacaccccacacatgcacacgtcacatcagcgtcgatcacacaccccactcacacacaccacgtacacagtcacacacacgcacaccccacacatgcacatgtcacatcagcgtcgatcacacaccccactcacacacaccacgtacacagtcacacacacaccccacacatgcacatgtcacatcagcatcgatcacacacaccacgtacacagtcacacacacacacaccccacacacatgcacacgtcacatcagcgtcgatcacacaccccactcacacacaccacgtacacagtcagacacacacacacaccccacacatgcacacgtcacatcagcatcaatcacacaccccactcacaccacgtacacaggcacacacacacaccccacacatgcacacgtcacatcagcatcgatcacacaccccactcacaccacgtacacagtcacacacgcacacaccccacacatgcacacgtcacatcagcgtcgatcacacaccccactcacaccacgtacacagtcagacacacacacacaccccacacatgcacacgtcacatcagcatcgatcacacactccacgtacacagtcacacacacacacaccccacacacatgcacacgtcacatcagcgtcgatcacacacccctcacacacaccacgtacacagtcacacacacgcacaccccacacatgcacacgtcacatcagcgtcgatcacacatcccactcacacacaccacgtacacagtcagacacacacacacaccccacacatgcacacatcacatcagcgtcgatcacacatcccactcacacacaccacgtacacagtcagacacacacacacaccccacacatgcacacgtcacatcagcatcaatcacacaccccactcacacacaccacgtacacaggcacacacacacacctcacacacatgcacatgtcacatcagcgtcgatcacacaccccactcacacacaccacgtacacagtcacacacacacacaccccccacacacatgcacacgtcacatcagcgtcgatcacacaccccactcacacacatcacgtacacagtcgcacagacacacaatcacttcttgaggcttcagacaggttgctttatctagggcaagtcaaagtttggaaacagaagaggtcatgatggattgttgtgctgtttcccttacgtgtaaccatggttagactttcttgttatgtaactgagaatacttggtttttggaaaataaaatggagagcactgctttatcttggagaataatatcctcatgcatgtggagaatgcctttaacttttccaaggttcttcctacatgttatttgaatttcctaataattctgaaaggtagattttcttggcattccccttattttaaagctgcagggacagaagtttgcgttacctgttcattaggggcatagctgagtcagggattctggaccctcggttttcgctgaggtcctgtgttattaatcctatacttggcatcttccacacagccagtctgagaaagcacagggcctgcagcttcctgggacagggtctcagacacgcagagaccatcaggaggagttcactctgctattaacaaatgtttactgagcacctgctacacatcagacactactccagccgcaatagtccaaacagtcaagaatccctacattctatgagtacaagggaatggtgagtgaatgagtaaaacacataatgcatgtgtcagatggtgattagtgccaaggagagaaagaaagcaggaagaggggtagacagaatgctgggagtgaaaagaagtgggaagaggtgttattgaggggtgacattggaacaaagatttgaaggtgctaagggagcaagttttgaggatgtctggggaagagaagtccaggccaacagaaagatcaaggagtgtggaaaccggcatgcgttgccttcctgaaatccacagagccgcatactcattgcatgtgtgtgtgtatttgaaaacttcttaaattctgaggttggtacatggctttaatttttgccttaatggcttcctgcacttggggagctctttaataggtgcattctggtagtagtaatcatcagtcctgggctggtatcacattacctatgtggaaaaaagcagaattgctttggcactgattgggtcttggggtggtgactatgttttcctggtttttaatgcagatcattgaaaacatgtcagggcctggtctcaagtgtttctcttaaatgggatagaatcatgttcttataagcagagggtgtaggaagggactaggtggggggttggtgggcagaagggttcttatattttaaatgccagtcagctgcaaccactagttaactggagcctgttcaaactcatttggagaacagttgaatttttaaagtgccttttgattctctctttcatttattttaactgatctgctgggattaggagcttggtaggggaacaccagaatgcttgccaaaatgtgtgaataattagagctgcgatgatgtgtgccagatagaaggggagtattcacacttctgattagattcagctaaatgcagttgtaaatcactgctgccacagtaacagcgccctgtcaggactgagcacaagaggaggctcagggcagtgaagagacgcagggcagccccaaggcatggggctggaccgaacctttgtggaagaggagggcaaggagaatggctccagtcaccagcagcccctgggacattggttttggcatctctctttcagctcacttctaccgtgttgagtcttgctgggcactgaggtggccaccatctcagcaaatgcgagtaagacgggtccctgctctcgggatgcttacagtctcacggaaggtgaatgcacaactgtggttcagtgtgatgcatgtgtccgcaggacagacattgtgctaaagggtcccagaggaggaattgggcctgctgaagggaaaggagaagggataggtggaaaggcagttatttccttcagagataaaagttgacatttcagagtgctcagcaagataagttagtggctggaggagttccaggcagagggaacagcacatgcaaaggcacagacaggcaaagccccacccagtctaagagtgcagtcctccaggatggccggggaactgggaacaacatggaagaggctggcggtgcaacttggaaacactgcaaataggttgggtcagaatgtgaagggtctcaagtgctcataggaggaagctcttcttccaattacgtaccactcccaagatcccagctaccccttggagagggtgggtttcccacctcagccagagaaccctgccttagccacagtcatcgatgggaatgtgttagtattctttggacaggagaaataaatgttgagaaccattgctctcaccagtggagagtcttaggaggttaagaaggtgaagaggaactataagatggttaagttaaaaagaaaactggcagaagctttggtgtagaattgttagtttacagcaaggtaagtctgcaggctcccagatgtagataggaggttacagtcaaggtctgaccaaatgatagaatccatttcaagagagatttcagagtggaatccagtcagacttgttgaggaagactccagctgtgtgctgggtttcttgctcctttctgaaccatccttgcctgatcctgacttttctgtacgtgtggagtgccatagctcaagacacgatgtccttcggaaaatagacagtgagtgtatatgttttacagtattgcccaagaggtggaatcctgtcatttcctaatcacaactacacgtttcctccctctccagcactgctctgctccctttacctaaggttgctaaaggtactggtggtcttcaaaaaaaaaaaaaaacaaaacaaaaagcaaatacccacctcttactcaggacaccccagtcagtggatgccttctctggcccctctcccgtcctgttcttggaaaagcagcctactttctctgtcctgatcatgcaacaagttgctctgaaatgaaccagcagcttgtggtgggaataaaagcccaggaaaaggaatgcagaaggaaagtgatggaacggcatgaaacccaaagcaattgataaaaatgagcaccacatggagaatgtggaaaggagaggcaagcataaaaatcacaaccacatctgacatctctagaaatggagagagacaaatgaaatctcacatgtggctttcctcaagtcagaaagattccgcttctccattcaggggcgggatgaaggagcctctttggaagccgtgggcctttctcaagttgttctaccacgcctttcatttctcccgcttcagccagtaagttcaagtgcttagagaaatgcttagcctctagcaccttctccaggcacaaaataatgggttgaccaaattgataattttttttttttttgagatggagtccctctttgttgctcaggctggagtgcagcagcatgatctcggctcactgcaacttcagcctcccaggttcaagcgattctcccgcctcagcctcctcgagtagctgggatttcaggcatccgccaccacgcccagttgatttttgtatttttagtagagatggggtttcaccatgttggccaggctggtctcgaactcctgacctcaggtgatccgcccgcctcagtctcccaaagtgctggaattacaggcatgagccactgtgcctggcccgaattgatacctcccaaagtatgcatgaaggacaataatttgagatatgaggaaaaaatctaaaatgactttttctacttatttttatctcacctattcagatttatttcgtgaatgtgtattttagaaatacattagtatactggtatatcattaagcatatcaataagtaaaaatatctcgggcaagttaaatgagttatttgtctgtttttactctggggggcacatgatcagaatgtgtgaggactgggagagtagttagcagtgtcactagctgaatgtggggccaggaagaatgctctagaactgtgagtccttgtggaaacaggggcattaactggatcggctgcctccttctagcctatgagatagcctgttagcttcccttgtagctcaaagagcccctggaaatcagtagtcagaacccagagaaagggaagttctacccgtaaaagagatgcccatgttttcttagctgatagtcactttgcagagccacacccacaggtgacaaaagcacagtggaacttaccctcaggccctttcaccatcacaggcctctcttctttcctggttttgtcgttgggtaggggtggtggtgttgcctcccggaaccctcatccaggctacatgagacatgcagacatgctccagtgtcatgaacctccccctcaacagctccttcccccctttctccacaacacaaacaaaaccatcaaactccatatgattgttataatctaactgtggagtcaggaatactgtgctgccctacgtgatgctcttttcatttttgcagccatctagctttcttttccccctaccccagcaacccacaaacttaaactccaacctagttcaacctcagaaatcccattaatgtcttagaggcaggtggcctgaggagcccttcacttctgctgtcagctgtgtctccatggctcaggaacttaccctcccacccagccaggctgctttccctgtcaatagcattctcattccctccatgtctgttagaacttgaccattagtcaagctgttcctgagatgtgtctcttgtagagatgtacactggttagaaatggaagcacctccgtgactttcctctccctgtcatggtgacagcagtgtgacaggtttgacagttccagtttctaggacctccagctgcaagtgctgcttcgaccatgtgcttacgaattgcttcaggtccacctcgtaccctttccctctccagccatgtttatcttggctccgtattaatggcacaccttctgaatgttggacaaagatagtagctcttgtgtaagaacacactatcgacagcaaatggaagatgttacactttaaggctgccagttgtccccacttgtgccatactgaaataggagatggcctgcatctgtttgaaagaaattgagtgaaataatagttggtgagtatagtcctgaaggcagtgaactgtgatggaatcaaggatctcttcctgttagagtgacttttgcccaccgcttccagtggtgcttgtagaacttaggatctcaagaatattttgtgtcccctgcagaaaagtagcaatgcaggttgttcacatccagaggtcatgactcccaacagactttgtttatagcagcccaggctcagtgaggtgtatagtgggaagggcccagtaccacatgggcagagaagcactcattaacttcctacctggttgtaaacattagaaagttcccattcagaaaagtacttaacagcaaatatcacagctatggtatagtcctgttctgaagcggatgtgttttacaggtgaagacttcaggaaaacagccaaagaagatgtgatcttccaagatatcatgtaccctccattgtttgtcagtagaggagttttgggcatttagggtagactcctcccacacatcacaaaacacttagcaacactgctttgcccattaaataccagtatctatcaccatcaccttgactcctgaaaaacagtcccacacagttgcaagtgctccccagggtggggaggaaaggagcacttctccagagggagaaccaggggaaacgaggtagcagcacccataggtgtgcctgtgcactgggtgcagctagtcggttatttcactcagactcttgatgattcaacacattttggaaagagaaagtttgtccccaaaagaggcacctgactggcccaatccattgtcacatgttaatggctgtcacatgacagccagttgctggatctgtttatgtcaccaaatagtcactgtctaattagacttacaaattctaagtgtagcattagatttacaaagtcagtaaactgtgatgtgtgcctgtgttatctttcatgatctgacagatcatgtttgaaaattggcccaagctaggcccagtggtttgtacctgtaatcccagctacttgagaggttgaggtgggaggatcacaacatcctgggaacagagcaagactcccgtctcattttttttttttttttttttgagatagattctctctctgttgtccaggctggagtgcagtggcttgatcatagctcgttgcagccttgaactcccagcccaagtagtcctcccacctcagcctcccaagcagctgggactacaggtgtgcaccaccatgccctgctaatgttttaaattttttgtagaggtgaggtcttcttatgttccccaggctggtctcaaactcctaggatcaagtgatcctcccaccttggcctcccaaaatgctgagattacaggcgtgagcctactgcacccagcccaaaattgtttttaaaaataaggaaaaaaaaaaaaagaagaaagaaaaccggccaaaatgcagagaaaagtttgactatcaatgcagcattactttggttttattttacatcagccatctcccctccgctcaagatttgaggttgcttgttagttgaactacttggcaatgaatttgtcattgaaacaaaaattttgaatttttgaatatgagaatttcattaataagtcatgaattgtaagcttgggtgtgaaaatctttataatactttatagtgagacatttctcatctgtcgtcttgcaggctactgcacaggagctcgagtacatagatttgttgtcaattaaatattaaagctttataggctatttttatttccttctgcttgcattccttcctccagctcctaatagccacatgtccagtctttaaatggagccaggtttagagaggtctaatgaagagggtttactgaatggggaaagggcagccaccgtgaccccatatcacacctttgccacacaatcagagacctctgttgaagctattctggaaaagatctattcttaccagaagctgtcctgcgctgtcagtgaaaagacattaggtgcaggtgtcaaacatgactaatgaggcatgaggagtcgacagcaaaataacagagattatgggcagagaggacttgcagatgaaatgtgaatagcagtgtagatgtgtgagtgatgcaggaaggaaggggaccggcaccgaggagcagtagctgtcccacttgcgggaaggttggacaatatcagttacttgattggtatcttctcctttgatatattaagtggacaaacatctaatgttttcctctcgaaatcatgagtttcctgcaagtgtttggggcttggtatccacgtttctgtaatcttctaagacaagccagaatctttttctgtttttatatttacacaggttttattgtgaaattgtcaggaaggatgaggcatgtttcactcattaattttcattgtcatcaaaacatcagagttacagtgcagtatcctgctattccagggcccacaggagctctgattgataacattctaccttcacaaaggttgtaatctaaatggaagaggctggaaaaagaaaaaagtatgattagttgtagttgtgtcaaaagctgcctctgaacagaccaatacactaagcaatcagagatttcaagagaggtagcagggcctgagactctaactcagtgaatcttgcttcaccagatgtggagtctgtctttggtggtttcgcagagcctggccctgagcctccatccactcagcgctcaatagatgactgtaagcatatttctatgcgttcattagcctcagggaggttgatttttacctcctagaggtgaattttaaagacttcctttttggatgagaaagagaaggctggtagagaaggaggagcagaagcaccatgaaatcaggtgggtgatggtttcctttcctggtgcttttaaccagttctcccagagtggagataaacatgaagttaatatggggaatgttgatcttcctaaatgcagctccaaatgatagacccaggacaggtttccaaacagctgttattcagattagaggcaaggacttgatgtattgctcccattagaaagtgtcctaatggaaagggcctgcactttctcctggccccatctgaattaaacaattggagtattttaaatcaagggtcataagtgtcaacaagatggagagctttgcctctcgattaaaagaggcttataagttacttaggaagttcctgccgacacagattgcacgtggctcctgtgaaccgtggttatacccaggctaagtccagccgttgtcctaaggagggagcaggccacctcagacagaaaatgcagctggagaatttaagtctcacatgccaagatcctgctaaccagagggtttgggggaggtaggacctttcatgtttctctgccaacttgtccccaaggtagggaccacaatcctggcaggccgggatggggaccaaagtggcacttgcctttcataacatgtttgtgcttgtttccgtatcagtaatgtcttagctccttatcaggttaattacccaccccttctttccaggctccgagtagaagtcatgctccaagaccaggcgctggccttgaacgtgatgcctcctcctggtttgtaccttgtttgagatcatctcaggcacagagcactggaacacggggagccacgtgatcccaggtgcaggctgagccaagcatgatccctggggtgtctttttctcccctgggactgacattaaaggtgcaggagccaatcaggatcataacagaaggtagaagatttccccagattgagaggagaggagagaaagagcagggcaagggggtggtgaggagcgagagagcagagcccgaacagcagtagcgagggcaatgcatctggagctacaaggacagacgtctctaggtagatgcccttatggcagcgcttctggagagagaagaaaatcccagtaatattaacagggctacaacaaatgaaaattggaaaataaacagatggaacatgcctcatagtttagcttttatcatcaataattctaaatctgcaagtgaatatggctaactgtagttcaaaccatctgcctattactgcctctcacttgaagagactgtgttgcatcccactctccaccaagactgagaggaagggagggagggagagggagagagaataattattctcagctgttctgtcaaaacagacacgtgctccgcgcccagcgtaaaggtcaactgcagatacaccatctatctctggagagggcagccagcagtcccacgctgctctcctgggcttgtggggaccccttctggctgcccttctgagttcaaatgtaagcgtctaacaggcaggctctgttgtttatttcggggctgagattcagcagtttcttatctatatgggggaaattaatgcaggtacatgtatggtgtgtcccaacctactctgggccatgtggagtcccctctgtgcctttcaagtcttctggaggctcatctggggtccagaacagtgctgtgagagatgaaaggacacgagtgctgtcccagcgcagagagctcagaatctggggaagcctggctctccaagacagggaccactgatgctgagtgagcaccaacccaaattaggcctggtcttcaccaccctcttttggaaaatgaacattttattcagaaggcaatatggtaagaaccttgaggaaataagtgtaaattgtaaatcagccacaaactcagttttagcctaccttgccttgcgtattccctcttgcaagactaaccagagaaacacagaatcaagcctttatcatttggtaaattgtttcatcaagaatactggcccaagcatggtggctcacaactgtaataccactgctttgggaggctgaggcgggaggatcgcttgagcctgggagtttgaggccagcctaggcaagaccacatctctacaaaaatttttaaaattagaaaaaaaagaaagaataccatatctgaggtgcagatgagtgtgcaagtaattctttttgttgttgttttaacatgacaacagctggcttttttatggagcttccctgaacattaaaaaaaagtaactaaggccgggcgcagtggctcacacctataatcccagcactttgggagactgaggtgggtggatcacctgaggtcaggagttcaagaccagcctgaccaacatggtgaaaccctgtctctactaaaaatacaaaaattagccaggtatggtgacgggcacctgtaatcccagctacttgggaggctgaggcaggagaatcgcttgaacccaggaggcagaggttgcactgagccaagatcgcaccattgtactccagcctaggtgatggagcaagactctgtctcaaaaaaataaaaataaagaaaaagtaactaagacataaaaaccaacccaaaataagatggggcacctgaaaagtgtatgtgtacacatgtgtgtgtgcatgtacctcatatgggcaatgcatgtgtggacacaaataccaaaaatattccaaagacttaattttttaggtgttgactactgtttgttcatagcccaatggtgttaacaagcagtagattgttagtgacaatcacactctctccagcacttacagcagaaggcttgatttaatcgaagagctgtcatttattattctgttgtgcaattccatgggggtagctaactgatcaagctcgggctacggggagcagagggcttttttttgttgttgttatgtctaaatcctcaatacaaattacagtatttctggactcccagtgggacccattagagcctgtggggcattaacgatcattaatagtgctgtcaaaaaggaggggggtagggagagaaggaaagaaagggagggaagtgaagaaagggagggtgcagaatagtagccagggagaagtgtggctttttttcagaaatggaaaattaatacatctgctttgttcacagtgccgagcatttgatgtttattaacaggcatcttaattttgcagattagtaccagtcgggttcttacttccgcatattgaaatccttccattgcctcagatccttcttctcttttcctcatccttcctccgccttcccaaaatctttctctccccagtagtcagtcctgaatctccaactccaacaatgaagacagaaagggactgagaaaatatgagtggggagagtgtcttcattcagaacagagtgtgtgcgcgtacatacatacaccacggttacagccataattggcaatcttgcctgtgatatcccattaactgtggttccttgtaagcatttaactgtatagttagtaatcaggtagaaatgttttaatcacttactaactagcatgcttatcagtgtgatggagaaagggcaaggtattaattagttaggataacatgctaatgtttgcattgtaacacttctgctatttaaagcaaggaagaccctgagtttgagtcttattcagaactgaagcctttttctagaatttttgttctctccaaattccatatctatgctaagctgacttgccttttgcctccctatggttgcatacttttctcctttcattatatttttcctttcagtctcggactcttgagatctagtcttctacatccatgacattctcaaaccacagaaaggaattttcccacaataataataggtgtgcattacactttctttcttcgcagcaataagtgccattacttcattcaagtgttgagtacctgtgatgtgctgggcactgtgcttgacacagggaatacagcagagggaagaaagaaccaaggcaccattcctgccctcatggagcttctgctatggtgggagagagacttgggaatcccataagtccatttagaatcacagccatggtgtatgggagaggcattgggactatgagagattataaggtattctgacttgggaggaaggttgggaaagtaccctacggaaggtacagttgagcagatagaaaagaaaaatagattgctgattactttgttccaggaaccatgttaagtatttttccatggattatttcatttaatccttataacagttctagaatatagggaggattctttagtttacagattaaactaaggtttaaaagagaatgagctgctgcctgtctggcccacggtataagcctactgcatagctcattgatgaatgaaccccaggtatggagaatttgacccttggatagtaactcttccatcttctctttttcgtgtcttttgacatttttgagcatagataaaccaggctgaccaatgcagccattttactctcatcaaggactcagaatggtgtgggtactgtgcacttgtttgagacaatgcccttccttgctgatagcttcccgaattgagcaaagcagatacaaaaaaagtgagcaagactctcagcctacaatctctagtgtggaagaaacaccctatttctttgctttcttacatcaacttcattttctacttgaaactgtaccccctaaagggaccttgcacttaagtcgttcccagtgcatcctacatccctagagttgtgtctgtgttctgtgtctttttgccaagggatgttgaaggctggaagtcctctaggtcttaggtcccccagatcactgtgggaagaccccacatccccatccctgtgagccaccaggagcctggtgtggccatttctcctggggccttgcttcctcctgtgagccattccagaatagggtgtggggccctggtgctctgacagccacagcttcctctgcttctccattctgggtgaatcttttccttagcgaagcccttccccatatcttaggcactacaattctttacttaagctctcttaaactttatctttctcattccattagattttcatggccattgaacttagcaactgaagaaaactagtttccctttcctatagggcagagagagctttagtaaccaaatgttcctaggaggagtggggaaacatttttattttcattccagtaacacagtggttctcaaagagtggcccaggtacccaagggggatccccaagaccctgtcaggagttctccaaggccaaaactattttcccaataataagacattatttgcctttctcacttactatcattctctcacaaatacatggtggggtttgccagaggctacatgacatgtgatttaaaatattgaatgcaaaagcaaatatgagaatccagacatcttctataccagacattaaagaaaattgaaaaaaatgtaaaactcactaatttttttgttttgaaaaagttatttttataaaaatgtatttaacaggtaataggtttattgttatttttaaatgaataaacattttacagttttctcagttttaatttatttatttttatttatttatttatttatttttgttgagacggaatcttgctctgtcacccaggctggagtgcgatggcgcgatcttggctcactgcaacctccacctcccgggttcaagtgattgtcctgcctcagcctcctgagtagttgggattacaggcacccaccaccatgcccggctaatttttgtattttttgtagagacgaggtttcgccatgttggtcaggctagtctggaactcctgaccttagtttatctgcccgcctcagcctcccaaagtgctgggattacaggcgtgaaccactgcgctcggcctttaatttttaattagcatagcaaaagccttttggaagttctcaaaaaaaaatttaagagtataaaggggtcctgaggtcaaagcatttgcaaactgccacagcagagcaaaggaagaaaagaaaaaccaaacatcagatttccagacgaaatccaccatgccacaccggcaatttccaaatgcggaaactggattgtgtcatccagtgagagaaactgttacttggatactttggccctacctctcttattttttttttctcaaatttgaagagatcataataaaacaacctcctaaatctaggtaatcacacatcccagtttccctgggacagccccaacttctatatgccctttgtcctgtcataattttttatttttatttttttcattttaaactttttttcattttctttttttttttttttttttttttttttttattgagacagagtctcactctgttgtccaggctggagtgcagtggcacgatctgggctcactgcaatctctgcctcccaggttcaagcgattctcctgcctcagcctcccaaatagctgggattacaagcatgcgccaccatgctcagctaatttttgtatttttaatagagaccaggtttcaccacgttggccaggctggtcttgaactcctgacctcaagtgatccgccttgccttggtctcccaaagtgctgggattacaggcatgaaccatcacatccggcctgtcctgtcataatttttaagtgttcccactttcactcttcaaagtgtcctggtttgattgataaattaaaggtcagcctacctgaaccccacccaacttcatgagcttataaatgacaaagtaaatacaaaatttctatagtccagagagtcaagaaagcatcccatttggattgactggctgggatgtggcagagagcatgcatttatttgtctgtgaccttttcctgtttcagctgtgaatatgggtccccacgttgatctcagctagggagctgggtattaaccatcaaggcagtggtgaaccgggtgggcctcccacacaaaaagctcactggcaactagcaaatccagatggcgcacatatccatgtgatattagccacatagaggcctttgcggggctttttttggacattgctaagcctgctgagtctaagatttcaaatgctgttttgagctacttgatttagaggtgaagccagaccacttggagggaagtgtgaaattctttggagttcttcaactcacttgtgactctataaaaattacccgggggccagaagcaaggaaggaggtaacgcttcaagtggcccttctgcctccacagcacttttcagattagggagtgacaggggctgtggaaccgtttttccctcccgctcctcagtaggaaaacatcgaaacatccatactgtcagctgacatgatttggggtgagctttaaaggactaaaggactccccccagaaggctgaaatccttgttaagcaaggaactttcatctcaggttctaggctcaggagcatggaaattggaattctttttaattgaccatatggttagttttgcagctttgtgaagctataaatctttggtggagttgtaacccagcagaagtgtcaccagaggaaatttttttttaactttttcctcttgtttcttcccaaaactcacttaaagaaaaaaaaaaaaccatgcagcttttgatatatacacactggtgagtgaagtgtgggggggcagtaggtcttggacaagtgagcgtggcagggatctgtcaggcagatccagcagttccagccccattctgagagctcgcaatttagcttttgctggtgccagcaattataaaaggggcctactcagctttaagcactcaagtgttgatggacaaagtgctagtttaacagatctgcgtaatggggaacaggtggataaatacaggattagggagccctttacagtaacagccttattatcacatgttatgtggggtttttgccttcatttgacaacttgggttgtgtaaaaaaattttaagtaacacaacatagaggaaacccttcataacaaagcactgaaacaattaatcaagatttatgaaacctctgggtagtagtggtgtatcaaccaaagtggctatttctgatcagacccacagcctcctaaatgaataaatggagagcacagcaccagaagccacagcctccataagtggtacaattgttttccataattgaagatagcaaaagcctgtgtacgatcaaagaccattccattaggagagtgaggatgtaataaggggacagatttgagtctgcccagcctggaaggcatataatctatccccctgtctccaccacagcaaaccccactggtgaagcttactccatctcaaatggtggctgtaatccaccttttgcccttaggaaattgtattagtccagacctaacccccttattaagaggaagcacttttgccatagaaatcatctacttttctgtttccttttttttttttttttgagatggagtcactgttgctcaggctggagtgtagtggtgcaatctcggctcactgcaacctctgctcctggattcaagtgattcgcatgtctcagcctcccaggtagctggaattacaggtgtgcgccaccatgcccagctaatttttgtatttttagtagaaatgaggtttcaccatgttgcccaggctggtctcgaactcctgacctcaggtgatttgcccaccttggcctcccaaagtgctgggattataggtgtgagccactgtgcctggcccctttcttttaaatcaccataggatttattaaatgagcactgtatagatttgttttacaatttttaacctttatgtaaataatgtcctctcttttacccctttaaaagctgtttcttggctacataatatgttttggctgtttatctatatgagatagagctctagtttattttaactgctgtatattattttattatgtgaataaaccatactttattaatcctcctattggatatttagattgtttttcatttttaatataatgacgaagtccacagtcaaccattgtttctttatgccaaggattaggtttgctgggtgtgttagtctgttttgcattgctataaaggaatacctgagactgggtactatctaaagaaaagaggtttattcggcttatggttctactggctgtacaagcatggcaccagcatatgcttggcttctggtgaggcctcaggcagcttccaatcatggaagaaagcaaagagggagccaatgtatcacaggggaagagagggagcaaaagagatgccaggttctttggaacagccagctcctgtgtgaactaagagcgagaactcattcatcaccaagggaaagccattcatgagagttccgtccctatgacccagcacctcccactaggccccgcctccaacactggggatcacatttcaacatgagatttggaggggacagaacatccaaagcgtatcatggggtcataaggtgtgagcatcttcaccccaactgcttattgccagttgctctgcggtggttgaattcatgcgtgtgcctgggaagtgtctgagagttccctttcaccatatcttgctgaacattgactgtcaacagacattttaatattctcctgtgtgataaatataaaataccatctcactattccgatcatttggattttcccaattactagtgaaattgagcatctttttacacatttataggctattcaacataatatcctttgtccatatttttattgagttgtttatcttttttgtatttacctgtaaagctctttatatactctggatactaattttttttggttgtatgttttgtaaccattcattatttccttgattccctttattaagtaacagaagatataaccaaataggttggaagctatagcatatagagtcatgcaggtgatgctcaggagttaagagtctctcctgcaggcagtggggagccgttgagggttattaaaatgaggaataacatgatcagatttgctatagaaagaaaaggaaagcagcagaacagaggaggatggattgcagagaggagaggctagacggtggtgccaattaagaggcttttgcaagaatccaggagagaaataatgaggacctgaacctaaaccatgacagtgactcctaggaggatttccaaggatttccgggaactatttgagaatgggatgggcaatgctagtgagaattcagtggagcattttaatcagccctttcctattgattcacagagttcctttcccatcttgcctcggtgaggattgtttccatcatcccttggccactcaagtctacttaccgggttagagacttgttgggtctatgatgtccagttagatttcccttcaacgagacccagggggacattctgccagccattgacagatcttaattctccctttggctctcacttgttcccttcatgccaccttgtttgcctctccctgactctccctctctctctcttttctctttttttttaaattttatttcccatttttaaatcatgcacagtataatacaataagcattaaatcatgcaaattggtctaggttacattttgaaaaatgttaagaggaaactgttaagagaccagtttctgacaggcaatgcattttaaagttgagggatttgaaatatttcagcagtggacctaaaacagcattataaattagttcaacttatcagccctaaacagaattattcatcttccaaaagggtatttcatggccgctgggcccaaacgatcgttcaccttcatttctgccctgctctaagggtaggtctcactttactgaattctcctgattcattactgtgtgttactttatgaattttttatcagcattttaatagctctttcagatgattgaatgtaactgattcttgtagcagaacactgattgaacagagagacagtaatgtatgtcgtaggggttagcttcaagccaagcaacagagttttttacctataaagatgtgctttttctcccctcactaagagtctctgcagatagaagctgcccccctcctccttccacacacccgcaccttacccaccaggatttaggcaggaatctgccattttcagtttccggcatggtactgccagcaaagagagggaaaaatcagcccaagcctgaagcaccctctttttgctcatcaaaagtatgaaatgattaagatttcggaggttcttgggataagagaaagacattagactacctcagaccagcaggaggatggtctgtgggaagagcattggagtctgagccaagcatgaatctcagctgtcccttccttgctgtatcaccttgggttcttcgtctcattgtcctgagctttttcactttcctgtagatcagaataacccacctttcctggttattgtgaggattaaatgagaaattgtattagaaactccaggcacatcagaggcccctcaggaaatgtttgctacatatgaataacgtacacgaaagcacttgtgtggcactgtacaaatataacttattaatataagccacagtgatgcttgaccaagaaaagactttttataatactgtatgctaggttgaaccatatgagattctattttaatagacccaaaatggcaacttcatatggttcaacccaatattttacattgtttgatcatctgtttcctggttacaatgaaaaaaaaatgtgagggatttgtgtttgggtagtgggggaattatatagctataaggaatattagagataattaggtgcaattttctctcctgatgagaaacccaaggtccagaccacactggtagtaagaagtagagatatgagaacacactcagttcttcccaaatcccaggacttatgcagcatatcacacagccttcctgaataagggatttgttttcttataacaagtatataaccggacttgaaagagaatccagatcctcttcagccttgaccaggattctttcttctgtatatgctcacctgtgtacagcacccaacactggggaggttctcaagagggtttcttagacaactgattgacttcaaatggcaactagagagaaatcaaaatgagttgtagacattggtacatgggtttggtggtatcagataagtgaactgacacctgaatcttagctgcaaatcccagccatcatttgattcttggtgtgtcttctacctcaaaatgatacaaattggagttgacatgagtttttagggaatctacagaaccaactagagttcagtgttttggggcaaattgtatatacacatatatacaaattgcatatacacatatatacaaattgcatatacacatatatacaaattgcatatataatatatattataattaaataaaatatatataatgtattattacatataaattatacatgtataatttgcccagaaacaatttgtgtccagttaatgatagaaattgttcacttaatatacacatacatagtttgcatatgtatacatatgaatacacacacacacgatttgtgtccagttaatgatagaaattgctcacttaatcatttgtatgtatacatatatacatacataatttgtatatacccacacacacatacatgatttgtatccagttacattaatgatggaaattgctcacttaagctctgaaagtcatcaaccaatccagaaaaatacataaatggaagaatgggctggcaagaaatgagtggaagtgaaatgtcttatttggcaaatgaaaatatagccatttgggcagatacttactcatgaaatgctgataaaatacttgaatcaccaatatccttgtttgcttccctgtttatgtcaacatcttaatgtgaaatataattacaatgaacattcagaaacagaatggcaaagcctggctaaatttattctaatgtccattcttatgctgaaagctaggtctccaaatgtacttctaaaattattttttacaatatgtactttaataggattgcaggattgaaatatagcttttgtggggcaatcaggacgcaggggagaagttatatgaaagttgggtaaagattgggggattttatggctgattttcatgatcctgctaaatcatgtggtcacagtgggatgaatgaagaatgaacactagaaaaacgtgtctttttgggctgggtgcggtggctcatgcctgtaatcccagcactttgggagaccaaggcgggcggatcacgaggtcaggagatcaagaccatcctggctaacacggtgaaaccccgtctctactaaaaaaatacaaaaaattagccaggcgtggtggcgggtgcctgtagtcccagctacttgggaggctaaggcaggagaatggcgtgaaccaggagccggagcttgcagtgagccgagatcgcgccactgcactccagcctgggcgacagagtgagactccgtctcaaaaaaaaaaaaaaaatgtgtcgttttgtttgtttgtttgagacagagtctcactccatgacccaggctggagtacagtgatgctatctcagttcactgcaacttccgcctcccggattcaagcgattcttgtgcctcagcctcctgagtagctggcattacaggtgcacaccaccacacccagctaatttttgcatttttagtagagacggggttttaccatgttggccaggctggtcttgaactcttggcctcaagtgatctgcccacctcagcttcccaaagtgccgggattacaggcatgagccaccacaccccgccaataatatgtacctcttttcacccatgtagttactgcttatggacttttctccattaaaaaaaaatcaaaacactaaaagcctttatttacactgtttgctctttcttttacatctactctgtatcttcttcctaattaagaatagttgggaacctccagggtcaaatagaaatggtggcatcaacacggtcatagagaactctgatgttcaaaggacatggccatggaaaatcaaagggaagactaataaagttaaaggaaagtttcaggtttgttgggcccaaggactcctgaaaggataggattaatgtgttttttgagccaaagttctgcccttgaaagggaaatctcctctgagctttgagtagctggtgctgcatcctttaaaaatgtattggatggaattaatagtgagcgttgccacatcccttcttcccagcccaaccaagaaccagggaaccagtcattctgtcacaaaatgaatagaagttatatccaaatgccaataaaacccagttagaatttaatgtaggacataactagagtgttaaatatgacaaactaactttgagataagtctgagagctcaagttccaacagaaacaaaaccttttatggacaaatagcttcgtatctcatatgctactcccaacagctcatttagatgaataatacagattctgcattggatctgtattggatggaggaaattgagacatagagcagttgtgacttgcctgaggacacacaaagttagtgacactggcagggttctaccatatcactttacttaatatgagcagcttctacttgattgggtgttctgtcagctggccatgaggaggggcaaaggaagccattcaaggaatctgaattgccaatgaggctgttagctgagtctactttttgaaataacttcatcatgatataatttatgtatcataaagttgacccatttttaagtgtgcaattcaattagttctttatatattataaatacaaatcctttatcagatatgtgatttccagatgttttctttcagtctatggcttgtcttttcattttcttaatggtgccttctgaagcatgaaagttttctatttcaatgaggtcctctttatctctttttttatggttcatgcttttgctgttatgtccaaattcaaaggaatgttttttaaaaataagtattatcaagtcttgttctctctctttctctctgacacacatgcatacacacacacatgagcaagcttaaagtcctgcatgaccccagatttcatctggaataaaacccaagtctgttgctgtggcccacaaggtcttccctgatctggcacctgtgcctggtctctcctcagccacatgttccagcctcactggcctcatttttttcctggaaaacgctaaatatgttcctttctctgggcctctgcttttgctgttttctctgcctagaatgttgtctccagcaattcttgtagctggcttcctcctttcatccaggtcccacctttagatatcacgtgcatcatgatcacgccttagattattcaggagatatttattctactaaaagagccttcttccagccaataaaaaatacccttttaaaaatttccttcgcagtactttctgagattattttgactttttaaaaatttacatgtgagcaccgtggagaccttgtctgggtgctcactgcccctttcttggcaccttgagcagtgcctggtacaaatgagcggctgagtaagtatttgtggaatgctcaatgaatgttaaactgagaagcagttcagagatcagagtcactgtttaaacaaatcaggatcttcaacaattctttcctaatgagcctttctttgtcaaactcatttcattccaatcactcctgtgtttcccccacgcttggagaaacaatctttctggtgcttcctttcattttttttgcagatgtccttgcattggttcatattcttttcttccttggaagtttcccaccccaccccgaattaggaagttcctcagggacagaatccatgtcaactactttatcttctgtctctccatgcctagcaaatgctaggtgtttggtcactgagtagatgaatgaatgtacatccctgaccttcacccttgttccttgagtggagaaaaaagaccccaggctgtgtgtactcttcatttctggaatgagggttcttgtacatcccatcatcagctctcctgggcttttattctgaaggctagtggaggcacaactgcaaaagactttgcagatacgacgtgtgaaatgccaagaggaagaaaaattgaaagcaggagttgcatcttgccatgtgatgtgaatacctttctggcactatgacagtctcctcatggtgggcagtgggataccatgtgagaccaagcaagggcccaagtcacctgcagctctgagatgcctgcagaattctgtggaaaacttcccaaatgcacttagaccccagggttttgatgatgttgatggttctctgttcagttttttagtttctgtcaaaatgtattatctaaactctttactcagtcctacctacaaaatacactttcatatttcttactaatcactttactactgaagtaaattttactagttcacttttccagtggactttgattaggacatgagaagtatttgttggcacctataggcagacttagatgcaatgttttactttgatgccaaaagtgggggaaggccttagaccaatagcatggcgtttgttattttagtttaccattctccctccaaacggcccatttcactgagactggggctatcttgctgcagcttggagtcaaacacacatggatgtgactctgcctttgcctctcagagcctcagtttcctcatctataaaatgaggctaatagtacccagctgatagggctattgagaggatcacatgaaataacatatcagatgttcttattacagtggttaggtacagagtaaatacagaataaggggtagctttattatgaggatttatatgattattagcattattattgctatggctgcaaccagtactaccaagaagagaaatgccactcaagcgaggacaactcagtaggtgtgacgtttaaaccaacagagaaatcagtgcatttttacttatttatacctttacctggttccataaaagttttatccctgtttctaaaaagaatgcatcaaataaattgaagtgaacacagaaagaaaaaatagcaactaagaaaaaaacacagatatgggaaactttttttataatttcagctttcattttggattcagggggtatatgtgtaggtttgttacttgggtatattttgtgatgctgagatttgaggcatgaatgatcccatcaccagatactgagcagagtacccagtaggtatttctttagctcttgccttcttccctctctccactcctctagtagtccccactgtctgttgttgccacgttttgtccatgtatacccaatatttagcttccacttacaagggaaaatatacagtatttgtttttctgttcctgtattaatttggttaggctaatggcctctagctgtatccatattgctgcaaaggacatgattttgttcttttgtatggctgcttagtattccatgatgtatatgtaccacattttctttatccagtccactgttgatgggcacctaggttgcttctgtgtctttgctattgtgaatagtgttgcagtgaacacatttgtgcatgtgtctttttggtagaacagtttattttcctttgagcgtatgcccagtaatgagattactggatcaaatggcagttctaagttctctgaaaaatctccagattgcttttgctgcagaaaacttaaagatcatgtaattgccacaactgagcttcagattttaaactgagattcctggcagccaaggtcaacttcactacataattaatttaagaatgagaccgccatttcttcaggattcaaagctgcttctaaaactaatttccaagataactttcttacctgggactttatgcagtgaacagtattccaacaacatgttctcctcaaatgcaataacagattttttatggctgcttctggtagcacctttttgataatagcaaagcagcatggcattaaaatacaatccggtgacagcagttctgtgtggggctaaggtaatatggccctagtgtgtagctgtgaggtggtcagacttgatccagggatagaatgtagagtgttttgaagaatggttgaactgcttgtccttcaaataatcttttgtaaatattgcttttctcagcttgccttttgataggagttgaatagcagacagtttgagattgtattctctgacaaaagcctggtgtgtttgtattctctgttcctggtccagggcagagccttatgccttagaaatcagaagtgcaagtggtaaagttgacatcttactgtaaaaattggactcctgcctgaacagaaggccattctccctctccctaggtggagctgcaggaatacttgcaaacaaatctagactcctcttcaggaatcagtttgggggcgtctaggggtctagtgtggcattcagacttgctgccctgggccttattcagtaggtctaaactgcagtgcagcgcactctggttaggggtagattcagaaggtaagatggcgcaaggacaagctctagcctatagctggaaagtacaacgcaccgtgccccacagcaccctttgagagacacctgcccagcaggaaggaggctgcactggaaacatcacctgagcactccaggcgaaaaccggtgaatcagctctagagggtggcttagatctttcccgcctgggtttctcactgccctgccccaagcagtagaaactgtaattccttcacacaagtctaagcaacatgatttcttcataaacctggcagatcaactggctataaaattttctcttaagaaattaaacaaattaacctgttcagtgaagttattcgaacaaaatggttacatttggaggcaacgctactattttaggttgctgtagttactgttgagtcattctttctgaccatggatgccaagaccatttatctattgacactagtttatgtcaaggtctataaggaagaacttgtgttaggtagagagaaaataataaagcagaaaggaaccatgcagatgatccagtacaatcttcacattttccagaggcctggaagtatttcctcaaagcctgggggaagtcctgactctcccacttacaatggtcattattccatgtgaagactgtttccaccatatagttggtcaggtatgtgtattagggagagataaaataataaaatgaaggtggctgttggattccttagaatccaggggcctcatccacattgataaatatttatcttgttctaattaggacctacatgcctacattaactggtggaagagctctcagttgcattaagctccctggcagaaagaaatggcctggaggctgcttcctctcaagtgagaaagggtcttccaggactgttcgaacaaaaggcatcagggaagtacctcttgagtctgtcctgtgaaagtcaacccagtttcttggctttccaggcagcctcacattgccttgactattactccagttcattaaatgttaatgggttatcaatataggaagagtaatcccctgaagtccctttaatatgttttattcttcctctcaaataaatgattgattaacatcaataggaattgttcaatatatgctgtctgcaagactccttgctccttgaggctttctcctgtggtttatagcccagtgcagacgcctcgatgagatcttaaatagagagagtggtaaaagtttatgtcagctcgtcagtgaaatggaggtggggaaggatctaataagtgcactggcttgaggatgatggcattttcataaatcacactgttcttttccctcttggtcggtcctgcttgtagaatcatagtatcttagagatggaaagggccttgaggttattttttccagcttcccattcttcaaggaattccttctatagctttcctgacagacagtcggatagcacctgcctgtacctccagggatgggccttaccttcctcctgaggcacgccttcagctcctctgcagttctgctagtggaagattttccccattccatcagttgtcatagttcctattcctttttctcacgactcaggttagagttgtaatcttccatttatttgattgcctctcctaaaagactgtaagctccaggaggccagaggccctttccttgttagctggccattccatatcatgccttgcccattgaagggactcaatgtatatttgttgaatgaatgaatgaatgaatgaatgaatgcacttaagtttagaaattccagaaagaactaggaagatattacataacatgaaaatggaaatagagtattttttcccagataccagctgatgtgctcaagatgactttagggtgaatatggaggaaggagtgaggggaagtacccaggaaagagtgacgggttatgactgagcaacattcagagcatgggaaaaacaaaaggatcttgactttttaatgcagcctggtaaatatcattgagatttggcaggaccaaaactgagcattggaaaagggatggaaaagtcttccctatgaggaaaggagcccacttgtggagaagatgaacactcgcatggaagcccacagaagtgagagaggtggcctggaggagggcactcgagtgaggagatgggcacctccagccttgggtcagtcacaaaggaaggacagaggcaggaaacaggagcattctggacagggggccctggccgctgctcacagcagctcatcttctggcgggagagggttagctcctgcccagtgtcctcacgtacgagagtggtgagtttctaatgcatcacctctcaccatgcaccccaagacagctgctcttctgaatcctacctagagaaaaaaaaataacccacacaattctcgctgtctctcaacctcccacatctaatgagtcacccagttttgtcacttcatccttgggatgtctcttgacatgctttttcttcctttccactaatgtagctcagatcccaaattctctctgggaccatcacttgccatacgcagctgagtcacataaagaggttgcccttacacaacagatctctgctcactgttgcctaagacaccgcacgctctgctgacatcgtttattcttcctgaagagtcctttagttcatcacctggtgcttgctggccaggttctataccatcttcaagatcctgcttctgaggccgtgtgcggtggcttacacctgtaatcccagcactttgggaggccaaggcgggcagatcatttgaggccaggagttggagaccagcctggccaacacggtgaaaccccatctctactaaaaatacataaattagccaggcgtggtggcacatgcctgtaatcccagctactctggaggctgagacacgagattcacttgtctgggaggcagagattgcagggagccgagatcgtgccactgcactccagcctgggtgacagcaagactctgtgtcaaaaaaataaaaaatcctgcttctgttcttctcttcatgactgcccgtccaactccctctgccccctggcctgtgattgtgttcccatctgtaccttcttacacttacctccatctgccttatgtgtgcctttgaagttcctgcccttgcctcctctctcccgacaccctcaccagcctctgaatctctgaatggtcttagtcacacttgcttccagtcagccttacaccccagcattgtgttttacatacaggctgcactcactgaatgtttattgacttgaatgggatgtttcttcctaagacatcaattccatgtcttatgatttttcatgcttttcaaaatattttcacagagtctgtttcagatcattcttggtgctggtatcacacaagctgagctgccttcctggggttcaccctttgctctcctttgctcatctccgttgttctggtctcctccagaaatctgctgaggtgacatcgtctccagtgacctctgccaatttgttccaacatgggaatgacatgctgatttaaaacagttgaagcatactccagaatgactagaaatggtctcgtgtttgaagtttctgctcattggtggaagttaaaattccagtttctccagcaacatttggttaaatgtccctatccagcattggaactgctcactgatctctttttttgggggggttgaacccctgcccatcttctcagtatttcaagggcatagtcacttggctgtaataactgctcaaactatttactcaccagttttaagtatagatcagcctggtgtttatgtgataaaattctagaaacttcttcctttgcatctttctctacctgtgcccaccaagaaaaggagccgtacttcaccccatagccgtagatcaaatgaaaagaaataaatttctcacttgtctctaccctatgctaccttttcctttgttaaaaagggagataaaagagaaaagaaaacactggtctacataaatagcactaaatataaacagtggaaatgggcttctgggctttgaactctacagggaagttgttatggcaacctcaagttgaattcactgggggggaagtgtcagtattaatgagataagatcgaacttgtgactccaatggtaactgtattctccaaggtttttcttcttactgagacaagaagcaaagcctttattttatcagtgacatctagatttagaattgggagacaaattgtgtgggcattggggcctggagtttagtttccaggatgaggtttctatttctctgttgagaggaattagagccactcctaacacacctgctttagctattcttgttcaaagcctatagttgtaaatttagaggatgggtaacatagaccattaattccctaaagagacttgaagttcacttaaatttaaggattttttttttttttttttttttttttactggagtgttacacagatttttctatagggataaggtaataagatataattgatattgtaactgtccagtggaggttaagttcccaaaacagtgattgaccatgggtcaagattcccccaatgaagaagaaattctaaaatctgaagagagagagaaataaaaaaaaataataaaaaaaaaacccaggtaatggaaagccctggttgagggcgagaggaaagggttgcagagcacgctgagcaggtactgcctatggaagtactgactctgacttcagaggtggggagacagaggtaagagcatgaagtatgtaaatactcaaagtgtttatactgcattactttatcatggaagtaagtaatgtatgaaatttgcattatagaaattagactgagatgctaatcatttcttgttcctaaagctgaagacatctataaaataagtttctaattcggagaggtgagcaaggatccacaggttaagcagacttcaaaaatataccatctagtgccgggcacagtggcacacgcctctagtcccagctacttgggaggctgaggcaaaggatcacgtgagcccaggagatcgaggctgtagggtgctagttcagggctgttgtgcactatgattatgcctgcgaatagccactgcattctagtctgggcatcatagcaagatctcatcttaaaaaaaaaaaaggagtatgccctccatctagaaggggaacagtgagccccagggcacaaagagagggaacaaaaaagtaagggtgggcaaagcaaatgaaggaggataatagcaaccagaaaaacttcttcccaaatgttgtttatttgttgaaagagtaaactcattcataaactatggccatgtataaacaccactgtactaacccaaggagacataggagtgcctcagaacagcagttggttgactaatgccaaaaagggcctggagcctctcaaaaccccaccaccacaaacacatgaaagagctacttcttctgggcagacccttaaatggaaaagcctagaaaataccaacactgcaaactgaactactttgcaattctctccaaattctgtcttcaccatgctggaaaaatggaataaagaaccaaaatcaacgatagcagtgtagattgcatgtaataaagagctaaaaaatttatgtatttcatagcctacaaagccccttcataaataatctttgcaaagcaatcatgtgagctagacaggacagatagagtgactctcgttttacaaatggagaaagtgaggcttggagagccgaccagacctgctaaaactgtacagcttccaagggctaaacctggaacttgagcccaggctgaattctctgtattcagaccctctgctctttctatggcaaagtgcctcaagaaaccaggcaaatcgtacctataaaagaaatgtcaaatcacgcagaattcacataaaattacttgaaaaggctcctgcctttcatcccaggctgtccttcacgctgctggcatatcctgcaaatgtcatggcttcagtgcccagggttttgccagaaagaacatgctgccagcctgccgaatgaaggatgcgacttgagaagcagcagaatttggagaggaacaatggagttctccttctagggggtgggatcagtgaccatagttctcagggggcagtgatgaaacagggctttgtgtctattcaggaatagtatccagaagctcacttatttttgctttccaaataagtaaatatcagaaaggatagctgaggtcagtctagaaaattagaatttgcttgggggaaaaatatgttctggaaaagataaacagtagcttgcagtttcactgttggaacatttgttacaaggtcctggtattgatcttttatcacccaatttccactgggagccatgatgtattaccacactgggaagctctaatgcaagtgcgtgaatcaagggagattctagacaacatctgtagtgaggcagcatccatttgagggagggaagattgggaagggggtgttgctagctgcaaaattccaaggggagttttgcgttgtgctgtgtgcaaatgcatatccgtgctggggagtgttatgggtttatgaggagagtgattaaaattgtatcaaagaggcttatgaagcttatggttcaagttaactgtatgaagtaaacagcctttaacggcctcctgggagtgtgacagatagtctgtgggtgttacggcaacatggtactggtgaatgttctggccatcccaaactaatcaccatctgtgagcatgggtctctggggagcgtctggtggttggacaatcatggtagttagcatttttaatcagcttctgtgcggcacagatagaaaccttatgctcaagcctttctttttctgtctgtgtagaattacttatgatgatgatagcagagccgacaagggtttgggttgtgcctctgcaggatacattctgtggttctctgccctccctcttccccagcccccagcctgaccgtggaaattagcctggccactgcttatggtcactgcttttattacttctctttaccactagcaaaagggatgtcaggggaggggggatgtttctgggtttagtgggactgctgcctcgggtcaggatcttgagtttgagattcttctctctcctgctttcctctcctactgcttccttcatcaccaccacctctagctctgccccaacattcactcacccatcaggcaccaacttcttttttcttgttcttattatcgttgggaagcattacttgagggcatcgttggatgccctctaagggacccaggcaaaaggggaagtcaatggtaccatccctagaagtaggcaggcctcatggatgtttttgctgtgcaacagacttgagcagctgtgacagactgtaaggtctgcaaaactaaaagtatttgtgatacagccctttagagaaaaggttggctgactcctggcttagagtattccttattcttgagaaatatttgatctagcaaactgtactaagatgagacataaatatctaaatcagaatatacatttcattaggccagtatatgcacatttcatggtaggtaactaattcagtgggctgattaaaataatttattgtaacaaaagtatttggaactgcctgtaattaaaactaagatttattaaagaaacaaaagtcgccaggcctgcagacagctagatcctgtgcgtgagggttgtcttagtccattttatgttgctctaaaggaatacctgaggctgggtaatttttataaagaaaagaggtttatttgactcatggttctgcaggctttgcaagcatggtgccagcatctgctctgcttctggtgaggcctcaggaagcttttattcatggcagaaggtgaagagggagcaggcatgtcatatggtgagagacggagcaaaagaaagggcttgggggtggggttccaggctttaaataatcggctctcatgtgaactgatagaaggagagctgactcatcaccaagaggatggcaccaagccattcatgagggatccacccccatgaccccaacacctcccaccaggccccacctccaacactgaggaccacattttaccatgagatttggaggggacaaatatccaaaccatatcaaggatgaaaggagagggtgtcagttagcttttgttatataacaaacccccccaaaacttagcgactttaaacaactattttaagtagctcataattctgtgggtcaggcaggtgattgtacctctctgggccagctcagctgatctctgctggcttctgtcagtcatctgtggccagctggggttggctggtctagattgtttgacttacgtctggtgaataacaggctgattggtctggggatggtgctgggacttggctgggacagttcatctctgctccatgtggctcttacccttcagtaggctaacccaggcttcactgcatggcaatctcaggattccaaggagcagcaagagagcaggccccagtgaatatgcactttgcaagcttcagcttgtatcgcgttgctgatgagccactggccaatgcaagtcacaaaactggcccagagttaacgtgggaagtgaccccaaggatgtggatacagggaggcatgaccaaatcagaagccattacttcaacaatctctgcaaagaagagaggtttccttctcttcataatctctaccacctttcatggtgcctagaatttacattacagatttattcctttgggtcttaaagagtctgcagtcttcaagaggacccctgttatatgaaggtgtagttgttcaaccaaggcctacccagagcttagctgataactgagaacagggtcgataccagggtatcagacaccaagaaagaatatgaaagggaaggtgagaaggcactagaaaaaaatgaactattcctgcattcgcgtatccagctacccacaagaaacccctacgtggctgttcagggggcacagcaaatccatactgtctcagaccaaccccatcaccttgccttcttccttctctccaacatgatttttcattctcgcagcaaatacagtgcctcgtcttgaccagtgaagatggaaatgaggggaggtggaggtaaaggcctgcagaacaaaatggaagaaagggaatgacaggtaggaaagggtagaaaattattgctgagtctaagtattgagggttcaactcagtaattgattccatccaagtttaagacagtggacacattcctctgtttttttggttccttatcctttgcttccactcctgaaaggattataatcctcattcttgtagttgtggatggttatggccagagaaggccatagggacagtcatcaaggaaagcagaggcctctcactcaggagatgcctcagcattttactgtcttcaaagacaacagcccaagtgctggagcagccagaaaggaaccggcctgatttatttatttatttagagacttggtctcactctgtcacccaggctggagtgcagtagcatgaacacggctcacttgcagattcaatctcaagcaatcctcctgcctcagcctccctagtagctgggaccacaggcatggaccaccatgcccagctactttttaatttttttgtagaaacggtctcgctttgctgcccaggctggtctcaaactcctgggcacacgcgatcctcacacctgaccctcccggagtgatgggattataggcgtgaggcaccattcccagaccagcctgttttctaatgggtgtccacattaaatctgaactctgcctcaagttgtagctgctgctgagagaaccctggctctatgcttttctcacaaaagagctgttccagactgcccttagaatgttttctcccgtggcagaacagctgttttctgttcagctgtcccttacattgtagctctatgctggaactagctcgtgtttaatgctgtgttatgggtaaagccctcttgccttgtaggtgacactaataaaatcacagaagagatcaaacctagaatctctgccgatgcagacctcatagtcagacaaagagttggatgcttccattgctctcctagcttaggctggagctggaattctcacagcaaccagcagggagctggcaagtaatggctgctgtgtcctcctagaccagggccagcctttagtagcagctgagcgtgggagtggcaggcaagcttggcaccatgcagcagtgggcttccttgggtgctggaagtacagtcagggaacccttgttctgtccactctgcctacacaatggttgccttcagtctggagagtagtgaatggcaatgagtaatgagtaaagggggaccctcttcataatggcaggggctgggagccttctgggttgaatattttgtagcactcaaagagatggccaactaagaggtcgctctggtattgccttttctctgcctccacatcggcaggcttccagcaccccactattctggatctcaacattggacaagtgtactaatgttcaagcaggggcctgggtgagatggcctcatggtgccctgctggttgctgccttttgctgctcttttacaatccctgtactcaagggttgatttctgacgcctgggagggttggcactttgggaaagaccaatgagatttttacatttgagattttcagcatgtcaaacataggcaagacagaatatcggggagttattgggaatatgaatttgtttgtttgtttgtttgtttgtttgtttgtttgtttgtttgttttgagacagagtctcactctgtcgcccgggctggagtgcagtggcacaatctcagctcactgcaacctccgcctcccaggttcaagcgattctcctgcctcagcctcctgagaagctgagattacaggcatgtgccactatgcccagctaattctgtatttttagtagagaaggggtttcgccatgttggtcagcatgttcttgaactcctgacctcaggtgatccgcccacctcggcctcccaaagtgctgggattacaggcgtgagccactgtgcccagcctttttttgttttttaaataggcactaggagagcaatatctttacattttgttacctgtgaacactcagcacaggaccatataggtaatagtaatggtgattatggtgatggcagtaatgatgatgatgatttagtatgattcaccaacaggttataagacttcagaatgtcacgaactggtgaaaaaaaaatgtatatttttttgtaattgtaggaggcctgcatagagttgaattgctagctttttatattgccaagtaagaatttttttaaagtatgaataccataaactatcaccatctatttcataaaaaaaaaaaaaaaaagatgtaatgtactggttaagagttgtacactcaaagaaattctgatgatacctgggctagtaagctgtgtgaccttgggaaatttaagtaacttctctgcctcagttccctcattgtgaaatggggatgattataactgtaactaccttatgggattattggcagaattaagtgaattaatgaatgaaaggcactgagagcctggcacagagagcacttggtgcctcttatatttttattgttgtcactaataccaaagaacaagacatatataatattagaataagtaacaattctgcacatgaaaactgaaaattcactgcattgttgtgttgttttcttttttatttttatttatatttatttatatatttattttttgagacggagtctcactctgtcgcccaggctagagtgcagtggcgtgatctcggctcactgcaacctccgcctcccaggttcaagtgattctcctgcctcagcctcctgagtagctggaattacaggcacccgccaccccacccagctcagttttgtatttttagtagagacggggtttcaccaggttagccaggctggtctcaaactcctgacctcaggtgatccacccgcctcagcttcccaaagtgctgagattacaggcgtgagccactgcgcccagcctgttgtgttgttttcatcttacttggttataggccagtggtgatctgggagccactggtggaccacactggcttagttagtcttccttctttcctccaccaaaagacatgcagagcgttactgccttcccacccaataaagaggatggtaggtgagaaaataaagagctatactgtaagcagagcaactgggtttccaaggagggagtgtaaaacaaaggatctcagtgtgggagtgtctaaggttgaagctgtcccaaggcaataccttctacccctactctaaattaaaggagtcataactctttgtggttcctgtaaaagtagttaagaggccggcacggtggctcacccctgtaataccagcaatttgggaggccaaggtgggtggatcacttgaggtcaggagttcgaaaccagcctggccaacatggcgaaaccctgtctctactaaaaatataaaataattagccaggtaggcacaagaatcacttgaaccagggaggcagaggttgcagtgagccgagatggtgccactgcactccagtatgagtgacagagtgagactccatctcaaaaaattaaaaaataaaagtaattaagagtcaaagggcatcattacatagagacacaaaatgaaagtcagtattgtatgcgcctttgccctgttttagaccttcttaacatatgggagcccaagtagcccaaccatggtggaagagaagatttcatggcctttctcattggtcctcaccgtgaatatgcagagtaggcacacctctctgcagagaactcctctaagaaaccagattcaatgatctgatgatcccgcttctgctgatatgctagaagccaaggcttttttttttttttttttttttttttcagtagaagaatcaaaagtaggccaagcgcagtggctcacgcctgtaatcccaggactttgggaggctgaggcgggcggatcacctgaggtcgggagttcaagaccagcctgaccaacatggagaaacttcgtctctactaaaaatacaaaattagccgggcgagttggcgcatgcttgtaatcctagctacttgggaggctgaggcaggtgaatcgcttgaacccaggaggtggaggttgcggtgagctgagattgtgccattgcactccagcctgggcaacaagagtgaaactctgtctcaaagaaaaaagaaaaagaaaaatcaaaagtaataacaggaaggaatgtgttagcaactgtagagtattagatgtatggctgaccttccaaccagctagctctctggtccccagccccactccacaacacatcctcaggttcccagttcaaaactttaaggccgctgaaacccaggctccatgcacattcatcattttagccccactttcagacatttatatgttggtgctcatgccaagccaccttggaaaacaaggacaagtatatgttcccctccacctccttcccaccagtacccagcgtgaggtctgtacatagtagatcctccataaatctggtgtaaaacaaaataaaagcaggtgaccttctgtaaccaagatgtgtgtagctacatccatccactcccagtactacaacattggatttttgttgctgttaaatcaaaattttagtctttcagaattaattctctttgcttaaaattaattatgacaggttgtgttttttacacactgctgaaatgtgtaaagcagtttgggagaagagggcctcctttcctgagttgatttatgttatatatgcaaactctattaatgttaaaccatgcttttcaatgaaattaagactttccagcaagcagctctctccattttatttaaagatcctagtgactgatgcacattgtgcccctgttgctacgataggagcggaggatgttggatctgagagatctcatgcttaacccttaagtgagaagtagcgtgtggtgtgggaaggtaacacagctctctcctgtaagcagaaatcaagcggtggtctactgagagccattttattacttccagagaaccctgaaggtgaaatgaaggaggaaatgaaggcaggtgggaaattaaagaaagaggagcagaaatggaagtaagaaggacgtaaaaatttcagtatcttgagaaacctgactgccgaacaaaatgtttgggctgggaagatggagaatgcacggaggcctgcaagaacatgggacagccatgacatgtgggctttgttcttccaaagagataaatgaggccaggcatggtggctcacacctgtcatcccagcattttgggaggatcacttgaggccaggagtttgagactagcctgggaaatatagtgagaccccatttctacaaaaaattttaaaaactagccaggtgtgatggcgtgcacctatagtcccagctcctccagaggctgaggctggaggatcacttgagctcagggcatcaagtctgtaatgagtcatgattgcaccactgtacttcagcctgggtgacagagtgagaccctgtgtaagagagagagtccaggcgtggtggctcatgcctataatcccagcactttgagaggtcaaggcaggagaatcacctgaggtcaggagttcaagaccagcctggccaatatggtgaaaccccgtctctactaaaaatacaaaaattggtcgggtgtggtggcaggcggctgtctgccacctgctacttgggaggctgaggcaggagcatcgcttgaacccaggaggcagaggttgcagtgatccgagatggcactgctgcactctagcctgggcaacagagcaagactccgtctcaaaaaaagaaagagagagagagataaatgaaacatctgctccttaaagcagtaatagcatagtctttaatatcaggaggaagcgttatatgttttatttaaaggttgttgatttatgaactttgtacctgtctattaagagtctggttcttgcatggttaatgtgtgaagttttaaaatttgtgcttctcatgtttaaagcatgatacccagcaaggcttctgacaccagacctttcccatattccatttcatagagcatttcatagaaaatgtttcatagaacatgtcatagatatgttcttttcgtagaacagttatatattctttccttcatcaaacatggattgaacacctattgtgtgccaggtatagtgatgggttctggatgaacaaaacgggttttctttagttctttgtaagtctttgaccccatggaattaaccgcatagttaattccacaggcatccttggtaacatagccccctctggtaacgtagcagaccacagagtgacaggtggaggggaccgaatagtgagacagtcacctgggattctatgattccacgcccctgatgctttgggctgggggagttggctgctgtcatttgtgaggtagagtcgcaacctggtacagcactaagaatccatttccttcttctcagtgactcacttcccaccatctccaattgctctctggtcatagttactatgttgttgtttgccagcagaaacagccatgttgttgtttgccagtttggggctttctgtcaacctgaaagacttccttctctccagccagtttggtcttgcagattttgttgtgaggccaacaaccaggctgtgaactgcctaagcccagccagcccttctttgaaaagccctgtggaactaggtcatcaggttgttggatggttcttacacagactgtgctgtgctgcaacttttaatgtgcactgtctatggaataccaaacttgtttccaaactaaatagtttccaatgaggatttaatgggagtttttcatttgaaatggattgaaaacaagccatttcctactcccatttcaagcaaattttggtccaattattttcctttttttaacataaagttaaatggactattctgcccatccctgactgagctgaaccgtgatttctcttgattatgcttttacactgcgaatcgcgaggctccagagacataatgggcgtctgtgggagagtggcagcaatttttaaaatcctgccagtgcttgtcagcttccactctggtgtctgctgtgcgggaagaaagcaccccaccaaaagaaaaaaagtctgccaacaaaaccagcgctgcccgcctgttctgtgggggttggcacagggatgggctcctctctgcaaacctatgtagggcatattctcagccactgaggaagcccggtttccactcatccagccctactcctcccactgttttccagccattagctttttgtggtgttgaaggtttctttctcccttttttttccttgcctcaatttttcttggtttcacttagaccatagcctcagggaaaaggagctcttggcaccctgccttccacttggtcctttaccttcagcagcccagcaaaatggaaaataagtgtctcatagtccttcttgggtggtaggttatttgttgttgtgatattgttggtggaggtggtggtcattctcttggatttgcagaagtttacagaaaactcgggagaagaaaaggcttcttgctaccatcctctctctttgggaagggcagctacccccctagcagatatgtggggagcctactgggcaatgccttgtaatgggaacagcctctttgctctcttacccagcagtgccaagaatttcactaggcccactgaagaagaaacacccttcaccccagctaccattgtagctgccctaccattgtgtgcagcccgggggaagcacacagtcgtctctgggtttctggtgaaagtccattgtgcctgctcagggctccttggtgcaggagcagtcaagccttcctggaggttgaagatcacgtgctgtgtttggtggctccccacttgggtttccatcgattcatggtattggtttgggaggtgctcacatcctcctgcaagtaccctgtagtgaggcttactctgaggatgcagctacatctcaaaacatgactccacctcttcctgcaaaatcctgactggtacaactgccagcacatccctttgaccttgagaagggtaaagcacagaggtggtaggtgacttcattagcatgacagaacgtcagagttgattagcactcaggaaaggttgtctaatgccagcctctgcctttgtaaatgtcttcagcatcaccagggaggggttgatctggtctctgcctgaacttgtgctggaaaacagttctgagcaggcaccccatggaaacctctaattcatgcaaaagtccccccctatgaagtgaagtctgtttctgttgctttttcccactggtgctaccccttcctgagtccacgaaatctaaatccagtcccctttctacctcttatccctccaggcatttgaaagcaggtacttattcctagctaagctttccttctctaggcctgctttcaggtctttcagccatccctcctattgcttggtttcccagccctgcatccttctaattgccttcttctagacatgttctgatttgttgttctgtttgttctgagctctgaggtacccagaatgaggtgagagactgtcacagcccttgacagagacccatgccaccttttagtgaaattggctgtttcgatagccttaaaagggtcgttcatttatttcaagtttaatcgagtcattcttcacatacataactgctcaccttatctgctccacgtatatgtgtgatttgtcattactgaacctatgtgcaaaccacatttattcctaaagatcatcttatcaggataagaaggaacatattcatttctttagtctgcaaagatatgttggatctgtgttttatgatccaatatactgctatttccagcttcacatcatatgcaaattcagctcaaccactgtgtgccagacattgtgctgaacctggggatacagcaggaaatcagacagcacagttgcttccctcacaatttattgggagggacagacaattgactgtgcttttccaatccagggtgacagcacaaaagaggggaactgcagaagcgtagaggaaaggtgcttcacagactcaggctttctaggaaatgtgatattgtgagaagttggccaaggaaagagctagggattaaagtttgaggtaggcagaactacatatgcagtgtttgaaaggtgacaaaaagcacggtgtcttcaacagcttatcaccaggtaatgctcctgatcctcatcagtggctgatgtgaatgtggaacctaataggatgaaagaaattaccattagaggccttcatcatctgccttcgggcacatcaaacatttatgaactcacctaattgtatttttgtcacagccacgtttctctgccttgaccacttgaattgcatgtgaaatgtatttatgtctcactgaatacagacctgttctgtctatgtcattgctcaagtttaccaatctaaaaaaaaaagacttgttcttatgacttgttcttcataacccaggttggctttgagtgatcctaaaagcttccttccttcctgagagttcactagctctcttcctaataatctgttttattttccaagtcattggttaacgtagtaggttagtggcagagttgcacctagaccccaagtatctgaactcctagtctagacatctttcctttctattgctctgctcccccttggctcatctttccagagcagagacactacacaaggtttttttaagagcagctggtcagtccctgcatccaatgtaggaggcagcaagcaaggctagcagttacgccagggagaatgcaaagtggggtgtcctctttccaggcactggcgcaggccagctacatggcatttcatctccttagcaggcctctggggtaaactttatgtgttaaactttatggttaacagagccccctgctattcattgtctcctttatttatcaaccagccccatgaagtcagtggggaaatattcttgttcccatttagcagatggggctcaaagagtagaagagacgtgcccagaggcacacagttatactgagtagctgagccaggtgtcttaaatccaggttgtctgacttctggtgccccaagctgacttcagatttcttttcttcttatatcaatgatggcatcaactccctgacctcccccttctccagaatgttgcctgggtgattgggtaagaggatataaatagtaagtgaaaaaaatagattcagttccaagcactaaggggctgagacaactagacactgtggcagtgctacagacctttagatcatttttctgacactctctagctaaaaaggaacatggacaagtgacacccaaaagtccctaggcttaaaccaactgtcttgtggaaatataatataagtatgagctattctgagcaggatgacaggattggaattcagtaaagttttagatggactttgagatccaaataagggaggagtattataaagagctctataaaaatggtttaaggaagggtgtggtggctaatgcttgtaaccccagcactttgggaggctgaggtgggtggatcatttgaggtcaggagtttgagaccagcctgaccaagatggtgaaacctcgtctctactaaaaatacaaaaattagccaggcacctataatcccagctactcgggaggggtggtggcgggcacctgtaatcccagctactcgggaggctgaggcacgagaatcgcttgaacccgggaggcagaggttgtgctgagctgagatcgcaccactgcacttgagcctaggcgacagagtgagactccatcttgggaaaaaaaaaaaaaaaaggttaaaaatgccaagctagcagagagagggactcagacacacacacctaagttgttgctccagcctaagctggcccaccactacctgactgcagtttgttgcctgtcccgtcatgcttgccttcaaaatgcctttggattgttcacaagctcaggagccatgggcctcctcctgttgaggggtgtttattgtctaaatcccttacatgtgaattaaaaataggcaaaggtaaaaaggcaggagttttctaacaggtatgggagtgctgtagtaggccagtggcaaagactatcgccattttctttgcctgggacttgttgagtctttgaagtctacctgaattccagagtctagggcttcttgattccttagcaagagcaaagggatgtgtaccctctctttcaggctttggtgaattagaccttgagacttcataattaaaatggatttaatagaggcagggaagctgggatgtctgccccagtaagcaggcatcttctgtcagaaggagaatgtgtcctttgtatttaaacggtttctccaaaaggctctaaatgagatttgggacttaaacaagatttggtgtgatttgctaattacccaagttactattacctgattaacacaggaatcctcatagtctgttgcagtgcctttcttccgggtgccaggaggcttgacatctgtcacctgttcacttggaggcattttaagtaacccaaattatgtatgtcttttctgctttaggatttggtgcctgatttttacatttaaaagttaataactacctaaaggaggtttgctgccaaaatacaagagtgaaaactgacaaatctgtttgttgctgacagtgaggtggagatcttggtttattcattccaactagttaggccgagaaatgatacacaggacagtacagagctcttcctggtgaccatcacaggcatcaggaataaatcccctcaaatctcactttgccccaccaaccttaattgaggcctccgcttgagcagtgacagaactggaagggttggaaccagaaaagctaagtgtctttctcaaaatcacacaggcctgcagttaggatttgtctttcgttgttttttattttcaagataataaaaggtttccactttgaccaccaggagaccatgctgactttcatttcagagatggggcttcagtgtgataaagtgatctaggttagagtcttagcaggtttcccttgagatctgaatggctgcggggtgtgctgggggctctgtacagcagctgttaacagttttctccttcccatgaagacggcttatttacctgggtctcagttctgaagattgtttccaggtatgctgtgtactgaagggactgagcgtgatccaaggagcctgggacctatgtacttggtgaccagactctcctctccaaaagcagggacccaggggacctcatccagcatcctgagaagcctcgctttggacaggcctgaaatttcccttccttcatcctagctctttcatccaagacagtgattcgggaaacagtatttcaaaattgaaattcaggccttgaatttcaagtctagaagaactgtccaaatcatcggtaggaagagcttggaagaaagggaaagtcccactgtaatgctaaaagagagccacccagccagggatggtctgcatccagaccagagcacaggtcaaagggaaagccgagagcagttccctaagttctggcatggcttttggacgcaaagcagctgggctgcgggcatgctgtaaggacagaggaccctttagggttccatctcttcggagagaaagtccctgctgttccagttcactgagtgtttaagaggaaataacggcctgaggcataagccactcacccatataaagtgaatacttcctcaagggcacaaagagaccacttggtaaatgacttcacccacctgctttagatggtgctccagtgcactgagaatgttaacctcattcacccttctgtggatgagcagattattcctagaaaatggtccgttcatgtttgaccaggcatagccccactgtgaatgacaaagtcttttttgacctcccacgatctttctccctttctgtctcagccaagccttttcttctggaaggagctactctcttttggctagacgatcattcagaggagtcacctctgtccctccccctactgatacatctcagggtctcagagccgtttatgttcccatttttgcatcttgacatagggatgcaaagatgggaacatcaagcatcagttcttccgagccttcatagaaggagtggggggagtgggtagacatggagatgaaacaagactggccatggactgatcattgtgtaagtctggaaatggttgcacaggagttaatttaactactttgtttactttcatattggtttgaaatttcccataacaataagctaaaaacagatagtaagggatctcaagtgtcttgggcagtggttttcccattgccacaatatatgtggtgaatgggcattatctgcttggaaaattaacaaaattaaaatttacatatagatcagtgaaaacactgctacagagttaacttaaaattttagctgggtgtggtggctcatgcctgtaatcccagcactttgggaggctgaggaatgtggattacttgaggtcaggatttccagaccaagctggccaacatggtaaaaccccatctctactaaaagtacaaaaattagccagacacagtggctcacgcctgtaatcccagctacttgggaagttgaggcaggagaatcgcttgaacccgggaggtggaggttgcagtgagccgagattgcaccactgcactccagcctaggcaacagagtgagactctgtctcaaaacaaatcaaaaaatttaatataatatgtgttcattataaaaatcattcagggccaggcgtggtagctcatgcctgtaatcccagcactttgggaggccaagatgggcggatcacgaggtcaggagattgagaccatcctggctaacacagtgaaaccccgtctctactaaaaatacaaaaaaattagccgggcatggtggcgggcacctgtagtcccagctgctggggaggctgaggcaggagaatggcatgaacccgggaggtggagctttcagtgagctgagatcatgccactgcactccagcctgggcgacagagcgagactctgtctcaaaaaaaaagaaaaaaaaaaaatcattcaggtacagccagagagagccactgtagatagtttgaaatccaaagacgtcttatgtgggcattacccacagatgtgcatgcctgtgcagcttaattttagattttgttttcttttgctttgttgttttgtgtgtttgatttcttttcaaatcagatttatgtttcttaccagctcgttttaacaactttattcaaatataatctacatgccgtaatattcacccgtactaagtgtataattcagtgattttttagtaaatttatagcgttgtgtaactattgccacaattcaattttagaacattttcatcattccagtaaaatccctcatgcccatttgcagttagtccccattaccactcccaggtcaaggcagccacgaacctattttccatctctctagatgtgctttttctggacatttcatataatggaacaatacaatgttggtgggtttttgttttgggagactgagtcttgctcagtcgcccaggctggagtgcagtggcgcaatctcggctcactgcaacctccgcctcccggggtcaagcgattctcctgtttcagccttccaagtagctgggattacaggcgcccgccaccacacccagctaatttttgtgtttgtaatagagacagggtttcaccatgttggccaggatggtctcgatctctccacctcgtgatctgcctgcctcagcctcccaaagtgctgggattacaggcgtgagccaccgtgcccggccgtaatgtgtggtcttttgcatgtggcttctttcactcgtcctaatgttttgaggttcatctacattgtagcatttatccataatttgtttccgttaattgctgaatagtattccattgtatggatataccacgttttgtttatctgttcatcagcttatggacatttggattatttctacttttttggctattattaataatgctactgtgaacactcacatacagctgagtggacatgtgttttcatttctcctggtagatacctaggaatgaaactgctatgtcatgcaataagtttctgtttaactttcttaagatactgccacactgttttccaaatggcagcttcattttacatttccccagtaatttaggtgcttctgatctccacatcctcaccaacatttgctgttgtctgacctcctgaacgtgaagtggtatctcattatggttgtagtttgtatttctctaaggatgttttgaaatggggaactgtgcgtcttccaactttgttctttttcaagattgttttggctttgtttcctttgcatttccgtatacattttcatatcaccttgtcgatttctacccgcaccccatccctccccgaaagtctgctgaataagggtgttgagcatcttttcatttgtaattagccatattcttggatgaaatactattaaaatcttcttcccactttttaagtgggttgtttatcttctaatagacttgtaagaattctgtatatattctgtatataagtccattatcctgggtatatgatttgcaaatattttctcccagtcagtggcttgacttttcatatccgtaatgctgacttttgaagcacaaaaggttttaattttgttgaagtccagtttatcagttttttttttatggatcatacttttgttgttatatctaagaactctttgcctaacctaaggtcacagagactttcttctaagaagttttataattttaactcttacattcatctatgtggctgaggtacttttttgtgtatggtatgaaataagggtctagttctgtgttcctgcatgtggatatccagttaccccatcactgtttatcgaaaagactattctttccccttgaaatgcattgccacttttgtcaaaaatcatagacaataaatacacaggcttatttctggactttcatttctattcctttgatctatatgtctatccttatgtcagtaccaggctgtcttgattactatagctttgtaggatgttttgaaatagggaactgtgcgtctcccaattttgttctttttcaagattgttttggctttgtgtcctttgcatttccatatacattttaggatcatcttgtcaatttctaccccccccccaaaaaaaaaaaagtctgctgagattttcatagggattacatttaacccacaggtcaatttgggcagaattgcctttttaacaatattgagtcttctcacccttgaagacagaatatctcttcgtttatttagatctttaatttctctcaacaatgtattatagtttttggtgtgcaagtgttgcacttcttttgtgttattgtgaataaaatttttaaaatttctttttccaattgtttattgctagtatataaaaacattgattttcatattggtcttctatcgtatgacagcccaatttttttattagttttaatagctgttttgtaaattcctttatcagatttttccgtgtacaggatcatggcatcttggaatagagacagttttgcttctttcttgtccatatgggatgacttttctttttcttgcctgatacagaattttaggaattaaaactcatccaaagtcatgccaaagatcagtgattatacttatgatatcaatgaggagacaaaagaggcaacttttggaattttaaatgagccttacagaggcaaagggaagaatgggtgactgcattagcaaggaagtaaaaataccactctacagccagacatggtggctctcacctgtaatcccaaagctttggggcaccaaagcaggagaatcacttgaaaccaggagttcaaggttacagtgagctatgatcatgccattgcatttcagcctgggcaacagagtaagatcctatctcttaaaaaattttttaaaaagccacttcgcattgactcaggtttcacagtgctcctcttagtgggtggttatttcagcaacctgaccagaacagacaagataagccctgaaacaacacgaaggagccctgagtaggaaaaggtagacaccacacactctccaggctcatttatgtaacccactggaagatctctggtctatacagaacctcatcttcatgtctacctattgttttaaaaagcattggcacttggttttctagcttgttgatggttttgttttgtttttgcagctatactttaggaaaggtgttagagaagagacgaagtaggacttgaacataaaggatgccaaaaagtgaaaggacagtagctgatagtgagggggcatattggaaatgcatttaaatatcccatgtatatttcctggacacctacagggacaaatcttatgctcaagaatttaaaagcaccactggtaggtcagtggaaggcaactccccagacttgataaggtctgaggacattggctgagcaagccaagactccagtgacgccatccatttcttttgtggctgatgaatcagattcaagtacaatgctttataattatccctatgaaattctagcatgttagtgtcgacccattattctagtccttcggcacctctttggattctgattctggttttatgagttgaagattaataactaagctttgaaggatggggggattgccaaaaaaaataagctgaacagtgctttttttgtgataatcctgtgtcctcaaagaagttaagccccatttgctgcagaaagaactcattagctcctgtagcttctaaggaggatcctcatcaaagaatcttttttaaaataagtatgtaataataaaataaaacccaccatctagccaggcttcttgctattggagtgggaatttacagataaactagggaggaggctacactgatgcatgtggtaatgggttagagttaaaaatatcagtatgagctcatgtttagcttaacatagatacaaatagtcacatatagaaatctttacagatctgtgcatataaaagggttagtacccatatgtatttctgtgccctgacaactgagatggcctgaaagaaacggacaccccagtgtcaacaagcacaccttcatctagatcttggttcctattaccattctccaataaaaagaactaggactcctgagtgaaatggttgcttctggaactcaggcaggaatatacaagatgaacctggagtatgttatggtgccagaaagtaaggaagtcctaaaacaaaaaacaaaactcacactgataggggcacatcaaagaaacacagaggccaactgaaagagctaatggccactcctggataattagagcaaaacaataaggaagcatcggattataacccaaagtataaaataaatatccatgactccatactgatagaaataaataaatggaggagaaggaacaaacctcccacacagaagaattccaagtaatttacacagatacctcaccctcaagcaggggaagcataatgccccactccctcaatgtgagttccaggtagtggctccttcccaaagagtagtaggggagggggaggggagtccattgacagtggagagaccttcaacctggtgaccaaggacaatatcagtagtcacaaatcacattaatagaacagaccattgatacaatgtgaaaacaatggcatttcacctctgtagtcttcctcccaaaaacctctcaacccagtcttaatcatgagaaaagcatcagacaagtttcagtaggggggcattcctatagaatagctcaatattcctaaaaaatgtcaaggtcaccaaaaacaaggaaatttgaagaaactgccaaaagaaccctaggaaacatgacaactaaatgtaatgggccaccctagatgggatcctgggacagagcaaagatactaagtacaaattaaggaaatctaaataaactatggactgaagttagtagtgctatgttagtattggttcattacttctaacacacatgacatactaatgtaagatttagtaataggggacactggatatgaagtatatgggaatgctctttgctatcttctcaatttctctggaagtctaaaattgttcttaaaaagaaagcctatttaaagggaaaaccaccatcactaccaattttgataaacttgaagggttagcatcaattatctggaaaatttatttgtgagaaaaccttattcctttatgatcattgataagtgaagcattgctgaattatctctgcctctctgagcaagttaatactatatttttaagagaagaggagaagagaggggagggagtagggaaaagagtatgtgtatctttgtgtgtgtatgtgcgtgtgcatgtgcgtgtgtgtttaaacaagagaaaaagtgaattctaaattgttaaaaccttggagtggaacttaatctaatttatacgcagttccactagagatgtgcaaggatttttttgttgttgttaaagagaaaaactagtttcaagcattattaagcttttttccctcccagaagctaagaaaaccatctgtgagaacctgtttgcatgtttgttttctacaataaaatgcaaaatacttcttcctgttagcggattataccatatgtctctccctgtaacaaaatcagcatgtttattaatgaacccaatcagaggcaaagatttagaaagatttaaggaactgaattttccattcaatatttcagcaaaagaaacttctggttagacatcgttgttgtgcttggaaaatagaaggtttgtttttgctttgaactcaatttacttggcaggggacagagagcaggaagagaggcctttgaaaattttcgtaaaaaaggtctgcatttagaaatggcccttcctgcctaatgattcccctacggatttagacctacagtttatatgtgactaatatttaatttgatcagttacatttttccagacagactaattaaagtgcttgatggcccagatcccccaaatctgaagcagtaacaggcctgtgggcttcctggagtaacaggaagtgaatgaagtagtttcagccatattgtcaaagcaacccccatggtactcataatggaaacatgtgaattttccagcacaaacactttcctcacagccctgttgaccatctgaataatcaaatagattggtagcactaggtatagcatagtgtattagaaagaaatatgtccagccagacccagcactgcagttaaagtactggtgctgtcacgagccagcagaaggcctggagcaaatgacgtactctctctagaccccagcttactcctctgacaaatgaggatatcagctctgctgttctcttgtttctgacttgtagaagaatggacttgtcagcagagaccgtaagcagtggaaatcccaaaagccagacagaccctgtgcgtattttaggggatacattctgttctggtcattcagccttcacccaagccatctttttttctatttggtggcatagacacagcccagccaacctaattctcattttattgcattcattgttcatgtgccacagttttttagaaatcttacaagaaaatgaagcacctattaccaggacaccactgcaagggggaaaatgacacttgggcacctggaaggacaaagacaggcagtggaggcatcatggggttggattcgagtaaccctctgccttcttcctggggtctgttggcagtgtttttgtgctgtggtcatgatacacacaggtctcacaaggcaggcagccaagtgttgactctgtctttgtaggcaatacagaaaactgtctacttgttccagtgagctaaatcaagtgagaacaggaaagaggtttgtgcaactttggcaactatagcaggaaccactttaaatgggacagggcaagtaatgctaaatatttgcaaggtgatttttttttttttaagactttaaaggttgtattgggagaccttgagaaagaggcctttctttcttttttttttttttttttttttttgagacggagtcttgctctgtcgcccaggctggagtgcagtggtgcgatttcggctcactgcaacctccgcctcccgggttgaagcaattctcctgcctcaaccctcccaagtagctgggattacaggcacgcgccaccacacccaactcatttttttttgtatttttagtagagacggtgtttcaccacattggtcaggctggtctcaaactcctgacctcatgatccacccacctcggcctcccaaagtgctgagattacaggcatgagccactgcacctggccttttttttttttttttgagacggagtttcgctcttgtcgcccaggctggagtgcaatggcgcgatctccactcaatgcaacctccgcctcctgggttcaagtgattctcctgcctcagcctcccaagtagctgggattacaggcgtgtaccaccacgcctggctaatttttgtatttttagtacagatggggtttcaccatgttggccaggctggtctcgaactcctgacctcaggtgatctgcccacctcagcctcccaaagtgctgggattacaagcgtgagccactgtgcccggcctcttttttttcttttcttttctttcttttttttttttttttttttgaaacgaggtcatgcatgcaggctggtcacaaaccaaaaaggccttttgacaattcaactacctcaactctgggatgggcatttattaataacccccaacccacccaagtcctccaaataccctgccatccaggggaaaacacataaacatcaataaactgcatgtccccaagggatgctctttgccccaggatagtctggcctctcgggagatttctcttacctccagggctttgtttcaccagagaagccagcctggaggtagaaggggaagatacttagcagcaaaatctgctgccctgtgcagccaggccaggggggcagtcaggggctatacaggctgaaaagctgtccaggacccagagctatgtgactcataaaggcaggctgcccacccactgaaggtctccaagtggcagtccagatggacagtgatcagctgtcacattggacggttggcctcctgtgatgacaacactgtgccaaggaggcctgggttgaagctttgagcacatgttaattggcttagctctattccaccactgtagaattttttagttcaattcagcaaatattccctgggttcctgttctttgccaggtaatagagctggacactgtgaatgcagagatggataaaatatgtcctttagctgatggagagaaaaacatgagcaaataaatgtcatttactatgaaagatactagagtatctggaaagaacagtggagacagagaagggatggatggctgaaagtgtgtggttaaaacagtgcccacccatcttgcccagacacaaaccactcaaaaccaagaccctgttggaggaagcattcctgtgagtttattagagcaggatttcctgaattcttcctaggaatgttaaaagataaaatttgaaaaaaggattccaagagcaaataagtttgggaaatagtgagttaaagttagacaggttgctttcattggtagctcatgcttaagtgcagaacttctcaaagccttgagtatgctgagcacattgtgtgattaccccaggggaggagatggtattgagaattttgacttgggagcctttttccagagttacctccttggacctgggaccctcatattcttggaccctggcacagtgtcctgtctggagctgagagtttgcagagtggccttctagtcccagcactcccactgtgactgaaactgtttggctttgggaagtctaaccttctctgatgttgtttcctcattgtgttaggcaatttttgcatctctataaagaaatacttgaggctgggtaatttataaagaaaagaggtttcattggctcctggttctgcaagccataaaagcatggcactggtatctgcttggcttctggggaggcctcaggaagcttttttttttttttgagacagagtctcgtcgctctgtcgcccagctggagtgcagtagtgcgatctcggctcactgcaacctctgcctcccgggttcatgccattctcctgcctcagcctcctgagtagctgggactacaggtgcccaccaccatgcccggctaatttttttgtattttttaatagagacagggtttcaccttgttagccaggatggtcttgatctcctgaccttgtaatccgcctgccttggcctcccaaagtgctgggattacaggcatgagccaccacgcctggccaagaagcttctaatcatggcagaaggcaaagcgggggtaggcacatcagatggtgatagcaggagcaagggagagagagaggggcgatgccacacaccttcaaacaaccagagctcatgtgacctcactcactgttatgaggacagcaccaaaccatgagaggtctgccctcatgacacagatacctcccatcaggtcccacctccagcattggcaattacatttttaacctgagatttaggcagggacaaatacccaaactatatcactcatctagaaaagaagggaagagtgacatctgcctatcttgcagtattgttgtgaaataatagatgtgaaagcacttcatactcataaggactgggattgtcattgctgggttgtgacaatcgcagctgtgatcaagtcttcgaggctttagttacttgactgccttgaggttgtggcctcttgttatgcctggaattctcccttccttcacttctttacccaccccttgagatacttcttataaccatcccctaagttcaatgttggtagccctgagacttctgtccttggatcccttctcttgagaccatttatctcagagctccatgtgtcaacattacctgtcttctgataaccacccagttttctgtctctagcctttgcttctcccttaagttctggatccaaatgtccaacttctccccagataccttgatgtaattatctcaagctgcatactagtgcctcaaactgcttgcccttccccacacactgtgttccttcataactgggtgtcatcttaaaagtacttctggtaaactcctgctcatccttcagaacccaactttagtctagtctcctcttggctgacttcctcctgtgcgctcccagagaactttgtacctacacctaacatgccacttctcacactgccactgtggccattggtgtagttttcattaagtcaaggactgtgctttatttgcctttaaattctcatccttgagcagagtgcagggcgggcagtaagtctaattggatgcatatacctcattctagtcatgcccatgcagcagaggggagtttcatctttaatgccacatctggctttacactagaggcctgaacctgccggatgcacaattttgttcttttccctgctggctaggatttgcaggcacccagaagctgaagaccctcggggtctccagaggaggtcacatgtgcctctggccacagccacccctggactttcagctggccagtgctcccagctcccagcccttggctggcagaggtgagcaggagtcccacccactcctccccagcttagccgagtcatgttgatattctggcggcatagtcaggcttgttattgagcacatgctttgcagattagcctgtttgtatagccaatcgaacatgtgctccattaaaaattaaagcatcctgttttaaggatggagcaggagacatcagctgccactgtgtagcagacatgcaaagccccagagcccattaccataggttacagcaaatgttaatcagtgccagtgcagttaaataatgcagtttgtgcagatggcagctactacatctcctcacagatgtgtcctcaagtcccggaggctgctgtatcacaggagttgtcgggagcagtcagatctgatgctgactgtcaatatcaccttttgtgtttgtgtgcatcctccagccagctgagaggcaacgataggatgactccaggccctacttccagcagcccttccagagctggagcagggggtctgtgcagggctcacaggagagcagaaatatttcactaaatcgccaagaacactcagagtaaagctctgcagtctgctccatgaaactgtacccagctgcatcctgcaagaggcttcccagccaggtggagtggggatggcgttcccaccttcactcttcactgctttctgcttgctgatgggcaagaattccacaagtattcttcctggcttccataagcacagggacacctcactgtatcagaagttggagttctgacagcacctactgtgcacagggcctgattctgaatggcaaagtgctgttcccgaagcccaggcacttggctctctggtccaggtgtccctaccctccagcccctgaacagatactctgcgtaaaatttaggaacaaatcgccactcatgctgccagcagtaagcagcaactgttgtggcaagaaaagaccaaactgtttcaactgtcccagctcttctctctctctgtgtacttccttactagcagctgtgggggacccttccatgaaggggcacctagagcactgacatccacatgtgggcacctgggggcattccatctcagccactgtcaggagcaggcacagtgactggtccccatgaaggtggcctgttatcaagagaagatgaaataaagctcgaggtaaccaagtgtgggaaacttgtatggaagcaggggagattgctcttgatatagttaagtgttttacttaaaggtgtaagcctcagctttctgaaaaatatgctactgtagaacaactcatttctgaatagcatcaaatatgtgaggtgaaaatgtacttatgagaaaaatagttaaaagtttattcatcctatttcctttctaggttgtcagactatgtgctattcttcattcctagatgggaaacattgcatcttatgaatgtaacgtgttgctgtagacaaatattcttgtggagtgaagcccagggacaagggtcttttgctttccttgcaaaatgtagagacattattcctgtttcacctttgaaggccatgccatctgataggccatgccatctgatatggtttggctctcaccttgaatcgcaccttgaattgtaataatccccatacgttgtgggagggacctggtgggaggtaattgaatcacaggggtgggtctttcctgtgctgttctcgtgatagtgaataagtctcacgagatctgatggttttatagaagggagtctccctgcacatgctccctctttgcctgccgccatgtaagatgtgcctttgctcttccctcatcttctaccatgattgtgaggcctccccagccatgtggaactgtgagtccgttaaatctctttttctttataaattacccaatcttgagtgtatctttattagcagcgtgagaacagactaacacaccatctgatctgatggcttctacccttcctttctttctttttttttttttctgaggcggagtcttgctctgtcacccaggctggagtgcagtggtgtgacctcagctcactgcaacttctgcctcccgggttcaagcaattctcctgtctcagcctcccaagtagctgggactacaggcacacaccaccacacccagctaatttttgtatttttagtagatatggggtttcaccatatggtcagcctggtgtcaaactcctgacctcaagtgatccacctgccttggcctttcaaagtgctgggattacaggtgtgagccaccactcccagccagcttctactctttctttacttcccagtctcaacatcatttgtggaagattttagcaccgactcactcctttccttccattaaactcagcaatgacatgagcagctcatctgagccccaggcctctggattcctaacctccttacctccagtggtctttcctttatccacctctgccccccattcccattgttatgccctacgtcttgtcactacctataatgatgtcagtttcaaaattgtgatttccaaaccattagctgcaaagagttcaaggaactgagaggccaggatgctcaaaacccaccactggcttcacaccacacttagaacaaaggtctttcccctgctgtgagcctgcctactgctctgacttcgtctcccactactctgctccagtcacgctggcctttggtctggccttccaacaagctgagctaatttgcaccacagagattggttccattgcctgaatgctctatcccgttatatagatggtcgcttggcttgttctctcacttcattcaaatgtcatctccttggagagacttccctgactaccctattaaaacaacaacagtacatcccccaccccaaatcactctatctacttatccagctttgctcttcttcacagcactgagccaacatttagacagacacacccacacatccatatacatctatattcacttacttactgcctgtctgctccattgaagtgttggtgccacaaggacaggggttttgtctgtcatattcgctgctatatctgatgtgcctccaatggtcttccattggaaaatcaattgaatgaatgaaggaatatgtttgggctggaagcaaatgttggaaatggagttttaaaacaacagggttattttttaagctttctaataaactttctatcaaaagcatttttcaattattaacacttcataaatgaacaaatttcatcttctcaaagttacacttaggtgccaactagagaaagcagaagaattcattttcttaatattttgtgaaatccaggatagattattatttcaagctataaggcttccagcattagccttgaaacctcatctttattttgcttcactgctaggtgtctccttttttgtttttcctagaacttttgtttgacttctaattttgtcctctgattgaggactgaaacaacgtgtaataatctcacaccaggcaaatatagttgaaatttttagtggatttgattacattcttgaaagtggcaaaatcaagtaaaagcagatagatcagaagattgaaagctttggcttacaatcattctttttactttttaggatgtaaatcatcgtattggtcctttttactttagacaaatatgaccccataaagttttaaaagtttgtgtctgtgaaaaaaagcaagatgaattgtctctcacttccctggtttggaagagaagttccaaagcagggctgaactgtcatcatcatctaataattttcctttagttttcatttttcctttctaaatcttagcatgtgagatcacaggctccctctccaaactcatcagttgtctcttgttttaccagtaagaactgaacccctcatctcaaccagtctgtcaccaaggcacttgctccaaagactctgtaccagtcgagatgcttttagctgcaagtaatagaatgcctcatccaaagtagccatagggtagccatagggccaagcacagggactcacacttgtaatcccagcactttgggaggctgtggtgggattgcttgaggccaagagcttgaggccagtctgggcagcatagcaagatcctgtctctacaaaaattttttttaattagcctggcatagtggcacgcacctgtagtcccagctactcaggaagctgaggtggaaggattgcttgagcccaggagtttgaggctgcagtgaactataatccactgcattccagcctgagcaacagtgatgagatagtcagaggtaaccagatgtgtattaggctgactcctaggaagctttacgttaggttgataagatggctacaagcatggtatctccacaccatatacccaaggagggaaggaaaagggcagacctactccttaattgtgtctttctttttagcaggaaggaaaatcctttccgggggtcctgcagcagattgccccttacagataatagccagaactaggtcacgtgttgataaggtttagatacttgttcccttcaaatcttttgttgacattgcatctccagtgttcgaggtgggcgctgggaggtgtttgggtcacggggtggatccctcatgaacggcttggtgtcctccctgtggtaatgaatgagttctcactctactagttcacacaaaagctgcttgtttaaaaaagcctggcacttcttcccctctcaccacgtgccctgttgactacccttgccttctgcctcgagtaaaactccctgaagccctcaccagaagcagatgctggcaccataattcttgtacaagctgcagagccatgagccaaataaacctcttctctataaattatccaccctcaggtattcctttatagcagcacaaaatggacaaatacacatgggtgccacaaaccagtcactagcaaatatagattagaccacttggttatctcctggcctggacacatgtcactttcctacctgaacaaagttgatgttttctaataacagagaatgaaggatgacaagctgccagggtcgacaactaacaatgtctgctacagcagtacaacccgttactcctactgaaaaaactcactccaggtggaatagtagcttatgtcagggtctgtattgataggccagtagattataaagtatttggaagtgatcttagaatctctgctcatttatgtcaccactgtttcatttacatacctctaggatagcacttaccacgtggcatcatgattccatgtccacaggtctgactgttcctaccagattgtcaccaggaaccccttatttctttgtgtccagagtacccaggataatacttggaacttaatagaggtagaggctcagtcggtgtttgctgaacaaatgaatgaataaactaacaacaaataatgaataacatattcctgaagccatgcgttatgaagaacagttggaataactataggtgtttacctggggaatgaatgaatgaatggacaaatgaataagcaaatgacaactaagagatttttggagcggtgtccaatgaactgttgaaatgacgagaaatgttgacatggagaagagatttgaggaatacagtgactttttgcaacgcaggatttaaaagccttttaagtgaaagagagatgagacttactttgtgggatctttaagggtagagctaggaaaagtgggctgaaactacaaggagacagaattgtaaaactaaaatctaaaagtggagctatgtaaagatggaatagactgcctctggaaagaatgagctcactgtcaccaagcagagagtggctaggcatactctcaggcagtggtaggattttatcattgaagattggacttagataagaatgatacttattccctggtataactgggggtcctccctcgtagtgagggtattctctgaaagtatgaaaaattaaacttttaccacttaatgttaacatgaaggaggtatgtggtagccctttccaaagtaccaagagactttatgatgctatgagacatcttggagtaatcccatctgtctttattattcccaattacatgtgccatttccctgttgagctcatttctgatagaagaaatgttttttaaaagaaaacgatgttaatagatgtcactggttttgtctgtcttaacggattctgtttctcacttcaggacattatccagtttatactttattaaaattggcctcatgcacccttgaggtgagtgggtagagaatgaggagaagagcctcacttcccggagatggcggagagggattgggcccaccaggtattctttcaaatgggctgccttactgcccacctgcaggactgaaaatcagagaaaagcggtggaaattgagaaactgtaggacatcattcactctcgtaattacagtgaggaagtgtgctgcatatgtatgttccctcagtaaaacaggtgttctgcccttaaaatgctaattatagactattgcagatcaatgatcttcacttatttcatattgctgctccattttttccacatttaactaccctgtgatatagaaagcttgctcacccttgaaaaaatcaaaatgcatatggattttctgaaataagccccttttctggaagtattttgtggttagtttcaaaatgcaatatcctgagaaaggtttaagtcggctttttattttaatatataataaaaaagtaaaatcactaggcaatgagcaattttacttccattagcctaatgtctttgtggtttcatctgaggtcactagtagattatttttcttgcattatttcatcagctgtcagttctattacaatcatgtaattcattcagtgctgtgatttttcaaagacataactgtaagcttagaagacagttttttggaagtttatttagatgattgtagggtgtcagactgcctcaatcttctccatgctcagtgtctgaagggtcaccaacagattgtacatgaccttagatgctcgagtaattatcaccactatgtttttatacccagcacataaaaatatatctgcactttctttatcatcatcttttgaaagactgtggcctgcctatgggctgggcaattaggtttactacttagattacaggatacatgatacagctcttatttaacaccaacaataactctttttaaggtggtttcatttcaagcttagtctattaatatattcaccattgggctttgattacaataatgcagtttatttatgtttgcatatagtgggtatcagtcaagaaatcatttgaaaatcattcactgaacaccagctactcacagcttgttagtttctggtggttataaaggaattagaaattctctgctcttgaacatattattgtgatccatcaaagcctctagcaaagtagtcatttagtttggtttttgtgaggtttttttagtacgaggataatttttaaatattaaaaaaattaggccaggcacggtagctcacgcctgtaatcccagcactttgggaggccgaggcggatggatcacaaggtcaggagttcaagaccagcctggtcaatatggtgaaaccctgtctctactaaaaatacaaaaattagccgggggtggtggtgctcgcctgtagtcccagctactcaggaggctgaggcagaagaatcgcttgaacccgggagggagaggttgcagtgagccgaggtcgtgccagtgtactccagcctgggcgatagagtgagactctgtctcaaaaaataaataaataaataaaaattagaactctacatagtaatagtttacctttattatcttgtaattttaaaagtacaaaatgcacatttaagatacatgtgcataaaatgatatgtctgggatttgttttaaaattatctggaaaggtgggagtagtgggaatgggtagatgaaataagactggccatgagttgataattgttgaagctgagtgctggtaggtagcagtttattatacagttctctctacttttatggaaattgttcatttaaaaaaaggaatagaaggttactatgcacagggagcagtggctcaggcctgtaatttcatactttgggaggccaaggtgagaggattgcttgagcctaggaattcaagaccagcctgggcaacatagggaaaccctgtctctacaaaaaaatacaaaaattagcccagtgtggcagtgcatgcctgtactcccagctgctcaggaagctaaggcagcaggattgcctgagcacaggaggttgaggctgcagtgagccagggttgtaccactgtactccatcctgggtgatagagcgagacactgtcaatccatcaaacaatcaataactatgaattcagctttgcttttaaaaagaaaatatattttaatgatcattgaagcatttccatatacttgaaaaatattaataattgtatgagaatagcatataatttcctgagactatagacagagctttgtgctcatggactctgaaccctttgttgtaactattagaatacaatagacaagcaagttcaaggtagcttgatacatactgtacacaaacactgagcacattccaagggatgtgaaccttaactacagaagcgtgtatggagctgctttaatttactgtgactgtgttgcatagaaaaggaagacgaccgtgctgccacttaagtactgataacatttaacactgtgtgcataagattgaggcagcttggaaggtccagaatatgaagcaaagaatccgatccattcagaaaccaagaaacctccaaataatagcactttcactctaattcagcctctgccaaatttgcctttggccaattgtcaccagtgccaaattaccaacagacttccttttctggtcttagtcatgttgacctcttccttctgtctcctagtcaagcagaatttaaaacatttacattgtatttcaatttctatgaagatgggagaggaaaggtgtatttcttgtcttttgtccctggccagcttctactgggaacttatttccttgaaattcctgtcctgtaaaagcatgcagatgaaagtatctttaatgtataattacatttttatatgtgtataatcttagattacatgggaattgagtatctggaatggatcggccttaggaaaatgtttctttttaaaaactattaaatattggaacattatacaaaaaaatagcattgaaatatttaatctgtggttcaggtctgttgttcatttaaaggtttaactgtttcccactgtttaaatatctctatctgatctttcatgctaagttagcatgtccaaaatattgaaaaacagatgaatgatcaaggaacttaaggaatactcctccagtgaagccagaaggatattcttgaggagaaaaaaagaatgcatgaaacttatttaacaagaaagatttgagtcaggtaatctacataatatatccactggcattaaggctgtcatcttggtattgcatttctggtacgaatttcgcaatagctgtctttcactgtcggttctaataaagagtgttggtcagcttaaattccctgggagctcagagttatgttttgtgaactgcatgtgcctgaggcctctcatgcatgatttaaactgctttgtaaatgtcaataggtggaaaagcattggatcccttgtagatttctccaaatcctcaaagatgtgtatgccatgtataaaccatgctgcactctcaaggccattgccgttttttatacttgcctaactgggggtttaaggtattgctagaagcaaaatatcagtgtgttcatgtctcgatccaactggccaatgaaaccctttattaggaaaacctttgcaccagagaaatgtctccagtgacctgaaatgggcacacctcatgaatgttgaatgttcttcaaactctatttcttcattcttgacttttttcaaaacatacatttgacttgattgaatttactgatttcagagtactgcatccattccatggacagcagtatggggtcatcaaaaaaaatttccattgagagtgcccagacctgggtcctatcctggttctgccactctctggctctttgtccttgggcaagccacttaaccttttgggggccctgcttttctgatccattaaataaaggaggttgaattaaatgatctctagttatccctcacagctccagcatcagtgattccaagagatagtgacagaaaaccagtgtgtcacttttaaagccagggaacacatgtgactttttaattgggctcattccactctctgggcagtacacagtgccggcagaagccccaaaatggccagcagcaatggcgtagggaggcctgagtgttagcttgagggttcatcaactcattttcgttcaaagcacttcctggtgattgttttccatggacctgggaactgcactaagggcgctcctcccacagtgtgccctgaccccccaggtgtgttctttaggtaaagctgttttttaatgtctgaagaggccaaagcaaatgccagtgagggtatagctctctaggatctccagaatagaggcaccatatgagcaacaacactagactgggtttctcagagtctgtttctcacacactttagtacctctcagcttaacatggtacctggagatagaggtgcttaggaaatgtatgcttagcaaatgttgcagaaagagtttattcggagtcatagagccatcggagcagatggtcttttttgttttcttcttcatgttttgactcctacatagttcagaataagtcactttggtcttttctttgcacatgttcactttctaatatagtgtcttcttggggagactgttttatggggaatatgtgagttcatgtgttagctgtggagccagcctgcctgaatttgaatcctgacttttcctctaactgtgtgaccttgagcagtttccttaaccattctgtatctcaggttttaatctgtaaaataaggataacgggagtacctagctcttcagattgtgaggattgaatgggatatacacataaagctctcaatgcctggtgtgttaaagtgttcgcagttgttacttttttaaatgtttttactacttttgaaatttagtgttcaaggtgaactttttacagaagagccagggcaattggatgcactttgggggaaaaaaaaatcacttgcctcatccccatcttctccatcgcagtgaggactgttctcaagtgggcacacaggacacctgtctccttcatctgcaaggccccagtggctgtgctggggtttgaggtctctcgttcagaccaggtatgtgagggcttggttatcatgcactgctcctgaatccaccatctccatgtccacatccttggcagggagaccagagccaactgggaactctgccacctggagagacctttgaaacactgtcgccaccagtgttccatttgtgtgtttgcagaatgccaagtaagcacattctttttcaccctctgacatgacctcagggttactttctgtggctgttgacaaatttttagacatcccagttttatcagcggaaaccttgaagagtgacaaatggttcttggaagagttggtacatactataaaaatgtcagctggctcatttataacccagtgatgtccagtgtctgagccgtgctatcagcatggtctatagataactcaccctcacgatgctccgctctccccaagtactttgtgcagctgttctggttgaagacccagttgacatctataatagatatcaaatggagagcctcttattttatcactctctgtgtttcagcactggcggtccccatggactgtcagaaacaggcagccagcacgttatgggaaaggtgacttgctgagtccctgtgccctgaggacattattaagtgctagggaaccttgttagctcataaagttggttcaaaccaattattgttctgcgaccattaccattgccaagaatgtaactcttttaaattcttgcccataaagccgatctttccattacattatatcatagagcaagacttctgatctggccgcacttgtatcccaccggctgcaaagactaaacattgcatttgctgctcaatattggttacccttcagtgcttcatggaggcagcaagactgctatttatagatttactttctgtctccctagttcagcacagtcagttttgacacactgtcccagtaatctgatcagccatgctgcttttaaatgaaggtctaggccttggcctctgcagagagggtgacagctgtcagatacagatagtaggctacagatcctggctgctaaaaccctctcattcattcctgttacagatcattgaccacagcttgaagccatgctttacagttggccgattagttggcaagagatctacatactgtattagcaaggtcaaccactgagataaaggcaaaaacgtaaacccctgcactatttttaaaccagtagccatttgttaaagctggttattttggtacttgtctccgttcccctcttttttttttctcccaaaacaaaactcaagaaacttgttaaaactcttcggcagctaacgaagatgcctcagataatgagatggttcaaacctgagaaggaaagatgaggtctttctcagaaactcatttaggaacctcggataggaagccgtgttagctgtgcttataccttgttttaatcagaacgtgtctggaaatcttagtccagggagacctggatgaaagtgcagccagtttgagtgctctggccatgacagtaggttaggcaggtctggcctagaaagaggtaagttatgattcatacaagtttaaatcctcgctcactcctgaatgaggtggttgggcttggttgtcagctcagatgattggacccattttgtaggtgtttccttctccagagtccttccttcccccagcatcttgtctgtaggtattctaaagccaggcattattcaacacactatattggacttgtgtaaagagaacttgcaccctgggaaaccttgtgttaaagtgattaattgacttcttcatattcagtgaagatccttgctgtttcagaatcgacacaaacgaccaaaccttcaatctcatctttactcagaaaggggtccacctataagattttgaactctccttcaccatctgaccagcctcctctctgctttcacctctcctatgccttcactcccactgaacgttcctttaacttcatgacagccaccttcccctttacccttctctgtgtcctgctaagactatgtggacccagctggggttcccattctttttccaggttatactctctatggtctctattttgtgtcctcctccctctcttctgtgaccttactgcatcttcctgttgcattcccatctcccatctgatctcttgtctttcactctctacctcttgttgacttatgaccaagcacagtttccttagtgtacaggggcacccaaggcccttgacaatatgtctgtccaccatcttgtagtcttgcctcctgctttgtttcttctccacctctctaaggccccatgcacacatttgctgaacacaccctgccctgtcaagcttctttggctgcctttgctattcctccaccacgtaggtcctttagaatggcaagccttacaatgtatagtatatttagtatacatacccagtaaatatttgtaggacgagtgcatgaataaaagcacaatgtttgacattgttatcagcattgacccaaaccctttgagctagatgagcaataaagattagaagaaagaggttaggtataaccacaaacaaacttgagattgaaggctcgctagaagtagaactttgggtggatttctctctgtgacttgattttcttgcctataaagtgaggtaagtgatatctgctttataggttgttgggaggatcaaagaagaaaaaagggaagtaaagtgcctaacacagtgtctggcaaatggaaggaacttgatagatgttaattacctagctgtgccatataactcccaccccatcttcagtgttctgtgaaatgtattttcattttacccttggaaaggtacaggacaggatggaagaccagtttgatgggagagaaggctgggagttacataaacccccatggttttctgacttttcactagagtcaataaggagatgtttaaacagactttggcccacaaaaggtgactcactctcacattctcagcttcctgctcagggaatcagtgtggaaactgggcttccacttctcagcttcaaactggagctgggaaactttcgcctctgtggaggagccttggggaaatctcagcccagctgccatgaggtgtgcaaggggaggacgtgtcagccctggaaactccacaggcctctgttccagatgcacagggcagtcacgtctttgcaggggtgaagcaggaggacaccctccctcctgttctgttctagcagccatcatgaggtgggacttggagggaatctgatcctgttaggggaacgatccagtccggtgcagagcagctttggggtattaatgactgtgtgttccacagggggaacttgtccatttcatttatttgcaataaaatatatgagaggaacatctgcaggcagcttatatatttgtcaaatttagaagtaattcaggcatatgatggggagccatggcgattttatgaattttctattgttatgcattcgagttcccatggcatcgtttggcctagctatggcagcccagagaacagaggcggtgctagcagacccacgtgacacatgccgcgggcttgggcggatgcctggcatgtgaagtgatccagggtgctggcagatgcagacgaggtgggagggaggtggaggaggggcatactcatgttttaggaggggaaatacagggtcacctttgtggacggcaaatagccaggtcctgaaacttgcttctaatgaattccttacatgctgttgaaatggcaggaatcataatagcttatttcatgtgcctttgaagggttccagcaaatggagtctaagagaaggcagggatggggggtgggggtggggaggcaggaaaagggggggcgagagtgaaatattactacttaaaacatattcttagacataataaagcattaaagttaaaatattgttgagacagctttcattatgcatgttccaggcctcattatggaataagcagaagtgactgtgcagccgagacctaacaatatctgcactgaattcctattatgtaagaaaggctttctagtccctgccagtgtcgggatgtggtggttggttttcaataaaggtcagaatcggtgccacactgaatagagctaaaagtgtgtttcattcttttgtaggccacgggcactgttggggattgatctgaaaatctggtctgttgcgggcctttgctctcaagggagattaatattttagctattcctttttgttcagtgcttctaaatgtatttggaatgaaaagaaaggttaaagaggggctctgggacggctagcttcagagactagatcatttcatgaagggaaatcaattaaaaaaggttgactgtgaacatttatccatttagcttagccgctattgaattttcatgatggacttcgactcttcggagagaacggagttaatggcaattgttcctttctcctcaaaatttattatctggtttattcatggaaaacactccatcaaactagatagaggccttaggcctattgatagatttgcctgtgtggggttggaatggggaggtttgtcacagatgtccagcctttgaaggaaaattaaacaagtatctcattacagaatgcttcactggtccccggaggtggccacagacgcagtggatttaatgagctgggaacgtcaatgctgccaaagtttacctcgacctgtctttctgaagaactcctctatttaggcccactcaagcaaaggagaaaggcaccacgctgttttctccctttcaactccaaagaaggggataatgcactttttgtgccatgcatccagaggaattatgtgtgctaatttgattaggggagatttgattaactggaaaatgagggctttgctaagactttcacacgcttaatttatcccttgcaaagcagacgcaacattgtgtcatgaaactcagaaggcatatgggaacagtattcagtggttagacggcctttcagacccaacaatatcaaggattgccacggttcatattgggataatcattttagagcattcgctttgctgcagaatacaaattgggtttggcattgccagttaaacggttcaaaggataatgagattaatatagtaggaaacttagctgagcaaaaagcttttttttttttttaacaccattgcataactagttttaaggggaacttagttgaaaaatgcttggttttctccaaagaatgcattaattatgttttgtggttccatacactcctggtctttcttgctaaataaacatatcgtgcatcatccagatcttgctgaaatttgggggatatgcattgaagcagcccctgtttctccatgaaggtgtatgtctgtgagcctggctgtgcagttgggaggcctgggggagaggtcatgcttctaccatggcgttttccattttccttaaaatgtgcctcagcaacaggctgccaagatctaatcctgttcccctacccccatagcagttggggaattaccaacaaagtctttaccatctgacattccccaagggctgtgtaagggggcatcttacccctgctttcttgggagtatatatttttaaaaagttgaaaggagaccagcaatgccaatctctactaacatctgaaaaaaggtcttttttaaaaaaagcatttcacattcagaagacacctggaaggtccctgcagagagagctctgggctccatgtgccaacgatctttgaatagaatcccttggagtttctacccgtatgtcttttttctaaagatccccttgcccttgatgattgcaaacttccacatagcttcagaagccatcttcattgtgccaagtttatttacaagcagatttggccctctctgtactttggcctacatagtacaagcaacgtttgaactcctgttttgctcttagcaccagaagtttgggcttttccattaaaatcagtcaatcaggaaagagtgcatgcatgctgggttttaactttaacacaggctgggtttcaactttcatggtgaattaggactgtctcctgccattctcccttggcttgctgcactgtagaaaactgtgaaaggagccactaactagggcagaccactggcccaatttgaacaggactgctttgttttagctggacctagaggtttaaatcacaagacggctactggattcccttctccccgaccccctcatggccaccaccactagccctctgtaggaggagaacttcactgagcacctgattacctgttctcgctttaggattagatcaagataggacagagaggttgttcatttgtaggcttgttgccttactgtaggagtagttggattgagtcaagccatccttttccttgggaaacaggcccctgccgctttaagtggagttgctgggtaatcgttccgctcggttgcataaccagaaagggatgtgtcaggactgggacctgcagacagcgaaggctttattaaaacgctcgcagagacctagacagatgagtggtctccagttggagttctttccatcttccccatctgttcactgcagttttaattaaatctactgagattatttttggccttctccaggaacagaaagccagcctgtgccaatgtccactcgtttctgtgctttactgccagccactaatgagcaggcacatggggcacccctgcctgtgtgcacccccttcctttgccagccatcatgagttgctaatagggtaggaactaaaagtgccaagcccaggcctctccaccttctcccacctccacccccaccctcagccccaccttggtgctaaagaaagccagctaacgaatgattccacttgtggttagctagctaatgggaatgacaggcttcaaataaccttaaagcatgcagccccaatgcttgtctgtctgatcagggcccttctgctggcacctgacactttcaataccataatggcattcacatgcattctttttgaatgctgtcatatagcaagacctttcttctcttcgtttgctgggaggatgcctggcaaagctattaagtctgtgatgggaatgacagttaactgcgggcctgtcagtcccactttggaagtcagcacatccttatacccattaggagcatatcataggaacttcagaaataacctgctgcaagataccatcaggttgttgcgctgcctgcaaacataccacccaacgagctttgcacatcattctgccctgcctctcattaagggtctggtttgttgatatttggtagatatttgatttctgaatttcagattgggacatagtaattacttctggaaggtagcatggctgtccccaggtagttggcaggtggtggttcttcctatttatggtcagtgcttcatggatttgaggacttctgttagttgggtttccaagagaagttgtgtcttggaatccatttccctaattgaccccctaggtttccaaagcagactctaggcagatgtacattttttattgcacttgagtcccaaattctggcctaatcaccaacaccagtgcactgggcaggactgtgagtgagcctcagtttcccctcttgccccaagttcaaggcctacaagagacccatctgagtggcccaccctcctctgcgctccctaagaaggaaaggggtcaaagagagggatccgagtggtccagagcaactgctgcccctgctgagctgtgtttataacttctcattcctcccactgatagtctcacccctccacagtgatcccttgctctgttcttgaagactccattttcattgacccatatcagcacttgcattttggggttgatgttgtggaacctaaacaattagaaggttggacttagagcttttagagtcttgatttgtccatacatacagcttgactttctgctaagacacacgcttccactcctaaccagcaaccgagaatcaacatcttctgtgtaatttccaggaaatgcctttcaaactcactgccattaggtagctctccaaacttcacttagaggaacaatgttttagaaggattccaaaaataggaataagtgcagtcctttttctctagattggcattttctgaaatgtttcctggaatagtcttttcgtaatatattaatagacgccactaggataaaggattttgtttgaaaagtgttggattagatcaaattaagcaaagcagtggagagggcaatattatgctgtgtttaccaaacagctttgaccacagaacacctaggaacatttcatagatcccttggaacacagtttgggaaatgctactccagaggatctggagtaagacaaaccagcagagaaccagagttagcctttctggtattccagtttagaacagcaccatatgctctgcagatagaggctctaataaccctatgacaccaatgccaggacttttgaatgaatgagtagaaaaaaatattatttagtgtgctatgtgttgttttgcttatgtagatccttgggagaaataacactctgattgcagagttacgaataattgagccttttttgaagagttggttttccttttatcttgcaacccccatgaactgtgcaactgcttagcttcccatcatcaccgtggctgctggaagcctagagccagcttcctggcccatctgttataaataagtggttaagtgatgggcagacttcatttccatctccactgtgcatacccacatggtttatttttccttcttttctaccaataattttaaaaatcctcccccctccctgttatcttttaaaggtaccctaaatccttttggtcctttaaggtactttaaatcctttatccttttggtcctttaaggtaacttaaatccttcggtgtagggaatatgtaagtgatacataacattacctgttaccagtcttagctacttaattgataaattgacattggcttgtctgagattattgtcattttgggttgatcaacaaggttgatgagcagttgatgtatagccacagctacggcaacagtttcttagtttcagaacataccatgtgttttgtctggagactctctaatcactgaaacatgaaaacaatttactaagctatgtttttttccccaactgtggcaacatcataaagcatttttgttcatatgtgttttattgggtttttttttaatttttttctttattttttttttattttttgagatggagtcttgctctgtcgcccaggctggagtgcagtggcgtgatctcagctcactgcaagctccgcctcccaggttcacgccattctcctgcctcagcctcctgagtagctgggactacaggcgcccgccaccacgcccggctaattttttgtatttttagtagagacggggtttcaccatgctagctaggatggtctcagtctcctgaacttgtgatctgcccgcctcggcctctcaaagtgctgggattacaggcgtgagccaccgcacctggccttttgtccatatgtgttttgtcctcagtagattcctagtagaatatgaaaataatttgcagaagatatcctagaaagttagagctaaaagggaccttaaagatcatctagtctagagatggcaaataagtttcgattgtcctgctatctatggtttgttagttggctgcctggaggcttgtattgaagattctgggccatgaaggcatcaaaggctaaatcgattagtgatgtctgccatgagcatggcatgaaggcaaggaagtgtgcatgctgcacattttctgtccctagtttctcccttttgaccaatgaaatcacctgagacagaggtggcactagaaatcacgtctttattctaagtccaggactctttgtaaccccatcttgctgaagtaattatttttcttccaactataaacgttagtaaactagagcaccaaaacaatatgcttcttctagatttgccattgagttcactgtaaagtgaaatacaaaaccaagaatcagtccccctcttcattatttttcccaacttctgatatagttgaggaacgaggcctattctatactgggacctacccaaatttttcttgtttatacttagccatattatcatgatttggttttttttaattaagactgttttggtaagacatattctccagcaaattcattttccctgggtccttctttggttaagcatgttgctagctatagccaaaccaacaggtctaagatgcctaagttatattatcttttcttttcttctttcctttctttctttttttttctttctttttttttttttgagaaacagagtctccctcctttgcccaggttggagtggtgcagtggtgcgatcatggctcactgcagcctcaacctccccagggttcaggtgatcctcccacctcagcctctcgaatagttgggattacaggcacatgccaccacacctggctaatttttgtttttttagtagaaacagggtttcaccatgttggccaggctggtctcaaactcctgagctaaagcaatccacccatctcggcctccacaagtgttgaggttgcaggcatgagccatcatgcccagccttatattctcttttctaaaaaaaaaaaaaaaaaagatgaagggaggaacattttagaaaaatcaagttaggcagctttgctatctcagtatgcaatgctgagaagtgtcactttaacagacttaatcctttcaaataataattcaaatgaaattgagatgaacagtttggctcttaaggactttttttcttgagacaatgggattcttttttctaagcaattaatttgctaataaaaaaaatggtgctgccctgttccttatttgctttatttcatgagaaatcaggttggcaatcttgttcacatatttacccatggaacattccattccatctccttcaatgctgaagacatgggtttcaagcctaccctgcccagggataagacagagcaggtgcaattaataaaccatcttttcaagctttccttccagtggtttgtagactgctttctcctgacatgagtcaagctatttaatgtgatggaattcatcttgtaaggctctctccattcaggctaagtgattgaattcacaattcctctgatttagtgcctcgtttgtcactttcttgaggagaggtttttggacccatttagttgggagattggctggagcaggaagtcggggagaatctgcccctaagccaccatttccttccacttcaaacatgattcataatcagtctggaagaagcaggaagatagaggatgaccaactgctctgagaagcaggctgctgtgaagttgattacgtttgcaggacagcctctaagatgtcttcgaggccaggacacagaccctctagaagccagccattttagccacttggggctccacaacacagtgccttcgaacgtaaccagcactgactcggtggtgtgcactgggcctcaaagcacattcccgtctcttatcattcagtagcccagtgccaattagagtggacgtactagacggtttcactcttgcaaccctgaaacagtggagtttcagggctgaaagccagtctgacttcatcctgaccttcagctatgcacatgtgccctgcgctgtagcgtggctgcctgctgaatgggaatggggtaggtgtgcttgtcccagcatcattgacattccaggaggctgcttcctgccggtcctccccctcaccaggtaccatgtttcctattagttcttcaggaaggaaggcaggtcaaaagggtggatgaagtaggtcagaaagagggcagtctctagtaggaggggacacagacttatttactggtaggaattctctcctgtggaaaaacagttccgaattcagcctcaggatacaagccccacctctggaggtgctcaggccatgagggctgcagctgcaggtcttctgttcgtcaacctttttctcttgagctgaacacaccagactccctgcagaattgcttgggtgtgcagggagagtcaggttattttttaattgaaaaagacattttttcttgagaacatgggaacactacaaaccttcaaggcaaatggaagaacaaatagatgttccagtgtctaggcccagaacaggaagttttacgttgtgtttaacagatacgacaggatttgcagaggaactttaaaggagcccaggagtccgctgaaaatgtatttaaagttttgtttgtgtgcttgtgcatttgcctcagaagatggttcttggctttcatcagattttcaaatagaatctgtaaccaaaaaaatagttgaggctgggtgtggtggcccatacctgtaatcccagcactttgggaggccaagacaggaggatcacttgaggccaggagtttgaagctagcctggacaacccagtgagactcctttgcttcaaaaaaaattttaaaataaggccgggcgtagtggctcacgcttgtaataccagtactttgggaggccgaggcgggcagatcacctgaggtcgggagttcgagaccagcctgaccaacgtggtgaaacccccatctctactaaaaatacaaaaaaatttgccgggcatggtggctcatgcctgtaatcccagctactcgggaggctgaggcaggaaaattgcttgaaactgggaggcggaggttgtggtgagccgagattgcgccattgcattccagcctgggcaagaagagcgaaactccgtctcaataaataaataaataaataaattagccgggtgcgatggcatgtgcctatagtcccggctactcaggaggctgaggtgggaggatcgcttaagccagtgagttctaggctatgattgcaccactgcattccaacctgagcaacctccaacctgtttcaaagaaaaaaaaatgttgagattcattgggctcttaaccagagactaactatgcacacgccactttggaaatgtatgctgtttgttacccaccacagtactctcacccacctgaccccttctccctatccaaccttagccttaaccaagaacagacctggttcctagtaagccatgtttccattcaccaaggtttggggagccttccctgactataaaagagactctgctatcacttttatttcatcttaattcaggcatttttttaatgtggtgtagttgacttgtttctaaattcctttacattttgtattgttcacacagtaaaaatgtctattttaccattccccattctaatttttcatcatttagtcaaaggtggggccaaaattgagctttagtctatgtatagtaaggttttgtttcattttgttttgttttctttcaaccagaagaataaaatcagaattttagagcttgtcttacccaacccacttttttttttttttttttaaccagagatgttaagtcgtttttcaaggtcaaacatctagttggtagtagaggtaatgagttgttttattctttgctcttatcgaagaaaggaaattatagaattaatggaattttatgaagttgggggttttctttatcgttatcattaaaagaacgcagtgtggttttatgaaagcctcacacaggctgtcttctcagcccttttcagacccgcactctttcctccatccacatcctctcccttctccccagccccaacccttccttccacgtcaagctgagtatacaaagcatcccatatttcaggctgaggcctacggagtgggttcccactggaccctctagcagcctgcattctccgacttgaatggctgcatgtggagagtatgtatatttgttcagagctcttgctttaagttaccccttcccaccacgttgcccaaagaaataggaatgtgaggggaaaaggaaaggaaaaataccacaggtattttcccctctggggaagcttgggactcaccacttcacagaattcaaggtacagaagcatcttttcatttagcagaaggctgcaaagtgtgggtagaatgctgagttttgttaatgaattgctgttcatttccctcttcatcgttcttagtagcttttagaaaatgtgtctgcttttgacttgagccttctacaaggccagagatgtttctacagagagcccttttcttgcaaataagaactcctttcacttttgttcatattgtcccaccatgttgctgcctttaaaaaaaatgtgttgtatatataacctagattatgtccctataaagtgagtttgtaacgactccctcatgagcttagcaaaagtatgtctagacaattttttttggcttttccccccaaacttctttgggttaaaaatagggaaggacttgttttaatacagtgtagtactgtatctttaaccttttgtccaaacgcatattgcctgtttaagttttatttagagaaagtgtgtaacttataaaccagctcgctcagaccttggggccgcccctggctggtcttcctgctgcccgtggattagcctagtctccagaagtgttttacaggaagcttaggcggagggaagcacttaattattatccaaatttttccctttagttaagtcttacggtaagatatcccagagattatatttttagcaaccactttaaagagactggggagattaatttaaaattgataatcgcatggcagcaccacagcctaacaagctcaaggtctgccttgtggagctggctgctctctggggaccccagttcaattctctttgctgccagttgaaatcagaaatcacaaccgcagtgattagcagtgaattccctgatctccctgctcgaggcagagggagagggggcctgttttctaagtagccagtcgttaactctttcatgggaggggcggaggcagaggtagtgattcatgggtgtgaggtggggcctagtaatctacaccttcacagaaacttcccaggtaatgcttagagtccccagctctgggagcttctgtttttaggggagtggtggacagtgagtgaagaaagagccttttgggcccatccaaggctgccctccaggcaccatgaccgctgaaacccgcaccgcacggctcaggcctctgccgagcaactctgtccttctgggcgagcctttctttgtggaagaaagcaaaaaaaactgccttctgtccctcttccagcattcttcttttaaaaatggcctctggctaccaagtggacaattatggatagctctgtagagcagcggtaagcagtgttaattagctgcaggatatcagaaacaaaaatgaaaatattttccctgtgggccaaacaaaattaattttaaaaattaatgtaaaccactaatgctgcaagtgcctccattaaattacaggactgtgacatgtacaatgctatatttttgccgttgaatttgttatctaagaggtgttcattgtttgttacggtgtgaaaagctgttttcctccagataagcttgttcattaggaaactggatctctgccaccaccctgtttcttcgcactgaagtaatgccctgtagcataaatgtagacagccgcactgcatttaatatcagaaatgtaaatcaaaagcgtccagtctggttttaaatggcttcagtctttcccagggtgaaatctggggaaaaatttcttctctgtgcagcttctgacaccactgctttagcagacaggccctgaaagcaggctgataattattaaacaaagtatcttgtttcccactgaggtctccggatcgctctgtcattagactggatttatttctagggtttcattcacgctgtgacagcttgggatttataagttctgtgttttaatttcaggcagaaatgaaactggtcaattgcaatttgggagggggaagaacccttgataaaagggctgtgcatcctaatgcctaaatacagagccagaataaagaaggcatcttgggtggcatgctgcgacttcagccacagctgccagcgaacttgagccagccctgggggcagtacagagacaggccgagaacgccatgcttagtgcagccccagagcaccccttcacaccacaggcccctgttccagggaggcgagtgctggccttgctctgaagaaggaagggggagcaaccaggaggaatccctcgtcctgccagccacgaagggcgtgtgctggggcagtgactgaaaacttcagtgtttctctggctctgtcttcattccagaagctctggcacacaggtggaagcctggcctcacccagccaggagcatgtaggttctccttgaacctctgcaccctgcttttcaaggtgttgagtaagctcagtgtctgatttctttttttcaaagggaaaccaaaattattaactcctctgatatcctttctggctcctatttacttacttagcaagcatctaattcagcactatttcaaatctgaggggtgtgttggtaaccagttgggagctgagagaaaacctgattagcagtaagcttatttccatagaaacaggccaattaagatgctgtgtgaaaaagcagtggagagccctgaccagtcaacttttgggggtcctgcagggggcaaactgtccctgccctgctgtggaaacagctggactgacacacagagaggagactctagtcctctggggggtgctgtggctttctgcggggctgctggtgttttcttgcgctcagagcactttacaacacaggcctgaaacagagcagcatcaggagggtcgctagagctacactcccgcttctcttccagaatcccctatttgactgaccaggaaactgaggttctcattaatgacttttctgccaaaagaggcacaaacaaatgaactccttccgagagccctatcagatgttgcaacgtaagaggcttctagtcggtcatacagatcgcgtatattaacataggaactgatctgccatcaccaaggtgaccataggtcctggtttgcctcaaacagccccaatttatgcctgctgtacttgttaacagtggatatcttcactcttaaaagtatccgagtttgaattctacgggatgatcaccctcgctattacccacaatctagccagttggttcaaggcgaataacccctaatgggaccagtgaattagaatctcttgtttaaaagttgtggaaggctacatgtgggacaaaaccaatgaaataaagatttatttatttatttatttatttatgtatgtatatatgtatgttttgagacagtgtcttgctctgtcgcccagactggagtgcaacggcgcgatctcggctcactgcaacctctacctcccgggttcaagctattctcctgcctcagccccctaagtagctgggattacaagcatgcgccaccatgtctggctgatttttgtatttttagtacagacagagtttcaccttgttggccaggctggtctcgaacttctgacctcaagtgatcctcctgcctcagcctcccaaagtgctgggattacaggcatgagcgatcgcgcccagccgaaataaagttttaaaacactcgaaacaatgctacatggcatttgtatctatgtacaaatatagcaaaagtataaatgccataccgtgcatgataaatatcaaattggtgagtgtgtaccctgcgggaagatatctgaaatatatatttctccagctatatggtggctctacaggttttccttacatgtattcttatgttatcctatacttttcctgtagtccaaaaatatttcataatttaaaaagaagcaagcaggccttcagccaacagagaatggtttcattaaagtaggggagtgtatttgttggggtgcatgtaaggaagggaaggattctatttagggttaaacatctcaagaattgctccaggaaatgatgcgattgggagcatgactgaagcgttgcattgtactctgggatagcactggtagacaggcactccagaaagcacaggatgcctgcccattgcattgatgtttctcgagttctcagcactaaggcttgcatcctaaactctggtgtgggaaagctagctgcatatttacgttctgggtggatttgcctccggagaccctgctgttcaatcccattcagtttgcaggttaacatttactgttcctgtccttgaggtcagcacttgcccacagattttcctaatttctttattttactcttcctccaacaattgcaataacttggatactttctcttcactacttgcaggaaacaggaaggaggcacacagtgtgatacacagtcttgggttgatgtctgttttcaaacatgtttttggaatctccatttgagtagtttaggtctaattccagtcataccaactggcttataaaagccaccaggaatgggtaaaattgctccagaatgggaagggagcagcattccatatggcaagggatttttcttttttcttttttgagacagagtctcactctgttaccaggctggagtgcagtgatgccatcacggctcactgcagcatcaacccccctggacttgagcaaccctcccacctctgcctcctgagtagctggaacaagaggaacataccaccatgcgggctaattttttaactttttgtagagatagggtctcactctgctgctcaggctgttcctgaatccttgggctcaggagattctcccatcccagcctcccggagtattgggattacaggcatgagccaccacacctgcccaggaagggatttttcaagaggaaatgagacagaaagagtttggactgagtgcacatctttctctaccctcaatgatgtttgttagcactgcatcacctggcctagatggtccttggcaactaggtgactgatctgagtattttacattgcagcatctgtacacaggtgatctgtatacagcaagtgattcctgtaagctccttgacaataacagcaataataacctttactcagcacatgctgcatcccaggcactttggtgcagcactttacatgactttctgtcttccatcctcacagtcaccctttgaggtgggtattaggatgaaccatgtgaaactgccatttttgtaggtcaaaaacagtcaaatattggcaattgtatgtggtccaatctaataatctttttgtaatcaaaaacagtcaaatattagcagtcctatgtggttcaatctgatcatcttactgtatttgctttgcaaatagagaaattcagacattgaaacttgctcaaagtccacccatctaccaggtgccagaactggaatttgaacaaggtactcccctccacaccctcacactgaactgccgccgcacagtgctgtctccttgggtggaagaaaaaggcatatttttgtggcctaggtgttaaataggttcttcaacaacacctcggccaactttgagatcaaagatggttggtcagatgaatcaaatgtttcctggagtcttgggttacactcgtaatgctctgtttaaaaggaatgatatgtagtgagcacatcagaaatctggaagatggaaaatctctctttaggatctctgctcctctctcgagcaaagaaagaaatcggtgtggtgccagcagaggtgttctcagcaggacctggcccattaaatgaaagacttccatgctgagccaatcaagagagacctggacaaaaatcagactctttcctgccctggaaacccatgccttgaatctgtaattcatctgttaaatcaagtgtgcagccggtggtttagcacagagggggacgacggggaagagagaggggcaggagctgcagcacttgaatttccagcatcagagtccagttagggaaaagaaacagagctgtgatagcttcttggaccttatgtttccagcaaagagaaagcagcaggaaagatttttgaaaacagatgagctggtggaaggtattagaacaatggcggaagaggcagggaccccaggggctgaacaaaacacagttccgctgttgcctttcaacaagactgaataaagtttaggattttttttttatgggacttgtagccgtttttaaactttcatttttcataatgtcacagataatctttttatctattatccactggctcttttctgagaggcatttgcatcaaatagtgctgtacagatcatgactgtctctagtggggaaagcagcttgaaatgaaaggttattcactccctctgctttcgctggctttgttcttgattctcacacatttttttacatctgaattcgggtatttctggagtttttctttagaaacccttccattctgagatctaagcatattcagactccgatctatatatcaggggttacaaagcttatgcctactgaaagtgaagcatgtactttgaaacatttgttggataccccatggtttccaaaatcccttcagagcatttcctacagaggcagcaaccgtaaaaagcggccagtcacacagtgggggccctttccctagcactggcctcctggtggcagtggagcagtggccttccaagcatgcactgcgagacatgagtggggcaatccgctccttccaactgcagggagaacgggtctgcagaatgaattctctttctccactcctcccatgtggggaacaaacgagagccctcccagggggcgaagtggagctgcaggagagcatggtggaaaacccaggagccacctgggctaacagggaatcaaaaatgacctttttgtgcacaaaaccccctgggaaaaaaaatgacctagaaagaagtggggttatggccaggtgcggtggcttacgcctataatcctagcattttgggaggctgaggtgggcagatcacttgaggtcaggagtttgagaccagcctagccaacatggcgaaaccccatctctactaaatattcaaaaattagcgggatgcggtggcagacgcctgtaatcccagctactcagaaggctgaggcaggagaatagcttgaacctgggaggcggaggttgcagtgagccgagattatgccactgcactctagcctgggtgatagaatgaaactctgtctcaaaaaaagaaaagaaaagaaagaaagtcgtggggatatgactgatagtttctgttcagcttctattatagtttcttaactcatcaccccaagctccagggggactctgggggaaggttgagaccaggtttgttctcaggcctgcctgacagagcccctcaggaaagcatcatccactccagctttctcctctgctgttccccactcaaacactcctgccattccctctcagaaagcccagaaacctttcttcccctccccaggaggagggagagcagtctgcagaggcaaggcctgagtggccacaatgacttaggtattccagctgtgcccagaacttggtctcagacaagtgcacccaggttagtagtgacctcagagaacagtggccaggaacttgtttttgcatttgtgtgtgtgtgtgtgtgtgtgtgtgtgtatgtatgtatatatatatatatatgtataaaataagggggcactggcccccagagaagtactgacaacaacctctggttagagggcagttctttgcagcttttgatgacaacctgcgaggagagaatgttgctctcaattgttcaagaaactgaaagcttagagaggttgaagcgatttgccaagttcacgggctggtgacggagtgggcctcagaactcagatctttctgactcaaactgccttgttcttaccatcccctatctccctagaggttgttagaacttttgggggcatactgttcctttattttagaaactctttggatatagggtagtggttgaagcagctctgaggatctgttttgaagagaagggtagcattgttagactagtagggtaatttccttttcccaagctcgtccctccagacctttgagccggtcatcatagttttatattttatgaccgaaaagaaacttctgttaaatcgtaaatacactaaaagccctggtgcctaaacacatgaacgtattatctccttgagcctggaaatctcccagcaatgtggcaggaatgtagaaacagtctgagttgtcaacaaaacataacagatttcccagttgtaacaaacatacgtgtagttgtgaatggaaaactctcccaataagcaaaataatggcctttttcgtgttgttttcctcatttaccatagctgtcctttcagagtgccatcggtttcaaatgtttcattgtattgatatttataacacttctagtaagcagagtgcccactacattatttttatttaactctctccagagttaaaggaacttgtagttaaggtgtcatctttcagatttacaattttacctagattggcaacatgggtggcaaagtgcttggaactaagacagaaaagttggttccagtcctggcctgcctttgtgtgtgacttgagtaaggctcaggaagagaggctgctgatacccaccccacctgtccccaccccacctgcccccaccccagatgggtcccaaggcaaatgtgaaagattaggtgctcctgaatgtgacaccagacgtggtgtgacagagcccatttgtgggtgtctgtttcaaagcttttggttcataggccatgctgcccgctttgctggaggaaagttccaagacccacaccaggctactccttgacaggaagcttttgttcctagcaacgggtttacccagtctttgtttgtttgtttgtttgtttgtttgttttgagacagggtctcactctgtcccccaggctggagtgcagtggtgctatctcagctcaccgcaacctccacctccaggttcaagcggttcttctgcctcagccacccaggtagctgggattacaggcactggccatcacgcctgactaactttatatatttttagtagagacagggtttcaccatgttggctaggctggtctcaaactcctgacctcaagtgattctcccgcctcagcctccgaaagtgctggggttacaggcatgagccaccccgcctgccccgactctcttcttaatatgctccatgcgtttgtttatgctccccccacctgcaacatactttgtagtctacgcatgtgtcagggctatttgctggtctcttttctctcaccctgatctggctgtgagcagataatcccccattcctcaatttggctggtactgcagttggcacggctctccaaactctgcagccaccagacatgtagaaacaaacctctaggcttcccaggaggctcacggactgcctcatggctgagccttcaatagagatgatcatctatgaaaataataacaaaaaatgttgctggttataaatgcaatatatgctcaatagaaatagtagtctataaaattagaaagttatgctgttataaatagaatatatgctcattgtaaaaatgtagaaaatgtaatacatattaagaaaaaatattcatatttgccatcgatatatattttacatatttgtatgttttttcagtatgacacatcaaagaaagggcagaatcttctttcttctcttaactttttgtcgtgagcaatacagtgttaagttcagggaaggaattgagttcggagccaaactgcccaggtttgaattcagctctgccacttgctagttgtgtaatactgcttttttgtttggtttggtgtattttattttatttattttatttttttttgagatggagtcttgccctgttgacaggctggagtacagttgcacaatctcagctcactgcaacctccgcctctgggttcaaacagctctcctgcctcagcctcccgagtagctggattacaagtgtgtgccaccatacccagttaatttttgtatttttagtagatatgaggtatcaccatgttggccaagctggtctcgaactcctgacctcaaatgatcccacccgccctgtcctcccgaagtgctgggattacaggcatgagctaccacgtccactgcctgcctgtcttttactgaagttgtagatgtcctctttgcctattctctgaattctacccctaccctacccatggtgacccacagagtgctttgtatacaataggggtgtcattaatgtttgttgaacataaatgaattaaaatataacatcctaaaagtgatttcaaactttggaatttaggttttgttgtttttgttttttattagagacggtcttgctctgttgcccaggctgcagtgcggtgccaccatcttgactcactgcaacctcaaacttctgggcccaagtgatcctctcacctcagtctcctgagtagctgggactacgggcacaatccaccatgctagctactttttttttttttcttgtagagatggtgtttcactatgttgcacaggctggtcttgaactcctggcctcaagcgattctcctgcctctgcctcctaaagtgctgggattaacaggcatgaaccaccatgcctgacctgactttggacaagttatttggcatttataattccactttctcatctacaaaatagagacaataatagtacctacctcatggggctgttttgaggaattaacacaaataaagcacttagaataatgcttcgtgctgtgcagtaagcactcaataatctaagttggtaatattcctgtttttatatcgtgttttaataaatgagaacataacattttaaaatcaaggagctgtgatttcatgctctgcacactgcctcagtgacataaagactgggactgaagctggggcatcactccctttggtttcccctctcctaggcccttagtcacatacaccttggagaacaggcacaaccgagaggacctgcatttcagtgatgtccgaggccaagggacaaggccagattctagtcaggtgataatggaatgagagtgttcactgcacatgtcttaatgaatggagatgataaggggtcaccaagccctatatatttatagtgctttatttttcatccaaaaacacaaagtgctgtttagtccccacaacaatcaggaaagcgaggaactattcttcccactgaggggatgggaaagctgagtccccttggtgggaccgggctgcaggcgcagggacttgctcccctcaaactgttgtggtctcaccacagtcaggaccagtcacttgaacagctcccatttccccagaatgattctatagagaggcaggagaaccctggaccctgagcaggagacttcagtccaggggccagcagcgcaagcacagcgtcatagaacatcatagaacatagaacattattctgctcagggcaaaataatgtgggctgcacagtctggcccaggcagccctcagtgttgtgccctcaagtgttgagatgacaggaggatggggtcaggccagtgatcctcaaagtcagaagaagaatactatgcctcaatcctactcatttcctttccaaactctccctagagggcctctaactgtggctgaggggaggggcggcactttttgatacacggtgcaacttgcccactttgaccctgacctttgctctgtccccttcaggtgaccctggcaagtagctttttagagcagtggttctcaaacttgagtgtgtgcagaatcccctggggttggggggcagggctttgaaaatacagattgctgggccccacccctagagtttctgatacagtggctcagggatgggcccaataatttacatttctgacatctgggttcctggatgctgctagtggagagaaccggtgatttgatagcattggtgagctggctcaactctctgctcaggaaagtgacaggatgcctcaaatgctgagtgctgcgtattcaaattccaaacacaaggcaactaggatgggagcccttctagactctgtgtattcaaggaccagggagaggcttagcagctctcagctctcctggcacagagagagttctctgaagcttgctgtttttctctctcctactttgatagtttcctccatttgtatgggcggaggttgcaaaggccagaatagactcagcgagagtgggagatgggggtgagtgagtgtgttcacttttgatgaggagcagatgtgacaagcactaaaatggagtgggcaataagaattattactagctgaggccgggcacagtcgctcacacctgtaatcccagcactttggaaggccgaggcgggtggatcacctgaggtcaggagttcaagaccagcctgaccaacatggagaaaccctgcctctactaaaaatacaaaattagtcgggcgtggtggcacatgcctgtaatcgcagctacttgggaagctaaggcagaagaattgcttgaacctgggaggcggaggctgcagtgagccgagattgcaccattgcactccagcctgaacaagagtgaaactgtctcaagaaaaaaaaaaaagaattattaccagctgctttgtggtcaggatgtcccaagctggcactgcagcaaccgctgttagggggcttggtgccatttgcaaggatgtcatcctcagccactggtttctaggcagcccctccaggaattcctcttccatgcacctccttgggcagagcgttgaggtgtggtggctgaaattcaggaattattgtggaagcttgagtttgcatgcccactccgtttcctactaactagctcaggggcgggggagtttctgaactatgttggcatagttcagaaacttaatgtttaagtgtcttaatgtatacgatggagataatgctctctgatttactgacctctcgggttgtgggctagacaccagagtttcagagttctcggtgcactgctgtgtattcctgggaatgcccctgagggtggagctctctgtaaggaaggcagccccaagggcagggctggtctctttagaaagactaggaatgaggacacccggcgtccaggcctagcttttccacccactcaccttcacagctccttcatcctttctgcttcagttccctcctctgtaacatgaagttggagtagatacttcattcagagcatcttccggctgtaaatggcttgagcccattgtcaactggaagacagagtgtgacgtctaaaaacccaaacagcaaagagcatctcttccaaaccacccaatctggagaggtggggcagttttgtggttccggcaccgacaccgtccctttcacacggtactgagccgcgggctgcttcggggcggccctccccgccccgtgccttgccgggatggcagagcggatcagaagctgcgcgcgctctgcctgcgcgctttgcctgcgcgctttgccgccgcaacccgcgcagcagccaatccgctggtgcactgcaggtgacctcccccgggcccgggaataaattgtcaagtttccccaccgtgggtgtctttgctagccggcgagttgcagtcttctgagctaattaggagacggtcatgaggagcgaggcgggccggggcgctccgcgggccggggcggggctggggcgggcggcgcgcagctcctgggccgaggcatccgcgagccgcgggtagatcgctcgcgtctgatcgccgcccgggagctcccgcggagccggctgccaggactcgttccagctccagtgcggggctgcccgggcgtccagaggcggcggacggcgtgccggcaagtttccccggcacctgccagtgcccgcgaacccacctcggaagccagacccggggaggcagaggcagaggccggctggctccagccgtggtaccgcacggctgccaccctcggacttccgtcttgagtctcctgaggctgagaagcagcagatgccgaacctgccccctgacgtggacgtacacctcaagacctaaaatgcgccctgcctggagactttgaacttagtcttctggaaatgcggagaccgcttcgggtggttttgtttttgcatcctcttcggctaggtttggctttgggattctctggctacctggatacgcctttcctttgtgggcaagtctcccgcggatcgcagcaccagcagccaaccctggggcacaccagcctttaaaacccccgagcctggagacgcatggagctagagaagaggacccaactcctgaccacgtaaggactctgattccacctttcccgtgatggagagaaatataatttcatggcagaattttctttaagcacattgtctgataggattggcaattactaaccaggaaaatgagtagcaattaggagttcagtaataaatggaagtctattgtcctaattgagtggaattactgactggtaatggcaacactgaattcttcagtttaattaagagtttatataattatagtgcactttttatttcttgggggagccatggggtaggaattaaataaccagtgtgatggttaagaaacccatttaatgggtaagtaaccaatgagttgaaatgaatgtgagtgccttgctcaagcaatgcaaacttagatgaattcctgataaagagatgtaacagcttgggccaagcaagactttcagctgctaattcctgtctgataaaaatctgaacggcttagaaatgattgggtaatctctaaaactggcacactgaaactgttttagagataccagagctccctctctcctgccggggtattaaccccgatttgtgctctctgtcgctgtgttttccacattcttcaagagtgaaacgagtgggtcatttgagagtgcttttgcagcctggggtttctgtatggaaaatcttgtgattgagctgttgagctgtaaatgttgatagctgaaggggatagacaagcttcatcgaagttactcaaattcaaagcagagtgagtatgtaggtgtgcaatttgggaactaatctgtaattataaagatgttattttcctctttggtggtgtattgtttcctttactattatgttctcaagaaattgttccccttgtgggaagcagtgaaattggagagaaatccctgctcagaggataattacttatatttttggtgtaggtttctgggaatccttttaaccctacattgggatgcacatatttatttccataagaagctccagcaggtttggaaatcactaggttttgaatacactggtagataattagcacttcaagtaacaatatttatgccactctgtaccttgacttctttttcttgcttacacgaggtctagattttcaacaggatgatcagggactaccttctctagagagcttgcatattgcaagtgggttcagggagcaccattatagttgcatttcactccagaagagacagtgagtggcatggaaggggcattgcatcttgaatactgcatgcgttttaaagtttgcagagcttattcataaatccgcttggttaatgagaaaaaagcaggtatcgaaagacgtttgctgtatgtgtgcctcccagtctcagcccttccaggtgctttgcaggtccctaagtacagagtgtcactgtccagaattttaagggcttacctaccctggtttttcccctctcccctagtcctgttttgtcattgctaccatgaaaatctagcaaaagtgtagaaagttgtgtccttccagaaccacggtttctcagtgcaggtttactgtattgagcgcccactccttttctgtttgtattctgcccaaggcacagcagacattcactccttttatttcccatgaaattgtacaacaggcagaagcttgaagatacaacacggatggaaatttgagccttgtaacgttcaaaaatgacacaattgccaagtttcctaacttttcctaagagttgattaaagatcacaacttcatatcgctcctttttccctatgcatttgccgtccatcacacacctgactgtgagctgttgtaatagctagatgaggtttaaaaaaagagggagtaggggctcaaggattgctgtcctctcagaaatgttgcccaaggctaccctaaggctcagcctacccccagattctctttctgacaagtgggtgtttggtaggatggtgtgaaagtttccttctatgataacatctttaagatttgtttccaaattcccttttttttctttttgtaacctgctgagaatatgagtctgtaacctatgtatttatctgaagtcagcctgaacagatagaaaaactgagttacaaggtatgggactcccagtaaattaggaacagatgtgggtcaaaaacagatttccaaactctttatcaaatgatcccacttggaaacaagacatgaacaggcctaactactcttaaaatgcaaggtttgtctgagggcaaacatgctggaaaagatggtggccaccaccctgcctctacttttcttttcctttcatctttcttcccaccgtctttggttccctgcataggctgtgtagtgggtatcagtcagcacttgtctgctggttgcacaatgcagattactcacttctgcccaagtaactccctgaagccgtactgtaacaatagagcatataaaaaagaaactcaggttgatcttggcccctgtccaaggggattagctagggagcacctgaaaggcctgtgttgaacacactcacctgtaacccagttccatggcctggatctcaaggacagggtaatctcagtaccttttaatgacctagtaaatgtggtatctttctgtctttacactcgacctgatggctcatagagtctcctcattatggagctggaggagtactttgaggtcatctaggccctcactactcaaagtgtggaccatgggtcagcagcattggtatcaccaaggagcctgttagaaatgctgaacctcaggtccatccctggatttatagaatcagaatctgcgacaggttccccagatttctcatatgcattatgacaggtggggttgtcccatgatccaactctgagatggagtttagccagtggcgtatttattaaggagtgccctttggatcaatacctatgggaaggaggaggaaggaacaggaataggtaggtagagcaagaagtcaagcagcaatacaggcccagtgacagtcatcactcacaacacgggaagctacacagctaggtcagccttctaagttgtctgtggtgggcagggatggccaggcctttcaactcactgcagacagcactcccagcagtcagcagcaagtctgtcattagacagggatctgggtagctcatcacagtgtccaccacatgcactgaagttgggagaagctctattctgggtcactggttctcaaaatgtggctgcataccaacaggaccttcagcaccccggggactcattagagatgcacattcctgagccccacccacagctactgaatcagaaactagggtggggctcagcaacctgtgttttcacacgttctccaagtgagtgctgcatgcccaagtttcagaaccactgctccaaggcagccttttttctgtttgttttgttttctaattgttattgaaatgattcacagtccatcttaataataaaattcaccactttaaagtgtacaattcagtaattttgtggggtttttaggttttttgttttgttttgttttgttttgtttttgagacgaagtcttgctctgttgcccaggctggagtgcggtggtgccatcttggcttactgcaacctcttatctcctgggtcaagggattctctcgcctcagcctcccgagtagctgggactacaggcgcccgccaccactcctggctaatttttgtatttttagtagagacggggttttgccatgttggccagactggtctcaaactcctgacctgaagtgatctgcccacctcagcctcccaaagtgctgggattacaggcacgggccaccgcgcccggcccaattcagtaatttttagtatatttataacctgtttagtatatttgcaaccctcgcctttacttccagaacattttcattatccccaaaagagatcccacacccattagcaatcactctctgcaccccctcccaaagtctggcagccactcatctgctttctgtcactgtgaatttgcctgttcttgatactttatttaacttgagtaatgcagtatgtggcttttgtcttgtttcttaacgttttgagagtcagccaagctgtaacatgtatcagtactccatttccttcatgggacaaatcatattccattatttagacagtaccacattttgtttctttattcatccattgatggtcatgggttctttctactgtttggttattgtgaataatgctgctgtgaacattggtgtacaagtttctgtatggacatatttcttcaattctcttgggtcaatacctaggagttgctcagtcatatgttaactctatgtttcactttttgaggaactcccagactgttttccaaagtgactgtaccatttgacattcttacaagcagtttatgagagttccagtttctccgtattatctccaacacttgttaatatctgtcctttttattatagccattctagtgaatgtgaagtggtatctcagtgtagttttagtttgcatttccctaatgactaatgatgttgaacatagttttcatgttttcattggctatttgtacatctgctatggagaaatgtctattcagatccttcttagggcagctctttttgttccttaaggaatccctcagtatgtcagctttgtgtccagtcctgtgcaggtgttttaggatttatgaaacaaagcctacaacctgtggccattacccactggaaagttctaatcagatgtgaaactgtctaaaaaggggaaaggaggacaggagagcccactgtcgagggttagcatgaagagattcacattctattacaattcgtgcttcagaaagacacggtgtgacttgctaggatagagtggtgtgtgtcagggatgtggcggctgcagactgctggagaagactgggaatgttgagaggaagaggaacaagtagagaagcggggacaggaagttgtgggcagaccttctagtattcttttatgggttacacacacctgtaagaggggatctcaggagcccaagatttctttcaagatcatgaccttcaccagcctcagcaaggtgaagcagttcacctttttcttcatttgggcaaaaatgacctgcctccaccatttctcagagtgtttgtaaagactgattataatactctaaacaagtgcttgaagagtgtgatttattctacattacaggtgagaaaaaagtttgtaggtgtccttaaatagtctctgattccctattagcagatcctcatggtggcagtgccatgtccatcccaaccccccagggcaggtgcctctctcaagatacctgagactaccaggcacatcctcagggctcccaggcagcttctctttatggttgcaacacaccttgaaaatgacatattggggcaaaagaatttcaaaacagcaaaacctttgccatcatcctctcacatagctagggcctctgcacgtatgataacaagacagctaccttagacttatgtcatgccatctaacttacaaagtgctctctcaaccttgcaccagaggaaaccaaagctccaggaagtgacttggctaatgtcaccggttggactgtagcatgatcaggacctgacccctggtacattgacacctgacccagtgttttcatcgggcacttttaccttacaggttgctaaggattaatgatgggatgttttgattcttagtctataagtggatcctctcccaggaggctccaggtctccggatgccaggcactcatgttttatttggtgttgcagctgtgtttcattgtagtaacatattccaaatgctatgagatcaccctgagtctcattgaagaaaagtgtttcaaaagtatgcagagaggtcaaagtattaggaaagttctagaatgtacttaaattctcagtttcttccaggagcccctctgtaacaggctgggtcgtaattagagtatttggatcactgtttcttgaacacattcaacacaaaactgtggcaatgcagaattcaaagagtggatcaggacatttgtgtactaagtagccctgtacatactggataatgattttctttcgtctgttcgccctgagttctctagcgtataccctgtcttgggtaagaatatatcctgaaaagtcatgtgtcaggttgatgtcctttgagtcctattttaaattcacaagtggtatgtgctgagaaaaagcagatcctctgataaagcaaagaactgtgttgtgaaaaaagttattctatccctactcattcatttcttctgtaaatcaggattttaggtatttttttccttaaagctagttatatctacgtagaagatttctgcatacttctcttttttgtttgttttgtttttgaagaacaaagtatataaatgccctctagagtcatagacacagattgaaggtggcaaggtgagcaaaattggcattttgtcccattaccccattttccttttcttttcttttttttatcctaagcaggagagaagtgatctgcaagtttctcaggatgcttttgggtaagagtttcaccataaaaatgtcttcacccacactcctcccagtgtcagtgtgccaggtaccctgtcacctttggttgatgtcctgatggattaagctctggacagagccacacctttgaagaggcttcttggccagattaacacaccaaggaaagtgcttcagtctagaacatgccccgtcgctggggtctggcaccctggcctctgtgctgtgccctcctgcagcctgtgctgtgctctcctactccagtgcttagaaatgccaagtcaaggatgtgggggcaggtgcttgagagagggtcaaagtgctgtcattgtaagaaattattcatcaacctcagatagtatcttccagtaacaaaccatacaagaccctggccctcgaggaggagcctgcaaatgttagctcccctgccagccaaagaaaatcaggaaaagagcaacagggaaaatactttatttttaaggagatattttgccaataatttaaattgcagctttcttctcttaatgaagaaatatgcatttcgtgatacccagcctcccccagttcctctgaagcagagataataataactactatttattgaggactagcagccaggtgcttcagcactttagtattttctgccactcaaaaaatcaatgggattggcatataatgatgccaaagcttggcaaggtgattttgtctgggtttaaacccgggtccctctagcacagtgctttaaaacgtgcctggcccacaatacaaacacaccgtgacccggtgtaaggtgttttgtggaactcaccaaaccactcaataaatatcgactgcatgaaatgaatggctgaacttcttaggacaattttattctttttgatggtcatttcaggtgtcattcctctccacagaatggtagttatcacttacctttttatatccgcacagattaaaagctttggtgactgtcgcttggttccattttgtgctctcctccaggctggtgatgggctggggtgggccgagagcaaagtgtcagtgcccacagcatgcatgagctactgctttcaggcctggagatgcagaaggtgggccttacctagctgctcttttacttgctgtgattgtgtaaggcagaagttcacccttgctctgcagcaaccatcacagagagttgcaccagccagatttgcgttcagcatgcccaatgatcaacatgctgttgaaaatggaagtttgaaaggaattgaaagtagaaatattcaccttacaggacaggtaacacttgcccctaggccctactttaaggatttggctgttccccagtatagaattagagaacgtcagagcttgaagggaattagagagcatctagcccactccactatccctgctcacctctgcctctgctgacagagaagctatggacaagaaaggagaaccgaaccactcagaccaccacagtccttggtggcaggccttacactggaggccacagctctgccttctggtaccttccaccatgtggcatctagctgcaagggaggctgggaatttaggttctgtccttacagtggggaaagagacttaacccaggagtttccccaaatatgggaaatctgatataaatgggcttgcttaataattattgccattcttacaggctaaaataaaaatcagatttcttcactgtgggaatagattttcctgagatgttaagggagctcctgctttgtatgcccttaatcttttcttgtggtaatgttttagggcggttccattaagcacgcaaatggtcatgatatcttttaagggttcctcctgctctatgagtcttcattttcaacacgtgaagaattcagtataacattttccatttttcactaaggctaaacttatacacactgacatatccactttaaagcatcataaaacagcatttgcccttgctctgtgctcaatttttctttccttggaaatgctgagaagtcgttgcctgttcctggtttttgacgttggctaaccacctactgctaaatgagacgaattgaaataatggtctgaaaactgaatcgtatggcattcatgttcacaggctgaccaagccaggagggactggaattgatatcttccatggaaaagatgtctaacaacacaaccgtttgaatcaactcacgtttactaccaggtactcctggtactaaatactataagtagcagttcatttgtttttgtctttcttttttttttctttctttctttccttctttctcttttttttttttttttttttggtcttttctttctcttgtgtaaatataaagctcccactgaaatctacttaagtatcatatctggaacttttctagtaagtagtggaaaatcagtttgtctgaggtcatctttcccataaaaggtgttgaagtcaaaatacaacatagcgatgaatttctcaattaaacattgtattagcgaatcacagaattacaatttgaggaatacacacagaccagagtagtctttggtatgttcaaaggacaaagagaagattggggattttattagaaagagaaatgttatgtattgttttgaaagaaggctcattggcactacagaagcttttgggagctggcaaggtctgatgagtgaggcagcaggtaaaactctagacaagaagcaagacaactcacagcaggtcatttcagcagctctgtgtaaaacaaccttagggtcatagcaagccttttcagcagctgggcttgcagaaaattcacttcttggagctggtgctatatgtccagagtgccccagcacctcgactctgatttagttgaatatttcaagaatgactcaattcgtataatcaactttcacacacgctttttgggcgctggataagattatcagaggagataattacgctacctccagacctttaaaagtgagcctcgtctagatctgatagttatgaggaattctacttgaagcctatgagattaactagacgatttaggacttaggactgagtccctaacactctagtaatctatgattcttaaaagttaatatttgtatttatatttatatttgcagcccatcaataattacattaatgatgaacttggttcttagttttgaagcatcattcatgcatttggtcaatagcatttactgtgcaggcactttgttagcagccggggatacagtggtgaaaaaagtagacatgaagcttcatgaagcttatattatagtgcagcgcccataagcttttcaaaatcttcaattactgtaatagtgtttcttggggccagacgtggtggctcacgcctgtaatctcagcactttgggaggctgaggcaggcagatcgcctgaggtcggaagttcgagaccagcctcatcaaaagtggtgaaaccccatctctactgaaaattccaaaattcgccaggcgtggtgatgcacacttgtaatcccagatactagggagactgaggcaggagaatcgcttgtacctgggaggtggaggttgcagtgagtcgagattgtgccactgtactccagcctgggcgacaagcgagactctgtctcaagaaaaaaaaaaaaaaaaaagtctttcatggaggacttctcatacacgtgcgcacacacacaacacattgaacactttattgtttctgtagtgatggggagacagctaggtgtggagacctgtaataagtcctagtgatagcgagccccagttcccacctgggcagagttagatttatcctgtgtaactgaccaattcggagtgatttggagtgtttctcttcttgatgaggcccaggggccccactgcacttggcctacttctgaaaggagggaaatgctgctctcagtaatcctctgctggggggcgaaggtgggagtgattggattacagttcctttagtagctgcgtggagcttgccatgtgtcagaaaaccttagagtgtagtcatggaatcctcagtgctgacaggaatgcactctttttaaaataagtatgcctctctgtgttgggatatatgatcaattgaagcctctgggcagaatccattgatggaaagcctatatttaaaaacgaacctagtggaggtgtatgatacagaggatatggtacagagaagaagaaagcagtgaggtctcaggtgttggaaaagtcaagtctagacaagaagcaagacaactcacgatgcagacgagatgactggaagagtctggggaactttgggagattaaaggatagagatggtggatgctgggtgatttctacctgtgagcacgattaccagatgtccttgatagtgtgcaatgcccatgccatttccttcaggcgacgctgcagttcagcgtgcaagatactgccacacagttgagatgcagatgaatttggcacatgttcatgttgatgttgcccatgtgattaagcttatatgaagtggtacacacaaaaaaagaaccatttccttccacagatatttatatttagggaaaaatgagaatatttaaagaaaagctgttatgcattgtagaagtaaaattgtagaaggtcttctactatctgcatttacttaaagttaaaagttaatcacttccagcaaggaactgcacatgtggaatgttggtggtcaatgtgttatgttaagaaacttaaaaccctcatttctacaaatagtcatatgatacgactcttcctgaaaactagagttgggacactggtaccctaagcacagcacagagtaccaggatgcctatctgactggacctttgccagctctgggcatttgctcttttgttagtctttggcatttattttattttatttttagaggtagggtctcattctgttgcccaggatggacagcaatggcacagtcatagttcacggcagcctcaacctcccaggctcaagagatcctcctccctcagcctcccaagtagctgagactacaggcatacaccaccatacccagctaatttttaattttttttgtatagatggggtctcactatgttgcccagcctgtcctcaaactcctgggctcaagcaatcctcccaccctggactcccaaagtgctgggattacaggtgtgagtcactgcatccagcccaatctttgacggtttgacagacaaaaaactggcatcctgtggttttgtccgggaggtttttaaatgcctctgcccatagtgtagcagtgactatttgagactaaaatgctttttttaggggaacagtttatttgctattttcttattgggataactttttcagagcagcctccccccatagtaagaaaattaaaggtattcacgatgaaccaccctgatgaaaggaagaagtgcttagagcttccgtgtcccacattctgtgtgggattgggaacctctggcatgggtcccagtgatgatattggacaatcccctggtgtactgctcagtgggaaagtagatatggcagagaatgttacttgacttctaataatcattttccccatcttccttgttaatagaaccactgcatttttaatttggtgacttgcccgattaaatgcaataaagactacatgtcttagccaccattgcagcaaggtgctgtcatatcactaagttctggccaatggttatttttaaaatttaaatacattcatttatttattttaattgatgtataaaaatggcatatgtttattgtgtacaacatgatgttctaaaatgtgcatacattgtgggatgatgaaattgagctaattaacatacgtatgaccttacatacttgttttttgtgatgagaacacttaaaatccagtgatttctaagaatacaatgttattatctatagtcaccatgttgtacaatagatcttctaaacacattccttctgtctagctgaaattttacatcctttgaccaacacttcccaacccctccgcccagcccctggtaaccaccattcgactttttgcttctatagctcaacttttttagattctgcatataaatgagatcatgtagtatttatctttctgtgcctggcttatttcacttggtataatgttctccaagttcatccatgttgtcccagaggacaggattgtcttttttttttttttttttccgagacagagtctcactctgtctcccaggctggagtgcagtggtgtgatctcggcttactgcaaactctgcctcccaggttcgtgctattctcctgcctcagcctcccaagtagctgggactacaggcgcccaccaccacgccaagctaattttgttttttttgttttgttttttttttttgttgttttgtttttttagtagagacagggtttcaccatgttagccaggatggtctccatctcctgacctcatgatctgcccacctctgcctcccaaagtgctgggattacaggcgtgagccaccacgcccggccaggattgtcctcttttttaagactgaataggatccattgtgtatgtgtctttaccacattttctttatctattcatctgtcagcggacacttaggtgaattccatgtcttggctaatatgaataatgctacagtgaatatgagagtacaggtatctcttcaacatattgatcttatttcctttggatacataccctaaagtggaattgctgaatcatatggaagttctgttttttgttgttgttgttgttgttgttgttgttgttgttgttgttgttttgagacagaatctcactctgtcgcttacttaagttggagtgcagtggtgcgatcttggcatcttggctcactgcaatctccacctcctgggttaaagcgatgctcttgccttagcctctgagtagctaggattacaggcatgtgccactgtgcccaggtaatttttgtattttaagtagagacagggttttgccatgtaggctgggctggtctcgaactcctggcatcaagtgatccaactgccttgacctctcaaagttctgggattataagcatgagccaccacacccaacccatatttttaatgttttgaggaacctccctgttgttttccataatggctgtaccaagttaaattcccaccaacagcatgtaagctttctttttctccacattctcaccaaaacttagcgctcatctttttttttttttttttttttttttttttcctgacagagtctcattctgttgcccaggctagaaggcagtggtgtggtcatggctcactgcagcctcaacctcctgggctcaggctttccccccacttcagccacccaagtagctgggatgaccacaggtgcacgccactacacctggctaatttttaatttttatatagagaccaggtctcactatgttgcccaggttggtctctcatctttttgatagtggccgtcctaacaagtatgaggtgatattcattgtagttttaatttgaatttccctgattattagtgccgttgagcagtttttaaatatatctgttggccatttgtagttcttcttttgaaaaatgcctattcaggtcatttgtccattttttatttgcatgattttcttgctgtagagttgtttgaattcctaatctattttggatattaaccccttatcagatacatgatttgcaaatattttcagccatttcataagttctcttcactctgttgattgtttcctttgccatgccaaagattttttagtttgatgcaatcctatttgtctatttttgcctttaggatcatatacgaaacatctttgtgaatgtcatggggtatttcccctatgttttcttccaggagttttacagcttcaggtcttgtattacatgtaagtctttaatccattttgagttgattctttcacacggtgtgagataagggtctcatttcattcctctgcacgtaggtatgcagttttcccaatactatgtattgaggagactgtcccttccccattagccagtgggtattaacgaaagagtgaagtgttacttgtagagtgtacccttaaagagtcaagggcatgcccccttcacccttgctccttctgcggtctagaatgtggacataatggttggggctgcagttatcatcttgcaccatgatgtagctttgggaatgaaaggcagtaaggcagaaacagcaacatatctagagaaaccctatgtccctgacattatagagtgccatgccagccctaggctgcctaccgtggggctttgatgtgagaaagagaactcttacttgagccactgttattttaggttgcctgtcacttgcagtcaaacataatcctaactaatccagtggggaaatggctctaaaaggagctatcatccaccttcctaaatttctaacatttggaagccgcttcttatagcaagtctttttgttacaattacgcagtcacaatggataactatctgcactttactgtggactgtggaaaggtatgaagcacagaggaatgaaaatctcacactcactcactagaatgtacttatactcacatttaccaaaatgccacttacagccttgtgcataataaaataaagtaattactaattagtccgtcacgtgggcatccaaaccatacttgaatagtgacttcagtgatgtgctgagagtcgtactcattagagtagtcatagtttctacaaagggggccttagaaatgggcttacttgaagcatttctctaaatatacaaataataaattggaaaccttctggagtgtgtataatgtatacacaaatgtgtgcattggttgttatactcgaagtagcagaaaacatctgctcctgactttaacacgggaacaaatgaccccagattattagctgctaatagatttttgtagttttagggaaaggagaaaagtaccatagccttctttgttctataaagaatacgtattttatgtattctgtgtttgaaccatctcagcatcagaattgactgtttaatagttgcagttgtttaataatttttttttagttaatgcaaaatattggaagtcatctccaggcttctggcttacagagagtccctgtagagatagcagatcactgcatctgacatcgtcagctgtggttgctcaaacctctggtccaggaagaggcagagtcaaccttttttcccagcagaatgggattctagacatgcagatcagctctcctaaatagtcttagagtcagagtattttaccaccggatgtgaaccctggagatgatctagtattgtccttcaagttgaggaaactgaggtccagtaagtccaacaagacctacccaaggtcacagtggcctgggtggcacagggctggaacccagacctcattgttcttgtcatacagcatgaccttccatttcaaggagactaacaaataccaagtttggcaatgtatccaccctcacttttatttgagaggttacaaagcaaacaaaatgagatcatgtcataagcagttctgtcctaagtgggttaggatttatttcttcttttctacattttttttttaaatcagaaggtatatccccaagaacaggaactaaaggaacagattgcttagacccttgtgactctgccctggtggtggatcattaatggtgtagaaaatgagggcagtgctgggcaggcagtccagggtggggtgcatgcctctttaagagatttatgtggaggtctgagctagggagacagcgcggtggtacatcatcatgcaggcgacatcagagactttcttcttcgcttgggtgcattatcataaaaagtgatttagactggagctgattgatgcaaatggccctatgttctttcctatcattagcggcctctttcagtggccagaggcagtgattaaagctgtcatttggagctgctcattaaagacaagccccagaatagcaagaggaaaaaaggttggagaggcatatatatacatatatgtgtgtgtgtctgtgtgtgtgtgtgtgtgtgtgtgtgtattttttgccttaaaagtgcatcattcttttctagattgagccactgaaatcaaggctgtagagacatttccactgagaatatagaatgctgttttgcaagtaatattagattttcggagtgtcatagtagattctgatgacagcttgcctacatattatgaaaggagatgaggagggtattgtgttaggtgtgttttgttagggattgaccctggtgagaactcattaagtctccctcctcccaggctggggacttcagaggcaggccacaggagagcagaggggagggttgccgagagtggatggcctcagtaagtcccactgtgacagtgttgaccccagggatggacagaagaaggagagcagggaggaggctttttgctgagcccagatgatatagatgcctggatgtcactcagagagaggggttggtgagaggaggcccctaaataggaggggaatggaacaaagcaagatccatagatgcgagaagagaaattaatcagaacatgatccctggctccttggagtcttccagacagggcgacatgactagttaatcactcttgtggtcaaattgggcttcagtgtgcacctgcctaccttttcatcaacatgcattcacatccacttacgcactgatttttagtttagtgtcccagtagtacctaaaagtgacaaaaatcccaagctccaaatgaattacagcatgccccaaatgaaggctagggtagttagtgggtggcggctaaacagggagccagggctgtgaagccagggagggagccatctttgtttcttggaagaaaccagtttgaagtcagagatgagactggctggctaatcctgcacatcctcactggccagttgatgtcttactgcccaaatcccaccaaactttcatacaagctagtctacagctctcctcagaaattcctctgggaaaggaaaaaaataagaaattatcaatttaatttctcagtctaatgaactggtcttatacataaaaatttaaattacttttttttttatgaaagtggggaccaacatcatttatgcaaccaccactgtctccatgacaacgccttggatgtggcagctcatgtgacttcacagtcacaggcccttgaaatgaagcaaaggaaagttttagtttctcttctgtaatttattggactctagggatgctcacgatggtgctaagtggaggtgtgggggtttctttttgctgtggacagtaaatagtgagaaagtggtgaaattattccttcctgcggcagggattggaacttgctgcagagagtgcttccttgtcagcctcagagccagttgacagcttcagaggcgtggcttttgtcctcctctctgctgcacccccacccccacgctggccttcttagcctgggtctggcgcatcagggcctattagtactgatgctgggctgtgatgttcctctcctcggggagcacggcagcagaactgaacaaagtcactggtaatctgtgcttacagcctcccccctggggagaaagcctagccagctggcactctcacgctgagcacattcacttcccctggctggtcggcagcctggcaggggcccagaggctggccggctgcagggctaacctgcaccagcaccccaggcagcccagctcaggatcacacacgcattgttctctgccttccagactggacactggctgaactcacagcttggacggtgtggctcatctgcttaggccttcccagggtagctctctagaaataaaaattacgaacgctggatgaagaacaattggctggctacattgaggttaatacaggaccatttcccctgtcgtctttttcctttcccaggctctaggtcggtgacatcaggaagatttatcatgagttccgtcttctgtagttggaaaggagatggcacatctgccttgggtgatggggtggaagagtgggtggcagggatgagggtggagcaggaaacaccagtagtcctggatgtgtgtgtacttgttagaaatacctgcagggaaaaaagaagcggctggtctttggatccttgctcaggtggaccttccagcacacccattgccagatacaacttctgtcgaactaagacttccctcccatgtaccagaatcttgcataaagggagcagaggcttgagaggcccctctggggaagcaatgtctttagtcactgctctgctcacaaggtgcaggaaaagtctagatttttctcagttgactttcaggcttagaaaaaaaaaacctctagaagatttatggcttgttgttgttgttgttgttgttgttgttgttgttgttggaaaagcatttattctctttaggagccatcacacaccaacatgtatgtggcccttagttggcgtaggtagaggtcaactgtgctgctttcaccaggtatacaggtgtcctaataagagtttggggacagtgcaaaacggcagtgtgttctgttcaaattttttttttgtcttgctctgttgcccaggatagagtgctatggtgcgatcttggctcactgcaaccttcacctcccagaatcaagcgattctccacctcagcctcccgagtagctgagattacaggtgctggccaccttgccgagctcatttttatatttttcagagaggtagggttttgccatgttgcccaggctggtctcgaactccagacctcaagtgatctgcccaccctggcctcccaaattgctgggattacaggcgtgagccaccacatgcagcccagaaacttttcttttagcagagataaaggagggatttctccaaaaagacaacaaaaaaggtgcaaatgaattagcttctgtacatcttcttcagattttccctattctgttagtgagttcactgagaagtggagggaacaagaggaagaatcattgctaacatgaagccagtgctaggccttatgctaaaactcttacacaggggtcttatctccttctgacagtgcagttgggaagcatgctcaccagccccatgtggcaggtgaagcccctggctcagagcctctcagcagctaatagctaccacgtggaggctccaggatctaagcccaagtgccagcctaaagaccccacgctcttctccctggctgagtgctgaggtaccattcggctttaacagctgacggggctgatgcagctgcccggtgacaccatgtgccctgctgtgtactgcagttgccattttgcatttatagtgggattatctgatgctccaagctccacaagggcaaggtcttagtttttacatactgttgagtccccagtgcctgacactgtgctctgcacaccatatgtggtcaatacatacttggcaaatgaaaaagggaatgaacgagtggtcagggttaaaaatcaacgtatctttaaagtaagccaatgtgcttcccaaacccaaagaaattcttctcaaaatagagtgtcgaatagttttttttttttttttttgattggagaaacttgagcatgtttttaggccaagcagtaggaattattagagagggaatgatggcactattgatggaacacggtcccagaggagatctgaagtgacaagattaagagcagagaagaattttcattagcagaaacagggcacttcctccttagagaccagaggtgaagagagaaaaaaaggatccggtagtcatgggctatgtatcacttaggagtgctttcagctgcaagtaatagcttgactagcagtgcctgaaacaattaaggatttatttttttcatgtgatggtaagacagctacagctgggtgaccactgtgttgcttcagtggctcagtggggtaagggccattgtcttcaagactttcttggcctttccctcatgagatgcaccttctagcatcacatttgcattcaagtaaaagtccgtgctatccttgcagacacttacttcgcatgctgcctgctctgctgattgaggaaatggtcaagactaaatgaccactagtccctccttcaggtatgacagtggagtccaacggttagtgggatctgacctccagcgagcttatttctcctatgatgaatataagaagtttgtggccgggctcagtggctcatgcctgtaatcccagcactttgggaggccgaggtgggcggatcatgaggtcaggagatcaagaccatcctggctaacatggtgaaaccccgtttctaccaaaaatacaaaaaaattagctgggcgtggtggcgggcgcctgtagtcccagctactcaggaggctgaggcaggagaatggcatgaaccagggaggcagagcttgcagtgagctgagatcacaccactgcacaccaacctgggcgacagagcgagacactgtctcagagaaaaaaaaaagaagtttgtgagggattcctaagaaagtgaccgagggagaggaggaaggggagagttggaaaagttaaatgattcacttgtaagctactagaactttgttaagtttggggacatcatggttttgtgaaatctactttcgctgaaatttatgtccatttctttgcctccttctctctgcacaccgcctctactcagaaatttaaccatttacacacaacagaaagaattttcctcaagatcgctacttttgcccagtatttctgattgtctttctgcttcacatctccagaaaatgtattccctttaacaacttaacttggagaaggaggaaagaaacctaagcagatatgactccacctaagttttatgaggaaccttcgaaggaaactctgagaaaaatgagtctgtatctttttctccctcttagaccaggcttttgacatctaccagtgtgcacacttaccaattaacagttacgttcttattggttgagagaacaaggcattaacacgtctggtgactgctgcgctggtcccgtgagacctgtagagaggccaagtggttgccgtgggcttttgctacctctttgggcagtcactttgcctgtatgagacgaggaggccggaccctctcagctcctgacatcctctctaacctcctgtgatctggtcaccctgtgggaaagccaaggcagccctggcccctctccagcagtctctccctggagggctcggcctgttgggttttacttagctcgcagtttatgccttcattctcctctgaccctcattaaccaagaggaaaaactaattctagaaaggactccatttccccccatattgtatatttcatatccacagagcatgctgtgccctattgagaattaaactgcgatcactaacctcatctcatttgtgccaggggtcttgttcaaaagctgtttccccagcaaagcagtgccgtgggttaggaccccctcaccccacacacacatgcttggtggagtggttcccatctctttttaatgcctttggcaggggacagacagagagagagaaagagagagagagaaggaaacacagggagagagagagcaagagaaaaaaaagagaaacacaaaagaagaacaagagggaaagaaaagctctcgaacagcagccctgtgttttgttagaacattggcactgcatttatcaggattactggagggagagcagggtttgatcctcttctccactgggagagggaaaagctttattgtaccttttttaacatctcacagttagatcagaacaatacactgtgtatgtacatacacaccatacgtatgtgcctaaggatgatattctacttgggacacaccctgttttcaaagcatggctgaattttttataaaggccagatacagaaagccaccaggctctccctgggtctccctttccagcagaccttccccccctccccatccccttgccggacttggatcagcaggattcactcctgtcaaacaaattagagcatctatgaaatggggctatcgacatgtgtgacttgatctgttttaataggggcccggtgggagtttcctccctgccccactgagctttgtatccttcacggaaaggcagacggggcgcgggaggatgctgtggactttaaccctttgctgccagcaggttgcctgcctcctgcgtgcagccgcttcctttttgtgcctggccattgtctggggagtgcgtgcggcctgccatgctcttcatgcttgttatctcacaggagacaagctcaccccaggagaggaagagagagctgcgttctgaagcagatcttttgatttcctttcttccctctcctctctcaaataattagaagtgctggtcaaggtattaaaaaaaaaaaacagccaaaggggagaaaatatattgtatattttataaccctggcattttgtttttcaagaggtgttgtcgggctgccatttgacccttatgtaataattagcatttgagctgtggcagctagcaagtaggtaagggagaattgcctgtttggaggaaggatccgaccccttttaagtagaagagaagagggaatttgcctctgtcagcatttcagatgcacccccatgctatcactgtctccctggccctctgttcctgactcagttgctaatgacacaatctcccagcgcctgcctccgcccatggctcacccccacacccattcactgttcaggtacttgagtcccagccacagagctggaaggctggacagcagctaagacaagaggcagaggccttgtgcacagtcctgttgccgagaagcgcttagcaccctgccaccctccctgtaccgctctgtaggggtgcagattcccaccgagcccatggccttacctgcacctctcccttaacctgggagtgctgcgggcagaagtcaggacccgctttcttttcttgctcttctttactccttagcacatagcactggtacacctcaatttatagaacagacaccttcctgaaaaactgcatgtaaatgcaatttttgacaggtggaattttgtagctcatagatttacattgtttagagtcagtcgaaatgaagctgaaaacacaatcatattccctgtacttactggtgtaggaacctgagcacacagctcctttcgtaaagtgagaaattctccagcggagcgtgtagccgtaccctggtttacctgttcaaggagtcctatgctgaagaccacatcttatgggcatcggtgtgcagtaggcgctcagtcacaccacgctcatcactgagatgtggaaggaaaggggttggtcgggccctttgctctcctgtgctggtggccaagcccagggcttgggttgtaaaaccacaggcctgactgcttctccttgaattgtcctgaaccttgacccttagcgccctcaggtcgttgtgttgtttggattggtgatttcattaggatttctcacccttttcatttatttcatttaggcccgaggcagaacttctgggagctagctgatcatctgtcttttaattttcctttagggagaagaactccactgggctccatttctccctctcattgcttgctggcactggctccatggcctctttgttgtgtttttgttttgtgttttgttaccgtcccctctggcaccagatcaaggggcagggagggaaactgggacgttttggaggagggttgccaaagagttgttgcaggaaagaggcatggtcagaagaccagttcagcagctgagcagcgacaggagcacttccagttcctccagggcctgagctcagagcggggaggaccatgaggggccgcggtatggcggcggtggggtagggaaagagccaggagaatgaaggaagagcagcagcttatttaatttggaaaaacaagggaaaagctccagtccacatacatctcttctttcttccccttccctgatgctcatgaatagcacgtggaagggttgagtgtttctgccccacagtgtggcttctgccgggagtgggggcacacattccaggcttctgtgctgcctgggtagctccttctcctggcctttcaggtccaggattacagactcaaactgtattcactgtgggggcagggtggggggttctcccctttttttctcccatgtcctagtcatttggtcgctgcaaaatgattacaacatgcaggagatctcttgccacctgaaccatttttaaatcctctcctgagtactaagcccagttctttccaaattatttccagcaactttcgcctcatgtgtaggtttctctggattaatccccagtacaatcttttccatcctcaaaagtcacagacattttagtttttctgatttcatgtcccaccttaggtcagatctttgaggggtgggagggtaggaggtaaggaaccactcctcatgcaggatattagattgagaaacagaaacctacaaaaattcagctccacttatttttaaactgatgatcatgtctgaattagatcagagcaaaagcaaagattaaggaaaaaggcctagtacaaactatagcaaacacagtggaccagtgctgaactttgctagctgttctgggacgctacagctaggcaggcttacgttagtgcatagtcattctctttttttttttttttttttttttttttggagaaatggagtctctgtcgcccaagctggagtgcagtggtgcaatctcagctcactgcaacttccacctcctgggtttaagcagttctcctgcctcagcctcgcgagtaactgggactacaggtgtgcgtcacgacacccggctaattggtgtattttttagtagagaccctgttgggcacggtgctctcaaactcctgacttcaggtgatctgcccgcctcgtcctcccaaagtgctgggattacaggtgtgagccattgcgcctggctagcatagtcattcttaagggcatgttcagaccaagttcctctggctattcttggagcggagatgtcctggcaacttcatttctctgtcgtctcttacaaaaccccctttctccaagttctcttaaaaatgcatctttgacttatattctctcctgcctgaggggcctgccgttgtcctctgttcctggactttcacctcatcctgccgtctagacctggcatctgttttggtcagtgctctggatgttctttaagcagcacattcttgctgagcagaacacggtgttcagccaggttccatagctcccgtcatccccaccgttgctacccaggcccttggttgtcctgcactcccgctaacccccagactttcttagaatcaaaacttcctccagttggatcactgggcttctattccataactccttcatttcctcttgccaagaatgttctttagcaatccgaagttatatttgttattaaatataagacttaaaaaaggcttgtatttttcccctgaaatcagctttaatgaattatgacaaaacttaactcatattgctaaacattatatgtaatgggtgtgctctttcaacttagggaaaaatggatccagaactgttggcagcctttacacgtctttcatcggcctttttctttgtggaccaaaagaaagggccaaacttagccaaaaccattggccgctgatactcttgtgaagactgtgttttattaccactgcaagagttgggggttggccaaaatgatacccagacatttcagatcttaatcacaggtgctgaaaacagagatgtgtttgattctagaccattacaagtgggagttaattaccacatttcaatgaactctccgtgtgccctcctgccatagcaattagcaagagagtggccgcttgtgtgcttgatggtgttttatgaccatggattatataggaattaggaatggcttcgggaagcatttggtcctcacagttatccaataccagcatggcccaaccccagatatgtcaaagccacaactgttgcgtttggcaggcattctacaaaatgtacttggtcaatactaaatagtttcatttagcagaccagtttattcaagtgcctgacaggagtttcctggattctcacctctcctgagaggccttcaagagcatcgctgaaggtttatctacagctagggtaggttatgagtaatgtcttttatgaaactttgcaaaccaactgtcgttctgttcaattcccagaggcagatttttagggttgctgtgtccaatacagtagccactagccacctgtggctatttcagcttaatttagttaccatcaaataaaatttaaacatcagttcctcagtgacacactagccagtttcaagagtacagtggtcactcttgtcacagtggttattgtatcagacgatacagaacatgttaatcatcatagaaagttctggacagtggtgctctagagtctcaacatgtcacgtgttcaggggatcactggatctaaagccattccttatgggaaatgttggctttcttgaaaatacaccagagaccagagaaggtcaccatgtggagaagaggcagccttcactctgccaagaatgctggccaggcttctctgttttatatctcatcacaatgagggccattctggccctccaaaatatggataccaacctttacgcactgtcagaaatgggccacaattcaaagtgttctctgctgtttctgatgaactgccgttctccagctcttccctgaaatggcaaggaaaagtgatgttccctcaagatctgccaagggagatactccctctctctggtaatcgtcgctgtctccttccatcaggttagactaccagggaagtacctacctgaatagcattagcgtatcttcctcactagaattatctttgatagatcatactttaatgtttataccttgggcttattgataattttaaaaaatcaatatgaagataaacttgcatgtgctgtgaaagtcattcattactaaagatgtagaccattcaggtaaagcactgcataatactcaggatgtgctggtctctctggaagaaccgtgggacctccttccaatggagaatgcaaatgatgtgacccactgttttacattttgccccatctgcccagaactccagagttcaactcagcactcatttatattgacttgattagccatggtggttagaaattggctttctctcccttaaccaggtgtttgattttctgttttagttttaataaccttattgtgtatatcttttaatttaattctccttaaattgttttctgaaagaggcgaagtataaacaaatgaatacaaattttattttcaggtccccacatttgatattttctgttttgaggtagtctctatgcaagccccaaccccaggccctggcataaatgacaggagggcccagggacctcctggcagtctcatttttctttcataccctcctgagtatctagcacactgctaaacatatgctgcttagagtgatgtaaggtagagaaacactgtgccccgcgtgggaaggcattacagaataaacttaggaaagagggtcacctctcagatttagtcagatgacaaaggcagcactggcttccctggggtgtagagataggaaagaatttgaataattatcatcattatcatcaccacattcattaaaccccatctgcacatggcactgtgtaagtccccataggtttttttctctgccagtgagagagaattttgtccagcagggaggcgaatcctgagctctccccagctcaccagtttcctcctcgggctgttccactccacagccagcagcctggctcatcactgaggttgagtccattgcctcctatgttcttgggagatctctgtggtccttggcttataatcatctttcacgttctaggactctggactttccctttacagcactcaccacagtagcaattaagaacattgatgcataatgaattagagattctcttgtagtacattttatccaactagggggtcatctctgttctctgcacccccatatctctagaaccccccattatgtgtggtatgtagccaagtgcttgatgcatattcttagcagtaaatagcaggaatgaatgaatgagtgtgtatccaatttgactttagagttatttcccgacttacagccgttgaagttgctgtttcctccacgtgttcaacctttgggattcacacaatacttgacagtcacagctctgccatgggggacatcattacacaaagcactcctcaccagtagtcagatggcacttgatagctacaggcatgtgaatattcttttactgtcaacttttgttgtgatttcacctaaaatgtgataagctccttgaggataaaggctaagtcttacttcttcgtatttctggtaaccgcttgtaccaaacacctgccaagcattgttgattgcacctatgaggaggtgagaaagtgccaggccgtcatgcccctctatacaaacatgtaacagtagactctggttcatcaggagtaaatgacatgatatgtgatagaccacgtacattcgtggctatagataggtgagtaactgtaaccatatccaattgtgagcaaaagtgttttaattggtggttttaaactaatataaaattggctaaatcatcatttttcagctttcgaatcatctgaagacctttttttattttttaatatttagtcttgttttatttatttatttttgagatggaatcttgctctgtcacctaggctggagtgcagtgatgcaatctcagctcactgcaaccttcacctcccaggttcaagcgattctcttgtctcagcctcctgagtagctgggactataggcacacactaccacacccagctaatttttgtatttttagtagagatggggtttcaccatattggtcaggctggtctcgaactcctgacatcaggtgatccacctgcctcggcctcccaaagtgctgggattacaggcgtgagccaccatgcctgctctgaagatcttttttaaagaactgatagatgtccaggtatggtggctcacacctgtgatcccagcaactcgggaggccaaggtgggaggattgcttgagcctaaaagtttgcatccagcctgggcaacatagcaagaccttgtttctaaaaaaaaaaaaaaaaaaaaaaaaaattatgtaaaaacttttttttttcttttaagtactggtaggactggatcctaccacaggaaaaaaataataatctctagggctaggtaccagacaatgaaatatattttttaaataactcactttttaaaaaatttccacttttattttagatttaggggctacatgtgcaggtttgttacatgggtatattttgtgatgctgaggtttggagtatgaatgatctcatcagccaggtactgagcgcagtacccaatagtttttcaacccttcccctcatccttccctctcgcctctcatagaccccaatgtctattgttgccatttttatgtccatgtctacccagtggttagcccccacttacaaatgacagcattcagtatttggttttctcttcctgcgttaattcacttaagataatggcctccagctgcactcgtgttgctgcaaaggacgtgattttgttgctttttctggctgcatagtattccatcgtgtatatgtattacactgtctttatccagtccaccgttgatgggcacctaggttgattctgtgtcttcactcttgtgaatagtgctgtgatgaacagctgagtgcaggtgtcctttatggtagaccatttattttcttttggatatatacccagtaatgggatttctgggtcaaatggtaattctgttttaagttctttgaaaaacctgcaaactgctttccataggcactgaactaatttaccttcccaccagcagtgtataagcattcccttttctctacagccttgccagcatctgttgtttttacttttaataatagccattctgactggtgtgagatgatagcgtattgtgattttgatttgaatttctctgttgactagtgatgttgagcattttttcatgtgttgtatgtcttcttttgaaaagtgtctgtgtgttttacccatttttaatggggttatttgttttgtgcttgttcagttgtttgagttccttatagattctggatattagacctttatcagatgcataatttgcaaatgttttctcccattctgtggattgcctcttttctctgttgatagcttcttttgctgtggagctcagatgtttttaatgtgcaaacatagttgagaactactaacccagtcttcgggtattaatcagcaccagctcattattccatctctgccaacactcaatcacaatttgctctagtttggtaactgccctcgttcagatggagcagagttggaattttacagtgtagggctggcgccagttcctgtcattctccatccaattccgagccaagtgtccagccttagcagggatcccacatgcaatggaaaaagggatgctttgttctcagaatggcttattcatttactagatgtgcatttagcatctgttatgtacacggtggaggaaaagacagttaatttctgtgctgtgcagtcaaggttgggataaacgtggtcaggatgtcatgggagcttcaaagaaaggaaacaggcccctgtgtagagtcatcaaaagagactttctgaaggtgatattaaaaccaagccctgaaagttgcatggaagcttgccgggatactctttccccgtctttcacctggctgatggaagagcatgggcacaggtatggaggtgtgcacgaaggtggctcattgatctataagtagaaatttctataaatagaaattgtggttgaagcacagggcacaagtgtggcaaagcaatgccttggaagccatgcgggcaatgttgagagacagcccaaagaggtaagcagaggccagatcaaaaaaacatgtttatttgccatggtgggacagatttaccatgaagctcttgaagcttaagctgcagggcccctggggaggggccacatgttgggctttgttccttttttaatttgcaaaactatatatatatatacatatatatatagtatatatatatatgtatatatatatatatgtatatgtatatataaattatataagcttcaggctctacaaaaacctggatctgaagcttaaggacctttactttttcctgaaggtaataggagttaatgaagaagggaagagatgtgagttttagctaggattataatttatcattgaaactgagatactttgagagtaaaagaccatgctattaatagtatacctacatccctccccctcccccccaaaaaatccagtaatcagaactttccttggcaaaaagcagtgtatgaagactttgattttagcccacttggttggtaatcttaagatgcagttacaggaggttgagactggagcagggagaccagttaggatgctgttacattcaaaggagatgatcagggccagaattaagacagcattaaagaaactgaagacaagcagttgggatcctcaggatgggaaagcacgggtaaacgggcaggagacctctgggcgccatttctgaaccgggcagctgggtagatagatggcggtgtcttcccttggcctgatggaacagggagggggtggcagacattggggggaagtggggattccagctgaatgtaaggatgtcgggaagtgcctgtggaagagccaagagaggacgagtttagtaagtactgaggttctggtggcaggttcatatccatcgcggggcagtcgggtttgctgtactgccacagatgccaaccgtctgcagatgccacttggagatggaaaccacctaatgcaagaagaggtcaggtagcagcatggatggctcagtgcaaaccaacccttctatttaaaacacagctaggccaggcatggtggctcacgcctgtaagcctagcattttgggaaaccaaggtgggaggatcacctgagctcaagagtttgagaccagcttggccaacagggtgaaacctcgtctctactaaaaatacaaaaaattagccaggcgtggtggcaggcatctgtaatctcagctactcaggaggctaaggcatgagaatctgctgaaccggggaggccaaggctgccgtgagctgagatcgtgccactgcactccagcctgggcgacaaagcgagactccatctcaaaaaaagggaagaaaaaaaaaaagcccacagctaaaagccagcccttctgtggtcatagcagccaacatacatggtagggcctgaatccatccccttgccacctcccttagcagcctgaatagaggcaggcgcgtctcagatcatggcagctggtgactgacggagcccctgattctctgagctgaccatataagctgaccctggatttacttaaagttaattttcatcatcatcagcctcgctgtctcaccagccccacctaattctaaatttacctaaggttctttttttttttcttttttaaaagctttaggtctatattttggacagaagatggtcttttagctcctgatctcatacttaaataaaaatgctctcatattctccttgatatatttgcctattggatttgtttaatgaaatatggatttataccataaatattggagtcgtgtagtccatatttcaattaatggatcatttatatgtcatgctaactttgtaattactgaaatgtaggaatagagtggattgaaatgaatttctgttcatctttccattcctgcccccatccaggcatgtctgagcagcttggatcgcaaaagggcaagatttacacatggggtttgcagaggaaaggggtagggggctcggaaaggcggcctcctctgcgtgtgccaggagagctctatattgcagtgtgctttctgggttcacctaggcagcgttacacagctgtcctcagaggagcggaaagctgggctctggctggagggcccggtcatcaatatgctgacaggccttcatcatcattttcatctcggttgtaaagcacagcctattttccctctttgccaaatctctgctccaaatgtacataactatagatttctgactgagccctgctgccaggaatcaaccagaaagcttcaccagacctctaagacagaggacaagtaaattgtgttctcggctcccgtgaacggggcctgtcactttaactggtttcttctcaggcagtgggtacagcccaggacacccttagtgaacttgccactgcccctggttttctttctctctctttcctgctcttcctctcctgcctgctgtttgctgaccagaaaaatctggctggagaggcccatgcagtgagtgaacatcacatacataattctatcagaatatatccaagggtggggaatcattgttctcggaactagctgagctgaagcccgagcagaaatactaaagtcagtcgtgcctttgagctgcctctaacagcgccctttagagacccatttcatacaaaatttgaagcctgtgtttattgcccattaaagcaacctttattttatggcaaatgttgcagtaattgccttttacgaagagcactttgtaacacacatgcacagttgaaagaaaaccactctggtattgtctatcgggacttaatggcgcaattaattttactccatctgttcctgagactttaaaggaaaatggattttttttttgagcgtactttaatgaagaagataaagcggcccggctggtgtcccacaggctcggcgcagtaagttcagattattgctcagtctgtcagaatgggctgcttccctcagcagcagccacagccagcaacccgctctggcccctcgccgcgccattcctgatgacaaactgccagccagctcccacaaaagcacgattaaaatgtcagcacaggatgacgaaggggccaagagggtcctcagagacaaactgtgttcagtgtgagttaatactttacagcagggctggggcccggcttgctgcgggctggccgggctgctggctcgccttgaagagaacaccagggcaggggctggcgactggcggcggggaagcatgtgcacatgcgtgtctgcactgctgtgtgcgtgtcgggcatgctgctctgtgcgggaagaggctcgtttcagaggaagcgtccaatgggccgttcaggttagggagttccgagactctccatgatttctgaaccgtgggggacggggtggtcgcaacctagaatgtgggctggagagcgctgtcccagtggtggccccgaggccacaggttctgtcccagatgttctcagcaccattttagcgacaagggcagctatgaaaatggcccagctgcagaaagtcattcctcacgaagaaatgggtgtgcagagaatacagtcagcaccatttatagccccatgtccccaaccttagcctttgcacggttggctgggccacagcaaggggctcagcagcaaaatatccttgaatcaatactgctgcttgacagcatctccagccccgcgcccgtgtgtgctaacttgctagggggcagggcgcactctgccgctttggcttagttctcccatgtcccttgattcagtggtgtgaccagaggggagactgcctgtggtgaaaaggacaaggagatttgcatctctggcctcctgtggagacccgatctgccgtcctggtgggcagcaggtgtgagcgcctgccattgtccctaatggttattacaagtgataagcaggacaaatgtgaagtcatctctcctgctggcaggtcagagggggctggatttagagcccctaggagactaggaaattagatggtcagtacccaccgtggaggttgtagcaactccaggctccagagatcctggacaggggtgattccagatgtagactcatacttgaaaggcatcaagagcatccattgttaggacggaggtacagcagtaattagtgcagagtgctaatagaggaacagaaggtaggaaggaggccccagcgaaaggcagccgggggattcggtttcctctaggtccagaaccgtgggctgagatttcacaaaggagaagtgagggaagccctgctggtttctcattaagccccttggcctttgctcattcttcgtgggctccaatggagggtggaccctgtggcttcttcactttgctctctgacctcttcagccccttctctgctctcttctctgcttgtcctaggactgctgtctgcaggcacagatgccccccgttgagccacgcaggtttctgtgaatctgaggttctaactccctgctgccactctctggctcccacgtcttccctgcctgacactcccctcccttccatccatcaccctcctctctcctaagagtgctctctgaatcttattgcctttttatgtctctcttgggttcttcctcctgccctctccctgagcatggttttccttttttggagcatcccacagctcatgccattaatggagtcataatagccacggttggcttttcccgagcaaacagacttctgtgggctgcagaggacacagacccccactggtggctcgaaacacccctcctgcaggcagttcacaggctggacctttaaggttcccaccagccaggccacacattggttcctccatatttgtacaaaaagatgtgagccaggagcagtaggcaaagccctctaccttggggggaaaaaaaaaagttggtctggaggataatggaaattcgcatggggcgagggctctgagagcagcatccatgccccatggggtagagggcaagacagtgactgtccgggggccttttcagggtcgcttggtgaaacacaccctatatgaatgtgttgggagaacctaaagcagaagggagagacatagagcaaaatcagagcgagggtccccccacctcttcactctggctctgggaagagactgctggaggattctccacagcacagctcactcacccatccatttgctcaccaagtacttactaagcttctctccaggtagctaaagacacagaacatgggccaggtgcagtggctcacgcctgtaagcccagcactttgggaagccgaggtaggtggtgaagtcaggagttcgagaccagcctggccaacatggtgaaacctgtctctactaaaaatacaaaaattatccgggtgtggtggtggtcatctgtaatcccagctgctcgggaggctgaggcaggagaatcacttgaaccctggaggcggaggttgcagtgagctgagatcccaccactgcactctagcctgggccacagagcaagactccgtctcaaaaaaaaaaaaaaaaaaaggacagaacacatggaatgcctgatccttgattgggccgtaggtctagattttttaaaagcttgtatataggatatttgaggggacagctggggaaatttgaatgtgaaccgtctattaaataatgcctcaattgaaatttctgggtgtggtaatgttcttactctaggaaataatacactttcctaaattttaagatggtttaggaaaaagaaatacacaaagaaacacacattcacagataaatgtggagaaatgttcatcattgtcggatgctggtgaagggtgatggctgtgtcaggattattctaggtactagatccatatcatcagcattgattctgggtactagatgtatatcatcagtgctgattctaggtactagatccatatcatcagtgctgattctaggtactagatccatatcatcagtgctgattctaggtacgagaaacatcagtgaacaaaaccagcaaaaggtccctgcccttgtggtgctcaccttctagtggtgagaagagacaaggagaattaatgagtaaaatgggatctgttggaagggggttgggagtgctggagtgggaaggcgccatttgaaataggaggacaggaggcatctccctgtgaaaggggcgtgtgagccaagacttaaagggaacaggaggctgtgcgctgcagagcactccaggcagagggagaagccagcacaaagaacctgggtatagtgtgcctggggcttttatccagaatgtcgagtgtcctgtgaattccactttccagcgatccacctttcatcccccatttgctgttcggcgggcctagccttggaaatgaccttgcatgcttgaggacaccctttggatttaagctgcacgggctggacctgtggcagccctctagagtgcatgcattcagagctgttggcctggctccgtcacctttgtgattcggtacatcattctctccacacacaagatctttcctgccccagtgtcaagggcgataaccacgatgaggagaaagcacgaggctaggaataagaccatgtgcatatggacccacatcctccatcccatctgattcagcggggtgacctcagccaaccacttggcttttcttagcctcagcgttcctcctctgtaaaatgggagtaggtgcaacttcctcccagaaaggttaagaagatgagatgaaagtgagcaaaggcagattgtgagctgcacattgcggaaactgttagctctctagacattcttggtctctgagcagcttagtgttgggggctggggttagcagacatggtccttggttgctggtctcctgctgagtaaccggagccttgaagtgagtcacagagccttataccccttcaccatctgtaaagagggagtcaccacttagtgacgtctgctgtgtcatccacctctgagagtgggattccaagaaccagagtaccgagtgccttatgaattccactctgcgaaaaaattaatagtaccttggggtctttcatgccacgttagaggttggcttctgctgcaggctagccaggcattgctcgacagggcatcttgtttgagctcctcttcatgtctgaaccacaaaggcacaagccctttcaaggacatgacattcagatgtgcctctcctgtgtgtcctctcaactttgtgacttacccccttggctgccagtgaggccttctgaacattgtgaaggcagagagggctttatagcaatcaggctactctttggaaattgtgctgccttttagtggagataggttagctcctgcaaatcctcgaggccatggtgagcagccagcccctccccacagcccgtcccaggccttgaagggcttcatctgaggacccgaaggcctgggttcctaagctctccctgagcaccatttgggcaagtcatacacagagagggagaggaaacgagttttaggagttcttagctgggttgttcccatctctaggtggcctggcagtgggaaggagagaggtgagaagagcattgtttatcaggtactgtcagaggactattcctggaaaacactgctgaatcttctagaaggggtgatttgtgttctttccatattggcaggttttcatttccctgcttaacatgactaaggactgcaggacctgtgcatgctgttaggtaactctggccccaagatggaccctaggagagactttgacacacaattgatgatgtgccaggtggatagaagtggaagtgcagagcacccaggcactttcagccaattagtctggaaatgacatccaagaggcagagaggtactggctgtgctgcctccattcgtgtgtttgcctctggagcaaaatcaggctgggctgctctctgtagggatcatgccaaggatttggcagctctctggaagaaggagtgatttggccaagtagatgtgggcctcttatgtctccggcaggtcttcagactcaaattcttaagagaccaaatgacatcttgcctaggctatcaggcagcaccattgcagagaggcatggatgaagctgtgtcacgaggagtggcccgggcaaggtgtgagatggtggcttcacttcctttcacaaactctaaggcagcatgttctccaggtgtggtccctcaccagcagcatcgccacctgggaactaaatcagaaactctgggagtggggcccagagagctgtgttgcagccagtcctctaggtgatgttggtgtgctttcagaaccactactctaagcaataccttcatattgaccactattaagacagatcacttccactgacagagtagttgcttatggcagccatggcaaggtggaaaccgtaggtatcaggagacctgcgttcaagtccccctcttatggatacattttgtgggaccttagaaaaaacacggaacttttttgagccagtttattaatttataaagtgggaataatcatacatcatctccgtggattttgtgaggattaagttaaattgatggcctacaaaaatacatttttttttttttttgagacagagtctcactctgtctcccaggctggagtgcagttgtgtgatcatagcttactgcagcctcaaactcctgggctcaagggatcctcccacctcagcctccccaagatctgagactacaggcatgcactaccatgcccaagtaattttttttttaagagatgggggtcttgctatgttgcccaggctagtcttgaactcgtggcctcaagtgatcctcccaccttagccttccaaagtgctgggattataggcgtgagccaccacacctgtccagaaagtgctttttaacttccagtattttgcatgtaagatggcattgttatgtttatcgaacacctgccagtttccaggcaaacgtgatccttatgtgttatgtcaggtaggttgtctttttatccccaattttacacaagataaaactgaggctcaggctttaaacttggtagagcaggacatttagcctggttcagcctgattccatgttggccttggagtttcactgggagtccatgttcttaaccattatgctttttaaaagttctcatcctggcttaaccatcatctgtgacactttcaaaaatactgagattgaggccactggtttgatgtggggctcggccactgagtttctttaaaaccttcctggatgtttggaatatgtagatagggttgaaaccatagtacgttgcgtatataccaccacccttccatctcagaacagatgctgcaaatccagagttacataaattcaaagtaagggacacagagctttagcaaaccatgggcagtcaataagtgcttattagatttgtgaattaagaagttttaaaatagcattcactgcaattttaataaatcagataacaggtgttcattttgggcaagtcgaagagtccaggaaactggaggaatataatgttacccacaatttgagaacccctttttgtgaggcctcaggaggtaggaagaggtaggcgttgttcttcccacattagagcaagaaaagcagccccaggaaggctcagcgatttccctaagtaggggtattttgggggttggtttttatagatggtgggcaaggggataatagtgtaaattttgtactttgagcttttgggtaaataggcagattctgaaaccattgtgttgtatctactgattactataaaggcacagatccaggctctttgttaactccctggcagactgagtgcttccaagtgcaatttccctcccctcctttctttagaaattacctcgagctgcaaagtgagttgggctcaggttggcatgcaggcattttccattccaagggacaggaagtggctgtgaatcttgtaacctgtattccttctttgagagtctatagagttggaaataaagacacagaagtctcctgagtgccctggcagtgcttccctggatgaagggtttggggagaacttctagagagccagactttcattaccgaaactccccatctttctccccaaacccaaagtagcagtgagacctgctgatcaccttcatgtaaaagaatagtaataatccccccgaatcctgtccaaaccacagaaccctgcaggttttggacgagtcccgccataaaaccactttcccatgacttcccgaacagtaaaccccagcttgggtaccagggaatggcgctttcagtttttaatggactgcagctgaagcaagttcaaaagtgcgaggattgtaaacttgagagcaactctgcagatgccgcacaccgtggcagaatgattcagggggccaaactttgcctcatcaagtcagagaattttctgcaaatgaacttttcaagaattatgccgtcgttggcattacagtattacacacatgcctgttcccgatcactcactggaacttattttgtagttaacctccataaaggactgtgcgagcgagcacaggcctgtcacacacacattatttagaagcccttattattattttattgccagtccttgacagctgaggaaaagccaagcgctttaatctttttttccctttagtttacagtgtaagagctgcatgtaagatggatttgattaatatgtaacagagatgcaattctctgtaaaatgtgctgtactttagcaccctggaaaacaaactgcatcacaatggcttaaatctcggtccattgtattatatagacatcataaataatagagagcaggcagatattgctgcaggcttcatctgcataacacatctgagctctctataatgtgttcaacttgtcacttttagtacagaagagaggtaataaagctaacagctgactaacacacatcagccctacttctacttccaggggggtgaatgctcattaagccatcttagccctgacttttaaaatccataactcttacaaatgtaaaaaagttgccgcaaaagattaagcgcataatatatgtcaaagtataatgttttatgcatctcccccaactaccactccccgctgccgccgccaccaccacaccaaaagtctggtttcttttatagccttctcactagacgaaagaaaataaaaaatctggttctcagataaaaccaaatgaaatattattttcccagcatcactaagggactaggtaattgcttttgagtttgaagcacatgagctgaccccaagaaggttgaagattgaaacctttccccctctcctctaagaccagctcaaaggaaacagggagcttgggcccaggagtttgagaccagcctgggcaacataggaacaccctatctttacccaccaataaataagccaggcaggtgtgtggtgcgtgcctgtggtctcagctactgggggggtggtgaggcaggaggattgcttaacctgggaggttgaggctgcagtgagctatgattacaccaccgcactccagcctgggtgatagagcgagaccctgtctcaaaaaaaaaaaaaaaaaaaatagggaatcagtcatccccactgggaccttgcagacaggccactagatcagtcttagctgccttaagcacgcccttacatttacttgcctcagtttccctattggaaaccagaagggagtaaacccctccattttctttctgaggggactataaggccgagttcagcactgcttgtcatttacttgcctcagtttccctatcagaagtcagaagagaggaaacccctccattccctctctgagaggactacaaggctgagttcagcactgcttgtgcaatcacagttgacagaggtttcagagtctctgttgtgctcttctgattagcagtcttgtgttttagaggaaaatttgaaaacattacggtatgtcattttctgtaatgatggctgagcctttttagggattaaggctgtcaggcagaaaagagaaaaggatgtttatactcttaactcagagcagatttaatcctatgggatgcattttggtgggctaggggagcattgtggtctctttctcggggaggctgtgatgtatacagtacacggatgtgcatgtctcatgacattcatctctttcgaaaatatactttagaacatttctcttggagctcctaagaaaaataaatggttggtggtggcccggatggtaggaagacaggttaggatgaaacaggaaatttttcttagtagttataaatctctcaaggggaaaagttagagccccaacacttgactcatttagaacaagttgaaccaacctctgaaaaataaactcacagggggaaaaaaaaaaaaaaaaaaaaaccataaaaaatcctgcatgaggtcaggggactggcatgctaggctaatagaaactggaagtcagcgcagacatcccaggatgcactagaataacatactgtttacttctgtgattagctcagaactaatggtgtgtgtgtgtgtgtgtgtgtaagtgtgtaagagaccaactgagacacaggggctttcattgataccagtggtgcttgtgggcggggattgaaagacggcttggttcccttggctaggagtgtgggcctagaacagtaacacacttttccactggtcacaatgacagtttgtttttggagaaagccatcattaaactgtgatgtgggccgtagcactgctacctcagaattctgttgctgtccaccaggcaggccctgaaagctcagctttccgttgctagagcccacgccgtcatcccttcttgcccatattcctgcagcagcttccagtctcatctcccagcctcccgggcttctgatctcccccgttccacatggcagccagtgtggccacatcatttctcacctcccaggcctgccattcaaagtcatccacagttgcttctttttctctctcattggtctaatccctcacccagcttccagccacactagtccacccggctccagccatgctggtccattagatgtttctagttatgctcagtactttcccatctgcattcaagctgttcctctggctcagaacactctttatctttgtaaattgaagtcctattcccatctttgaagagtcaccatgaaccctacccttcaggaagactcactagacccctacttgaaataggtctttcgccaggcgcggtggctcatgcctgtaatcccagcactttgggaggccaaggcaggcggatcacaaggtcaggagatcaagaccatcctggctaacacggtgaaaccccatctctactaaaaatacaaaaaaaaaatagccgggcatggcggtcagcacctgtagtcccagctactcgggagactgaggcaggagaatggcgtgaacccgggaggcagagcttgcagtgagcggagatcgcaccactgcactccagcctgggcaacagagcgagactccatctcaaaaaaaagaaaaaagaaataggtctttcataaatctgtgagctcaccagttaactaagttaactaaggtaatcaggttccttagttcagaacacactgtcatcctggatccatgggaggccgcccttagttttccccactatcctggcctgctccccaattctcagacacccagcctcatgtgcctgatatgtaaccttgtcaagtagatagtgttcttctgtgtgggtgttttgtttacataagtgatgatatgctataaatcttagttctgtttcttgtcactccacataacatttttagaatctggccttgctggtggttgcacatgtgtttgttgcttctcaataataccgaatattctatagtgcacattcccctagtatcagatagctaaggttgccctcaacttctcccatgaaattagcaccacaatcaagcacacactgtcaccataaccatccttgtaatgtgtctatttatggaattctgcaatctacctgcggtgcatgtaagttctaatttccagatgtccttgcccacacttgctgttattcacctttctagcttttgccatcttgatagtataaagtattataaggagttgaccatttttctgagtttctgatttcttgttgatttgcatttttggtataatttaactatgggtcattggctattattttggacactcaagtatcttcttcaaatctgttgcccattagctaactgtagtgaccttgatgttaagagatctttacttttgctatagtgaaacaaatacatattttggcctcacttaatgttctgggagtatctggtttaataagtctttttctatccttcgtgcacagatatcatttcacgtgttcttttattagcttcatagttttatttttcacttttaggtctttgtttcaccccataatactttgtaccatttcctagagtttgccttgaatttatttccaattgtgtcctcaaccaggtgtaaagtcttagaagaactatgttgcattctccatccaagcctcagctttgccgagccttaacctgactgacctacttccctgtgtccatactgatgacattccttccctacattctcagtggaagacatatcactcctcttgtctcaggtcaactttttgtgcatctgagtatctccttccattccatcctcctcagtgacttctcttctgtcttctaagctctctcgctgtcagcacataaacatgcgtgtcaactccccttctcgtgcatcttcctctggctccttgtctcttgaccccattcacttgtcattccttcacagcaactggctttgcctctgcccgttgatggcactgacccatcctcatagaagcttcagtcatttccacttgccaggtgaaggagtccctgcattcatcaggcccaccctgaagggcatgtgaaatgttacgaccacccttcttgatttttgattttttaaatgtttttggttttgtgatattcccgtctcctcatcttcattttgtctctctaacaattctcagatcattttcagtgattcctcagcctccacagattccaagattatgtccactctgatggctctcgccacttttgcatgacaatgatactggactatgtctccatcccaggtcttgcccttagcttcggacccatattttccatagccaacaagatggccaggtgtcttgtggacacggaacattaaaaatgtgcctaatctaggccaggcgtggtggctcacgcccgtaatcccagcactctgggaggccgaggtgggcagatcatgaagtcaagagatcgagaccatcctggccaacagggtgaaaccccgtctctactaaaaatacaaaaattagctgggcatggtggtgcgtgcctgtaatcccagctacccaggaggctgcaggaggagaatcgcttgaacctaggaggctgaggttgcagtgagctgggattacgccactgcactccagtctggcaacagagcgagactccgtctaaaaaaaataaaataaagtaaaagtgtgacaaacctaagttatctttcctcaacctctgtgtcctctgctgattttctgatttttaagtggatcctaagacaggtctctgggaatttttctagactgccttttaaatcaaagaaacaaactttattatcatgtactaattgaatgtatcatctctgatctctctctttccccaaccctgtccaaacctgttcctgtattcccatacccacaattcagccagttaccaaagccccacatcagcaagtctccccagactcttcctttgctgagtgctatgtattttacctctcaaaagactggctcagtccatccctccctttccaccaagacagcctctgctatgacgtcctggctcgccccacctaccatatctgtgctgcagtagacctggggtacggcctgagaatttgctttcctgaccagttccttggtgatgctgaggctgctggtctagacgacactttgggaactactgcttccgttgatttttcccatccatcaattggctcattcaacaagtagttattgagtaccagtgtcaagttctggaattcaacaatgaagaaaacaaggtcatctattgaaaaggttgtggagggaacaaacaaagaataaattcatctataatgtgatgtgtaagtgatacatgctaacaatggttagcatttataaatggttgaagggacggaggagtggtgatggagagggagtcgtcagggaagacttgctatttaggaaaattttgagcagatacctagagggaagagcattccaaacagagggaactgcacgttcttgtgctttaaccatcctaaaacacagtcccgactctatcacttccctcgcggggtcaacagcagccacgtttgactgccattctgcgctctccacgaactgtctcccacacccttttccacacatcgtctcgcacccagactgacctgacttctcccaggtctctctgctgacatttcacttgcctcccctggggcacttatttgtgctattcacccccacccctcctaccttccagcaaatgcccttcttgtgtgtttgcctcatgccagatcctgtaattcattcaacgtttgcttccatttccacctcctccatgaagccttccagaatcatcccctttgaaagtgccctcttcctcctcattccagaaacatttatccccagaagtgctgcataacccttgtggcatctcacccttgtatattcctcacctggcccaactctgtagtccagcaaatgcgtagtagaccttgggtgaaggatggcccagaagtgtttctcctgctccttgacctctccaagaggcgggcctctggtatttcctaaacgctggtggctttactgttgaatcagagcaaaaggagaaaggaaaggccatggcctaaaatggagtattggaatgatctctgggtttctctgtttatcccagctttctttctgtgctattaccaagataattgagttggaaatactagtagcatttccttcatcttccttcaggctcacaagcgttcttcacccaaagggagggagattaattgacttcttttatcttccattcaaatgaggctttcatgtgaatcgctcccaccctcccgccccctcagccctcccaacctcccctcattcattaggagctggacatgaaaaggagagcatctaaaactctgcagagtccctggatctccccagacccctctcttccctcattccccgccaaacatttctgacctggcatcacaacagttcacgtgagaagtgtcacggtggggcagagcagatccaaccggaagctgcaccagccactgaactctctccacaccaccagatggtctggtgctgcagcagcctttcagaattaataactctccctccagaggggcagcttcattcaggaaccgtttcacattttccagctaagtgtggttttttcccatagagttttctggccgctctgttctgggcagaccatggggcctgctcacgaaggcaagagatgtatcttgccttccctccacctttctttgcctttggcttctgacagcgcagcttttaatctggaaattatggtaacttgtatgtgcattttgagagtatatcattgctgcatttaattaacggttattagtgttagcgtactgtgctgtattctatgtcacaaatcatcaagtctcccagagcagttacagcaattaagaactccatcacaccttctgtatagtcatttggtacttttccaggtcttttcaaaactggaaattactaatcaaatcatttctgctgtgtgcctcagtatcgtttattccattcctaatgatgtgcgacttttttttctttggccgttaacagaggcatccgtgcgtctaacccatttcacaccaccgtcatgctttagcgaggcgataatgaacttgcagaaggaaatgcaggctttggttctcttttcagagcagtgtctttcctctcctgctgttgggtgattgaattttgaaactgtaaaatgcatcgacagacctacaaacctgacttgccagagccacagccatcacagttgagcttcaattcagagctcagtgcgactcctgcctgatcaatttgtcatccctctaaatggaaactaattacttcccagggaaagattgcaggcaaatatcagcctttgcatcagcagccctctgcagtgaggttaaggcagagtccatggggtttcaccagaggggccatttccctctctgcctccgtcatgtcaggaagaatttttattatttagagcagcagtgagcttgccgtcacatccactaaggtcagccgtcaagcgtgcatctcacttaataggtcacctggacggtcccaagtcaaatgtcagaggccattcaactgccaggttgcaacaaaaacaccctggcaggcttttgatggtgtttagatggggatgagccagcccgctggaggggagcccaccgcctctggccccccaaggggattctctttttctttatgcccaagaacactgccctggaagcatccccggaatgactgaatcattgccatttgtgcggcatcgaacagactgtgccgctgacagctgtaggcaagattgactccgatgcagtgccaggagatctaggccatgcaaggcggctgctcaaggcccgctctagtgcgagggccctggctcagggcagcagggctggcccagaagctggggccaggaccgggccagccagctcagaggctgttgaacaatctgatcagaggagggccttgccagttccctacctttgcccattttggatgctgttctgctctggccttgctgctcatcattccaggctggctgagcagtttcaaactcagggctgatcctgccacctctgtgtctgggctgagctgcaaggtctttagcccagcattgctcagtcttggacattctcccagcagaagtcagacaagacccaggagagaagtttgttttgttcagcagctgattggatccgctcactgttgacttgtgttccatgttggagaatgcgttctggtccccctgagctgatataaaggagcccaaactcaaatctgtgcccattccacgtttcccctctactccaggatggagagtttttcctctcattcttatccacacagcgaaaaacactagacacagtgagaaacgctggacggctctgggggccgtgggagctgggatgagcactgaacttctctaggcctcagcccacttcgctctgcaagccctgaatgtgcctggacaagatgaccggtaaaggccattccagctctctgtgctttgtagcctgagtccctgtgaggagtggtttgctttgaaacacaatataatccagaaaaaacagctatcttaacttggccagctctgcttttaagcaagaaataaagtgatggtttcttgaaaatgatgctggcctttataatgccttctcccttaatctccccacaaactgagacaaggcatcctgggtcacaccctggctcgtctcctgtgtgatgtgttttctgggacttgcactttggtaaccagaggagactgccaactgggtatcatacctgtctctcaacccctcttctgcccaccaccctctctcagcctccctattccctgaagctagcatgccagggaggcaggtggcatacgtggtacaaggactgcatgcgcacattttggaatgaaacagtggcctttctttggaactcagaccatccagtgtgctctggctaaagacaggattgtagatctaagaagtccattgtactgattagtttcatctcagtttaagccactgacctaccaagagtatccattcaggaaatgtcaccccatggcctgatgtagtggtaggagactggaaatagctgagtgatgacggcatgtacactcagcattgcttagccttgggcaggtaccgaacctttctttgcctcggtttctcatttataacatgggaataatgatagtacttacctcttcagggttctggtgagggttccatgaactaaaacacatgaagagtctagaattgttcctgtgctgtcctaggcccaggatgaatgtgagctgctgtggttacagctagtgtcatagtactccgcccccctccaccaccagactaccacagtttcctgcattctgtgatgccgtcagctcactgagtcaccttcaccaacacctttcacgcctctggacttcagctttctcatctgcagcacgagggagaggaatgggctgaggcttgccatggtgctttcagggacaggcgtgggagcatctgtggtgagtttgcagttctgtgttgtatatgtctgcaccaatgagagtttcatgatcttgaatttatacattcatatcatgaagcacaacctagtagcatgtttagatgtagaaacacgatataaaaacaaaacagaatttgttttggtttttggttttttgttttgtttcgttttgttttttgagacagtctcactttgtcacccaggctggagtgcagtggcgtaatcttggctcactgcgacctccgcctccccctttcaagcaattctcctgtctcagcctcccaagtagctgggattgcaggcatgcactaccacgctcagctaatttttttttaaatttttggtagagacagggcttcaccatgttggccaagctggtctcgaactccttacctcaaatgatctgcctgccttggcctcctaaaatgctgagattacagatatgagccaccgcgcccagccctggaaggaacctttgttaagagttcatagtaacagggtgctaaaatgagtttattaaaataatcccagtagatgaaagattaggagatctcttttgaggaaattagagagtttagatctgttttgaaattagggaatgccttttcctattgacctaagtctctgattatatatgtcaacctcagcttacggaaagaagctgacatgtcaaaataagaagaataggctggatatggtggctcatgcctgtaatcccagcactttggaggctgaggcaggtggattgctttagctcagaagtttgagacctttagattagaagtttgagacctttagattagaagtttgagaccagcctgggcaacatcacgaaaccccatggagcatgtctgtggtctcagctacttgggtgtttgaggtggaaggattactggaccgcaggaggtggaggtggcaatgagccaagatcatgcccctgcactctggcctggcagagtgagaccctgtctcaaaaaaaataaaaaagtaagatgaataaacaatggttaatagaaacataagtggtgggacatgggggtcaggatttaatctcagagtgtcccagtggtgatttattttatttatttatttatttatttatttatttatttatttattttttgagacggagtctcgcactgtcacccgggctggagtgcagtagtgcgatcttggcttgctgcagcctctgcctcctgggttcaaacgattttcttgcctcagcctcccaagcagccaggattacaggtgcccaccaccatgcccagctaattttttgtatttttagtagagatgggccttcaccatgttggccaggctggtcttgaattctggacctcgtgattcacccgcctcggtgtccaaagtgctgggattataggcgtgagccaccgcacccggccccagtggtgattttgtaggtcagcagagatgatctgtgtgccacatttccttgtagcttaacaatgggcctcaatcatgtggtgcttgggttcttagaatgtggacagccaagacattccagccacaagtaacagaacaaaatggcttcaaccatggcaggggggcgggtgtgagtagtgtttctaaatgggactggttaagtattttggggcacggattggcttctctgccattctcttagctttctcctcatgatttcaagatggccgccatagttatcagacactatttcctcaggaagccacactcacagacaggaaggaaaggtgttcttcctcacgtacctctttttatcaggaggaaattcttttctagagaccccatagcaaacttcccctcaggtttcactggccagaactgggttacataccgtctcctaaaacagtcaccgtccaagaataatgggattgccaagggtggcctgagcctcctgtaacaggggaagaccacctgcccacagcatggcgccatgcagtacctgaacaaaacctgggttcagtgaacttgagggctcttgcctgggcaaccaacagggtctgtctgggaccttaaagtcactgattctgacttagcacttaggaatcaggcatgtggtttaatctctctgaatgtcaaagaatgtgagctggtcaagagcagatctagaactagaatctcttttctcttactgtgactctcatccccactcagctttcttcctggaattatttttactttcaaatgtgtgaagtcagacatacaacaattgtgcatttcacttgaaactagtatctcgttgattgctaccaagaatgttgtttaaaattgagaagtacatacatttacctctacatatctccagtgaacttctgtgaccattaactgtcaattttatcagattcattttacacgcaaagcaaacacatctacacccttgtctcaagaagtttccaggctagatgaaaaaactgttcctgtacccatgacagttagacataaattaatagtgccaactaattgattgatgaccagagttcaaatcaggggaagaaaggatcacgttgagggcatggctgaggcccaagagaatgatttcaatggacagagaggaaggaggaggaagtccgaatgggatgaagataatgttgatagtaatgatcaacattacagttatgagcacttgctgatatgagtaatgatcaactacagttattgagcacttgctgtttgagataaagttctaagcactttacatgtcttaacttatttcatcctcacaaaagctattatgagatgggattattgtcttctcattatttccgctatatagataaggatcatgacatacaaagaagttaaataaggtacccagtgccctagagttagtaaatggtaaagctggacccaggtaatgtggcttcatagcctgccccctctctggtgctcagcctcatttactgtagcaaactcacgaaactgggaaacccagggttttgtgaggcgacttctgtacaggtgttccttaacttacattggggttacatcccgataaacccttcatacgtggaaaatattttaagtcaaaaatgcatttaatacacttaacctactgagcattgtagcttagcccagccccccttaaacacgctcaaaacacttacattagcctaccatcgggcagaatcaactaacataagcctgtttcataataaagtgttgaggatctcatgtaatttattgaatactgtactgaaagtgaaaaacaagatggttgtatgggtacctgaagtgcagtttctactgagtgcatattgctttcataccagcataaagtcgaaaaatcgtaagctgagccatcggaagttagggaccatctgtatgttgatttagctgaagggaggatttataggcaaaatagtgagataaaaggtagggaaagttttcactgaattcagaagtatttggaactggggctggtcatctggatcccagaaaacactggcaaacacacgcacagaaatgcacagaaaaagaataccccaacattgaacaccaaaggccctcagactttggcgcctccattttgaaggtgagggatgtttctatgtgtctgtaagcagtgaagacatcaccggattatgatcacatcatacattgcacacgccgtcacggttgcacgttgctctaatcccatgtatattactgtgtctatttggaaagctgcaagagccatttatttatgagtgactaagtggtagttgactgccttcaactcctcatgttttacaaagtaggaatccacagagaatagcagtaaccaatacaccaaaccaccttcattttgagatgaatactgagaagtctttcattactctgcagtataaagtgtttactaaacagaattaagccacagcataataccctgccttccttcttctctatttgattcgtcctacttaacaccagcaaaagtacttctgccattttttttttagggttagacaatttatgccatttaaagtgtaaaaatggaatttacttggcagttagagggaaaagaattgacattatctagacacaaggagttcatgggtataaagtctcagatcatcatttctgctaaagatcaagtacctaagtaaatgtaaaagactacactgagagagacatccccagttggaaaatgtgccaagtcatagaaaattgtggtagccctgaattttcaagaatggttttggccagatgtggtggcgtgcgcctgtagtctcagctactcgagaggctgaggcaggaggatcatttgaacccaggagtttgagttcagcctgggcaacatagcaagaccctgtgtcttacttttttaaaaaaagaatggttttattggtgtattttgattattgtaaactaattgtagactctaatttactcttggatattgagatctgttttgactcttggcaatggtggtgttttttggtgattggttgatgttttatctggcctgatatccagattcttttttgtaatgtacatactctttcctgatatcgtttatatgacaatcctcccctccccttatttaaatagaggtttaaaagtttaacaagcccaggtgtggtggctcatgcctataatcccagcactttgggaggtcaagagaggaggatcacttgagcccaggaattcaagaccagcctgggcaacataggaagactctatctctacaaaaaaataaaaaatcaaccaggcatggtggtacacacctgcagtcctacctactcaggaggctgagacaggaggattgctttcgaggctgcatgagctatgatcatgccactgcactccagcttgggcaatagagtgagaccttgtctcaaaaaaaaattaataaccctatctctcatacttttatattttctctttggaaacctaaccctcaatatatttcaaatgccttgtaaatggcttttgaagaatgcttcacactggatacctgggttctaatcctaattctaatacttaactgtgaacacggatgaagtatgtcagtctctgtgatccttacgccctagacttcccttccccaagtggtttgccaccattaccaattaaaatcctatacctctctgagatccagttcaaatgctacttcttgaagctctttttgatactgctttctcactttcctcaagaggccattatgtcctgtccttttgaagggcatgtttctcaaaagccaaggttgtacctttagtttcttgagagccaaggttgcatctttagtatcttcagtcatctttgcaccccagaatgtttagcacagagcttgcccatgatggctactcaaatgctgaaaggatgaatgactaaataaatcttgagatcagttgtatttttttctttaaaataactggctacagtcactggctctcaaccctggtgttgggctcatggggacattgtaatcagttgtaagcgggttgaagtgatttgttatgaatgattgttaggttttggaagtttgcaaactatgtactgtttgtataaattagaatgtttcccttcagtaatattctttaatgataatatcatcatcctgcagtgttaatacttcagtgtgacactctcccttgcattgtgatttgtcttaaatggaagaaaaaaggatggacttagagtcaggacccaggaaattgtatgttaatccacagcctatcttttctgtgccaaagcccataataagccagaaatcactgctaatggttatggaactatggaaatatgatagtcctctactactgtacgagatgtgggggccttgtcaaaatgaacattatctgtcaatttagagaaaagaataaccattactctaaaccaggggtcagcaaacttttacagtaaaggtctagatagtaaatatttgagggcttttgagggccatacagtctctgtagcaactacccaacttcgctattgtaatgcaaaaaagctattgtaatacataaatggatggacatcactatgttccaataaaactttatttacaaaaataagacggaggtcacattgggcttaatgagctgctctaagccatagagtacatgggaatgtaaaccatactgcttattttttttaattgtattaatggcatttattctacttcctttgtaatagctaaggagttcctgcaaagaaagaaaaattaggggttagtaaatttgttacttatttgcaagaatattcagtatatatttcagggttaatattctctagactttctcagcataagaaatgagatgaaattctgttgatgttgtaaataccactattgaggctaattcgtgaaagaaaggtgactacggtatttgatgaagtaccttgtcttccaagaagtttgcttttgtggtattatctgtggcacgttattttctgtcttggtactttctctcagtgggatatttaggctctactttcctgcttggcacttttgttaataatgactttaaaaatcctcacttctctttttaaattgctgcatggagtaatagcctctctccttgacagtcaaaaggccaagaagtgcaactatgtgaaataaacttttaaaacaaggccccaagtgcactgcaagttgacttgaaataattagtccctggagtttggacacccacaaagtatctttcggaactcggattcagaaatgtctcagtgacagcctgtggcgggaagccatcacagcagcagggcccattgctcttgggacatcccacactgtagagttactttggcagtgcctggaagcagcggcccctgcccacatggcttttccactgtctcacagccaagaaccatgacaggcccctcagaacttgggccctctccagtccttgagccagtgttcaccctcacaggaagagtgtttccctgttttatcagcaagtaacagaaaacccagatgactgcagcttacaaagtaaagacatttctctcccattacaagaagcgtggagaaagcatgttgtagaggctcagtgttgtcacagaggacctaggacccttccaccttcctatgctgccatctcagtgttgggggatgacttccctcatggatgcaagaaggttactgaaacgccaagtataatgtcactacctcatgtggcaccgtgctttacggtaagggggtgagcataaacagaggggattccaagtgctgttctgtttgagcaggggacatttttcccagaagcccctggtggttttcttcttgggacctgcttgcttgaacagcatcacctgcctctggcataggggaaagagattgccgttattggcttagaccaatcactaccttccctggcactggacacatgccacatcagggttctactggaagacaagagaaagggatggctactgggggagcagccaacccaggtctgccacacccagctgaaccccctagacagtggtcagagcaccttttgctttgaccgaggaatcccaagccttgccaagaatctatggccagtcctctgggattattgccagcagttttttctgtttgttgatcatctgcagacacctgattccctgtcagtgctttttctgtttgacaggacttcttgatgcccaccaggatcgagcttgccgagtcttttggatgttgtgtgttatccacccagccaagtctttttggggaatatttatggaaatatttatatataaataaataatatttatatttccagaggtgctctgtacctctgtctatcccttttgggggataggtaagccactttggggccctcaatcccttaacaaaaataatttcatttttcttagtaaaatcatataatgtctgcatttttcctttgcagtacagaaatacatgattggtattttttaatagattacttttctggaacagatattattttgaaaatttaaaataaatttgaagagttctcttctaccagtcttaatttcatggaatagtttaaatattatttaattccatggtctaaactattggctcttattgtctttttttttaatattatgtatataaaattaggaactcatttaagaacagcaagaattgatttaatctgtgagatgccaaatggagctaatcctgaaatactttctatctgtagagattgatagtttacaaagcactttcatacatattatttcagtactttccataactattatctgcatttgacggatgaagaaataagggtataagagctgaggtgacttggccaggatcctaccagccttcacagagttggcactggagcctgggccttcacagcctgcctctgagacactgtcctgtttctagcacttaagttccagtgtctatggcagcatgcaataggattacaggaggacatcgtagccacagataacccggccatgttacctgttcatttcaacctctgcgactaggcccagatttctcaggacatttccttccccatgagctgaattttaacatgcaaatgtcactcacatcctacaagctaaggtgtatgggtttatgctgggactaggtcatatctgtattttaaaaatcccagaacaaccccagcagtggttttagagatgaggaagagaggagacagaacaagttctgctggttaccctgctcttggacttctcaggtgcttcattaatatcatctctgatggcattttgatgccatttttctgatggcattttgcagcttgcctcaagtgtcccttctggttttctaatgtaggacaaagcccaaggatgagtggctgcggttgccagtcagcattctctgcagatgtctttggtgtgtgtagctggggttaacccgccgtcttaatgtctgcctactcggttttgcatgcaaggatacattatacaagaaaattccatcgagatcatgtacaagtaaaatcagcttattttttccgaagaggcaggggagctacttcttagcagagtgagctgtagagtctctctggaatgcaaaacacagacctttgtattagaagtgaaatatttagatagggatcattatggagctctttttatagcaaggcaggcctgaaaaacagagagagagctgggaaaggaagcacaaaggaggtaataatatctgattagctaagcagctggataactgaaggagaatttgttaaaaacctatcaagacatcaaagctagatgtgagttgctctgttagcccaggccacttgtggagccatctctggaatattactgagcatctaatttgctgctattttttcccctagcgtcactccttcactaagggatctgagctgtaacctgacctgtagctgtcatcagggctttttttccatccctgtcatggcatgggatcccagtatggagaagcttagttggtattcaagtcatccgcatcgtacttgaccacgtgtgaacaagtaacctcatgtttctggggacaggcagggagaaacttgagaacttgatccccttgggggcccttggaggattgcttccaccaagccctgggttttgcaagtgactcgtttcccaatctatggcacatccaagcctctttggttttctttttccctgttcacacggatatatttgaggcaccatactctatctgcccaagaaaggaagaggggcaaggaaaaccgtgtaagtcatgcttgtttaaatattttggcttctgccaaagcagatatgagaacaattggactataatgagagttttccattggcctcaactatcctggacagttgaacgccaagcctagtttgataggtacctactatggacctggtggagctccttcttaaaattagacagtgtgtactggccagaatgtctcagcttgcagcctgaggatgattatgctgatcctggaggccctggggaactgtctagggcactaggggtgcctgtgctaacagcaaaagaccactcccccccaacaccacacttgcacatgcctcatgcacagaggaagtaggtgccaggtcttttcagagaagagcttcaaagccctgctgccacctacgagagcctttgatccatctctcggctgaatccagcccctcacggggctgatccgctttgaaaccagagccagcagcccctctacaactccctctgagttacctcacacagacaagagcacaggcttctggggggcttctttttatcttccctaaattgcgagaggtacttctttcagcgttgtcctataggattcttaagaactgccggggagatgtcttagggccaacacaaagaattgcaaacaacagcccagtgtcttggaaactttctctacagtttagtacggataaaccacatgcagatagaaaataggaagaaaaggaaattcatggtaagcctgcgtattttcttatttcgggtgcgaggggagtggagaaatccgtcatggataaaatccaactttaatgacagtctgaagccctgaagcacagacatattgcagagctaatgtattattttgtttttgtttattctgcagaaatggggaaatttcattttttagtagaattacaagctccccttttactattcacaagccctaacatgcatggcatcctgagccagagagccttccgtgattttaataccagcttctttgtgaatctaaactggttttccagtccactccctggcgggccacgggggttgttggagtggtgttacacatacttagctttctttgggtgcttgaccaccgcctgttctcaggggggacaaggagccttgctgtgggcattaccagtgggaggtaggcatggacagtgaggttcggcacctgacctctgaattcccgcggcccttgcaggatatcacgcccacgactggcggtcctcagcctgaactgcgcgttggaatcacctgggaagctttaaacatactaaacctgggccctgctaaatgacacccgtattctgatataatgggtctgggtgtggcctggatattaagatttctgactttcccctcccacctaggtgattccatgtgcggtccgggctgagagccactgtcccgcagcctcatcatacagcttgcctaggttccacggctgtgtcacttcctggccatgtgaccccgggcatgttaactgagctcagcttccttgtttgtaacataggggaatcactgcaagattcattacacctatctcctagagattattgcaggggttcaagttatggacattactgggaggataccatggaccagacactgttgtgggacctggaactgttatggctgggaaaaaaagagatcagagtccctgcctttgtggcgcttctttattttctagtcatggatatggtggataaacaaacaaacttgcatatacatagtgtaatgtcaaatcgtgggcagtactgtgaagggaaaatatggccaaggggaagggtggcaagtggcaggagagagtgcatgcacataaagggcacatgcagtcccgggctgtcagaaatgcaggcaactggctgggcatggtggctcatgcctgtaatctcagcacttttgggaggccaaggcaggtggatcatttgaggtctggagttcaagaccagcctggccaacatggtgaaaccccatctctactaaaaatacaaaaattagccaggcatggtgatgcatgcctgtagtcccagctactctggaggctgaggcaggagaatcacttgaaaccaggaggcagaggttgcagtgagccaagactgcaccactgtactccagcctgagcaagagagtgagactctgtctcaaaaaaaaaaagaaaagaaaaaaaggaaagaaagaaagaaatgcaggcaactgtgcatggcatccttggcagggtctacagtgttgcagttcctaccacttcaccctgggtcaatgagatctcagtgtgatgtctttctctaaacagattatagacactccctcaagacagacctcagactctgtgcaagcccagggcccggtcgccatctgtgtgatgaatccaggcacctagctccgtgcacagcttctcaaagtgagcgtagatttggagagaagaagggataatcagatgtttcatttacccaggtacaacagatacgtattgaaggcctgcagatggcaagacctggttcaagcacaatggggcagaatatgaggaaggcccaccccttcctttgtctcttcccccacagccactacagttccttccaccagtgtcaaccaccaccgtggcagagcatttcccgtgagacaggccgcaggctacatacattatgtgcatcctgtcgtcatgtcctcaccaggggaagtagctgttggtttattcaaccccattttacatgggaaggctctggggctttgtcatgctatcgtttgttcatgtcaccccaggccacacagcagctaagttggaaagtgtttgctgttagcctgcattgttgtccttccatgagggacctaacgtgcatactaaaggcctactatgtgccagagcctggcatttcaccattaagtcactgaatccccataacactgtgcagatggaaccttctcagctttcctgaccatcccttatcttgggctagccctcatgacacatgtcacaccctgcaattaccttctttattcatttgttgacttttatttgtctttctcccctactagaacatcagcacagacagtggactgttatcattcactccagagccggcatttgaatggagattagctggcattctagatgccgcctaattacctgacaggagaaagaagaccaggacagaagcagctgaaattccaggcagaacataggttgtttcagaagaaacacaaactctccctggcggcgtctgaggccatcttcttcaggaaggtgtttcttggatgcacttcaaagcgtagggggcttcacaggtagaattaggttgcaggaatgaggggaaggtagtcccctggaaaatgtgaaaatgagggttgagatgcaggcaggaaaattcaggaggactgttgagtgaatagtcgctccctgtggcaggtgaccagggtgggaggagggtggcagtgtgaggacatcctgaaacacacacgctttggactcagatcttgctgttgtagctccgctacctgatcagtctgtgaccttgggcaacttccttagctttatctgtgaaatgggaataatagtgtcttcccttcagtgagaaccaaatgagacagtactttctgtacatcgaatgctggtgtagagcagttagaacaaatctgtagatctgtagatcgatgctggtgtagagcagttagaacaaatctgtagatctgtagatcgatgctggtgtagagcagttagaacaaatgagtctggggaggtggacccaggctgtgttgcacgagcagggcctctgcacaggcccagcactgacctcaggtttaaccttttacttgaggtacgggaatggctttttggatactgttgtttgaagaaaaaaaaaaggtcatgaataaaacttagaatactaacaaccacccagaaagccagtcccatctctgcccagtaacgccttcctttcctgcaggaaggttggaaccttccacagttccaccaggtattggcctggtggaccagattgaaagggtgagcagacaatgggggggcagacacctgaagccagagatgtgggccaggtgggggctgtcggcccttcccacaggcccaggcagctgcgctgacacagctgtccctttgaaagttggccccgagtgggaagctctgcattattctcccagcccactgcagaatgccttctgcccattgcacagtggcagcgtgctttgggcagcttgatgctggggctgcatggagggcctcagaaaagtaggtagactcgtaagacgggctttatcctggaacaggcaccaccaccctgccctttccagagccaagctatggacatgggtcctggagaggcagaaatgtcttaagggaaggaaagggaaatcctaattactacctgggaaacagtcctcatttccaaacccagcaggtgacctgcaggataatgtgtgggcagtgattcattagaagctgtaatccccagtgttcaagcgagagttgtaactgtatctagggcctgagagagagaaacgggcttcatgaattactcctctggcaccgttgcctacatacctaggcctgtagcaatttatcccaaatgaggaaataataatgtcattttcctccagcctttccctgggaggaagttctctaatagagggtaggcaggtgttaagaagaaatctttctgggccacacctcattacaagattgggataagtgagctctttttcagcttctgcctctcctgtccttgccttgtcagcagcagggttgggagttaggcacagggcatggtgggaaagaagtcttgctgggttctcagtcattgcagttggttgttttaggtaaagtaaattgatgttgtgtttcttttccctaaatattgactgttgaacctagttgtggaagaaaagatacctgtattttgctcttattacttgctattcactgctactcttcatctggaggtcactagcaatttttaaacacttatccccattttacagatagaagatagtaagttctatggaggaatgaaaggcctttttacagagtaactgaggttccatatgttgaactagaataaagtttaagctcctgaccaggtgcgatggctcacgcctgtaatcccagcactttgggaggccgaggcaggcggatcacttgaggccaggagtttgagaccagcctggccaacatgatgaaaccccgtctctactaaaaatacaaaaattagccaggcatggtggtacacacctgtaatcccagctacttggaaggctgaggcaggagaattgcttgaattctgccaggaggcagagattgcagcaagctgagatcatgcaactacactccagcctgggcaacagcgggactctgtcttttaaaaaagaaaagaaaagaataaagtgagctcctatagcaagtggagccccacaggaagaaaggcttcaatggaacggacgttgacttctcgtccatccgacagtcttatggatcttgctggttggccctgactccccttacagtgtcttagggaccccgttcttttcatctcgtggctttgccatctcgtaagcctcttactttctatatccacccaatcatggggaggaagactcagaattgacacttagcacctctgccattgccaagaactagtcatgtgaccttaactactagtgaaaggcaggggtggcccggaaatggagtccttcaccagacagttgcttacctgagacaacatgcatgtacctgtgaaatgcgtatactgtagaaggatcatgagtttggcacataattagtggataataatcactaccacgtctcagaatgagtgtcagataattagtggaccataatcactaccacatctcagaatgagtgtatttgctaatagaaatgtggttttggcttaagtcacattgtcagtggtgaatgcagcctaaaattgaactcaaatacccaggccatagttgttttctgactccaccaaggcagaaatgaaattgttgagtttgagagtaagtagatggggccagccaaagcaagatggacagaatgacattcctttactgtccttattgacaatttatggttcatgcaatagaaaagaatcttaaaagtctctctttaatatacaagaagagaaagacccctggaaacttgtcttttcatcattcgaaacctaccttatcccttcagtcaaatgcagtggtacctgtaaagctcacacacagttttgcatcaaatgattatgtggtcagccatgtaataagtggattcaaagaaacgtatatttaaggtggccacttgcccctggggtaaatggcagctgttggactctgtgggattttgtgttgttgttgaacttgtaaagtgatgaaacctcataatttctctcctcttttagttccctctctgtctgagcagctgtactgaagtttgtcaaacatgcccattagctttcacatgtaaagatggcctttttatattcaaattttagtaatatattatttaatcattaggcagtttactaagggtatatttgtggccattgttctttctgaatgcctaatcactaaaggaaaacattttggaaacaagcactttcttccagaaactgtggtttccaggagagagagtcactgggaagattgggaagccatcagtggcatggcacagagacaccatggatgctgctgctagaccagccctgacccagtagtaaggcctagccaaggacacattgaactccttgaaattgctgatatttggtcaggcacggtgccccgcgcctgtaatcccaacaccttgggaggccgagctgggaggtttgcttgaggacaggaggtcaaggccagcctgggcaacatagcaagatccccgtctctaccaaaaatataaaaaattagccaggcgtagtgatgcacacctgtagtcctagctactcaggaggctgaggcagaaggatcgcttgagcccaagaattgaaggttgtgttgagctctgattgcaccactgcactccagcctgagcgacagagagagaccctgtctcaaaagaaagagaaaaaaaaatgcttatattcaacaatttttgtccttccaaacaacaatttcatcatattcaaactaatacaaaactggcttcccaaggaggtgtttgtttataaggctacagggcaccattttcctaccacttctaacattgtcttataggaggttctctgaaatgagaaatgcagatcttttttttcttcttctcctaagacagggtctcgttctgttgcccaggttggagtgcagtggtgtgatcatggctcactatagcctcaacctcctgggcgtaagtgatcctcccgcctcagtctcctgagtagccgagactacaggcacacatcaccatgaccagctgtttatttatttatctatttatctatttatttatttatttatttatttatttttgtagaggtagaatctcactgtgttgatcagccttgtctgaagtcctgggctcaagtgatcttcccgcctcggcctcccaaagtattgggattacaggcatgagccaccacacccaggcagaaacacaaatctttagtgaggtagcattccatttagctacagaagcactcagcatgcagttgacctttaaacaactcgggtttgaaatgcatggattttagatgtggggctttttaaaccaaacttggatcaaaaatatggtattcacaggatacaaaaaccacatatacagagggctgaatttttgtatgcatgtattctgccgggccaactgtgggacttgagtatgcacagattttactatactcaagtgtcctggaaccaattcttcacatataccaagggacaactgtaatgtgaacacaaacccataaacagtgcaacattaccagctttcccaggatgcatgtggctgacagaggagtcagcatcaagaagggctccactggcggctgggggcctctgagctggagcttactgacaagtggaagatgcccagatgataaggtgccgtgacagattgtggtggtagcattgtgagctggttgacaacacagaactctggaatcagatggcctggattcaaatcctggactcaccccttattggctgtgtgagctaaggcaagttacttgccctctctgtgccccaatttcttcatctgcaaaatgggaataatgataatggcattatggtttactgaaaggattaaaagagttaatatgtttaagtacttggaacagcatccagcacgacactaagtgatatggaggtatttgctatttttatacagagcttagtggcatgaagaagttagacaagcaatgaggaattcaaggtggtgtcctggagtagaagagaaatcggttctggaagggagacttagattacaggacagacagagatttgggtgttgtttccacgactggaagaaggcgacagttggcaaatacccacctatgtagtgatgtccagcagaaactgtcctgagacccatctaactttgtcattccactatctctctgtctctgtgctttctcctgcccttcttcctgtctcaaaacctctagtccttttaattataggaaatgttcacgttttcccaccacatttttttttatatatgtctgggtgtaggaaatttctgtgcacccccaaggacacctgcagctcctctctctttgagtttggtgtatgccgggagggtagtcagaaaacagccatagccccctcctttgcaactgtttctgctatagtctttttgatggtgcaaggtgtaccctagggctgattgtgttcctgggagctggaagctgttactgcagggttaaatcagcaacaggagagcatcactcccagcaacctcagaaagaatagagaatgatgttgttgaagggagcagggagctgtgttcctagtgccgtcttcttaaaaaaaaaaaaaaaaaaagtttccttcccccctcttctctctgcctttccacaacacaccttgtactaaatacatttttcagacctgactttgtgcaaacacagtgttgttcggcaagcattaaaaggcaatttagtactcaaaggattaaaagctcatgttaaattgaagactacacttggcataaacattaaaaattgacagaacaccccgcacattaactgcaccagggcttcgtaattagcatttaaaagtaaaacatcatttccttactgtttcctacttactcatttataatgcatttattataatacagatgtgagcaagaggctttctcccatcatcagcagatgaaaaatatacctgtgctgagaaagaaactgggatttattaatccagcccaaaaagcaaaaccaataaagaaatctctcactgggctgatttgagagattcaaactaccccttggaagattgacacaaggcccccaaagaaatcgccttcacacttcttttccttttcttagcctttcactaacaaatactgggaagaaaatccaagtaagcttcagccaggcacacacttgcgtttaaaactgatcaactggcaggttaccaaaggaatgtggaaaagagcttgttggcccattgctgatgcttcttcaaaactttggtaagactgggatccaattttctaactcagggaaattctgctgacttaacacagatggctgaatttgtaaatgaggacacctgttcatgacacctttgggctcctgcttaaaatcagggtttagtttttagcattaccaaatttgtaaaatctgaatgcagtccaaatctgattttatgttcttcctccagagttaatcctaaatgtgccaccattgcggtctttggacctaattctcggccccttcttagtatggtaggtagtaattcccaaactctagcatgcatcacgatcactgggggtctccctaaaatgcacattctgcctgagcaggtccagggtggagcatgagattctgcatttcttttttcacctaggctggatggagtgcagtggcacaatctcagctcactgcagcctccacctcctgcgtccaagtggttgtcctgcctcagcctcccacgtaggtgggactttaggtgtgtgccaccacgcccaactaatttttgtacttttagtagagatgggtttcaccatgttggctaggctggtcttgaactccggacctcagatgatctgcctgcgtcagcctcccaaagtgctgggattacaggcatgagccaccgcgcccagccagattctgcatttctaaaaagctcccaggcagtgccagtgctgctggccccaggaccacatctttgagtggcaacgttgcacagaagactctcatcagttatcagtcagtggattcagctcatcaaatgtgaaagacccccaaattgccagctccctgtggtaaacccatggcaatgactaagacaaccaaacacagtgcttgccctgaatgaacttattctagaaatatctgagaccttgttatctttctcaggcctctcctactggacctcgtttgtcatgtgtgattgcgaacacctttccctgatgttatctagagatcctgacaggcatgttctgctaaaacagacctcccaggctgtccccaagtggcctcaaattccccagctggggcaccttaagtttatcacgttaggcagttaacaggacaaatataatttctgggccacaaggccagtctgggtgaacgcatgacataagggtgttaaaagtggaggggaattccgaaaatagactttactcttgtcagaatggtgccaggggctggcccagcctgtggaatgcctcagcgctagagggcttgggcagtaaggcacgcttccctggggagggtggtggtggctggggagaggagagccaggttcccaagaaagtaatttggcacctgctctatggcaatcccttacaggcgaagagagaaaaaggaggctttgggacagataggggaattttctgatacaagcagtccccttgtattttcttttcattgtcgtaatgatttgtaaaattccagaaatgtattcgtgcccctacatgacttgaaaatgccgctgtctcactaagagccatgggctaaaacacacccgaacagcggtcagaagtgaggctcgctgtctctgaggtgaggacaacagcctggattcccgagtcaggctcacatctaagcctggcagggcctggagggcggcaacgtgtggtttgcaggttcgttcattaccccagtgttttttatgggaagatgcttgggtgtgtttgtgggaacagaaccctgattttaattacatcccttctggttattcagattatagacttctaaggatcttgtttctctggctttcttctgccctacagagggacacaagggttcagcagagaaagtgcctgtgctctgtgttgacacatagaagcagagaattttagagcagaaagggacttcagtgcatttagtccagcaccctcgaattataggtgagggaactgaggctcagagagattgaaatgacctgcctaaggtcacacaagtaggattaaaacccaggtctcgtaaacctctctattttgtacatcatgctgtctgcacataattatttcttttcagatatttaataaaagtcacaatcagagttagtccatttcttgtctctcctttgagagttgaagtcatcgtgtgaatagccataattactgcattttctgtgcgtttcttatttgattcttctttggcacaagggctctgaggatgcttcagcattgtaccaggcagaaaaacgaacacaattagcagattcaaacagatgcacatcgcatctcacacaggttaatagggaatgtgcctttctaaagcgaaggagccagggttaaacagggcatggaagaattcaaagggtaaaatgaatatgattcacatacttgtagagtggccaaggagggccttattttttactcttcaacaaaacagaggtttggcgctaaaaccacaaagtaacgttcactgtaggcgcacctcaggcacaccccgtccctgctacgctacacgctgcctggtctctgtagactgttactgtctgaggacctcctctcacaaacacttatttaacaatggcactttggctttttaatattttatttgatttctgttttatggtatttttaattgaaccctgttttaattgccttttctgcacaccaagagcctaggtggggaaggaaggcttacaaatgaaatgattattgttattacttcctttctttctgcagcgtcttagtcaaattataaattgattccatccacatattagccccgatcctcatatgcatgtgtcagaaaacagaaagtgttgaataaggaggctgaaaattttcatctagctgagaataagatttgtcagcattattacagagtgaggaaaggaaattggggctaagttcttgccgtcgagttgagcagagtacttggttccgggtgacacagcccacaggtgggcaaggtttcataaactgagagctagaagtggcctagaaaagacatttagtcgctccctcgtgtccagtcatagcccagggcagacatagtttatcctgcacagccttggctgacacctccataaataaggggaccttcctttacagcttttcagagtctcaagggcagctacacagttgcccttaggataaaagaataaacaaccctcatccccttaaacttctgcccctctttacccagtgcccccgcatcctgttttttggaatttgacctatttatgcccaggcactgactgcagggttgacagtagccaccctgaaggggccttggtagggagtaacaaaacaggcggggtgcggtggctcacgcatgtagtcccagcattttgggaggccgaggcgggcggatcacttgaggtcaggagttcaagaccagcctggccaacatggtgaaatcccatctctaataaaaatacaaaaattagctaggtgtggtggcgcacgcctgtgatcccagctactcgggaggctgaggcaggataattgcttgaacctggtggggggatggggacacggaggtagcagtgagccaggattgcaccactgcactccagcctgggtgacagagcgagactccgtctcaaaaaacaaacaaacaaaaacaaacaacaaaaacccagatctggcacacacagaaatggcttctggccttattacacccgctgcctccccagctgggtattcagtgggcagccactcatagccttcataaaatgacttagatttgatgcttgaaatgaaagcttgtcaatcctgggtaaccgcttgaagaaaggaacattatcccttaaaaggatagccctagcccctagaatatctttctcaccttgggacttgctaaaatagaattccttatttcaaaggcagtaaaatgttttgagttcctactatgtgtagtatgctaggctaggcactacaggccaagcaaggcaaataaaactagcctctttccctattcccctgcatttcagaaaagacaacacatttcaaggctctgctttgcaagagaccaggcaccacagtttcctcctatcagcctgggcatggcaagtaataaccccccctatgaatgaagaggttgctgtgttcaaagaggttaataaagtgtccaagaccgtacagtgtcagtgaggcagggaagaaatctgaaagctggtccctggctaacctgtctctttgcgttgtcaacctggaaggaagtgtcagatggtttggcgcagagctctgtccttgggcctggcctgtttgcaacctttgcttaggtgaaaagtgagagtggaagacactagattggaagaagacaatcaggataccaaaaaatatcccagcagactgaggaccagaacgaaagccgtggcagtgagagtggaagggaggaaatgagcaagaggcacagggaagacagagcagcctgaggattcggtgaactgggtttggagttagggagggtgatggcctaggtaagaccactgacaatcaggaggaaatcccaatgaggtcatctgtagattgttgatttttaaagtgccaatggacaatcagtgccacactccaccaaatgagttggagatacagaagtgtaaggcaggaggagctggagtcttgggagccccctacttggaaattacagcggaagctggggaactggtgagagagagtcccccacttcctcctttctagacattgaagggatacctgaagaatctcaatattaaaggataagagaatccaaagaaggcaatattacttgagaaacaagagaataataatagtattttgtcacggaagcccagtaacaaagggagagacagtctgccacttctgcagaaagagacagaaagggccactgtgtttgttaattaggaggtcctcggccagagacctgctaagctcataaacgttaaaggccagagttactctctttgggtggaacagctccagggcagctgaatagataatagtcactgcttcctcgaaagggtaggacacatgatttctttttctttttttttctttttttgagacggaatctcactctgtcaccaggctggagtgtaatggcgcaatctcagctcgctgcaacctccacctcccaggttcaagcagttctcctgcctcagcctcccaagtagctggaactacaggtgcccgccaccacacccagctcaattttgtatttttagtagagacggggtttcaccatgttggccaggatggtctcaatctcctgacctcgtgatctgcctgcctcggcctcccaaagtgctgggattagaggtgtgagccaccatgtccggccaggacacgtgattttaaaagcaggggaagctcccatgctagtcaaaacaaccctactacagcattcatagaagaataagatagaaaatgagatgggagcttagctggtgacacagcagggcacttgcttgcttgggtcagcccagcctagaaagtcagaggtgacggcactaatcagacttcagggaaactggctggctggtaacacaaatcttctgtttacagtgaggagtataaccagcaacccaacgcgagtgacctacatgcagtagttggcccatatgccccccagggacaatccctaaggaatccaaattataatcagaaagtcacttgctgaccagggattataggaataagggacctgggcagaactgcccactctctcctgttttagtattggtgaaactctagtactgtgcagggacttttggtactcacttgtaacacttgattgtctttttttttcttttctttttttttttaagacagggtctctctttgtctcccaggctggagtgcagtggcaccatctcagctcactgcaaccttcacctccagggatcaagcgattctcatgcctcagcctcccaagtagctgggactacaggtgtgcaccaccacgcccagctgatttttattttattttattttttagtagagatagggtttcaccatgttgtccaggctggtcttgaactccaggcctcaggtaatccacctgccttggcctctcaaggtgctgggattacagatgagagccaccatgcctggccggattgtactcttttgatcctacctgtttcccagtgctggattgtgagctctctgagagcagagcctgggtcttactcatctttatatcctggtgccaagtattctgtgttggtcacagaatcatctacttctatttggaatcatctactatttctagaagaccttagtagagataatggtattagtaagtgcttctgtgtttggggtgcctactctatgcctgcaggcacattagataaagatatctttagagctaatagatgccatgaggcgtatcctacagataggatcctgagcttcagagatgacagatctcatgtaatcaagccggctttatgaggtaggaggggatctgaacctggtctgcctcactccagagcacatgctcttcccactgggccgcattacctggagtcactaaggcctgtttcacaggccccttgactgggcagctcccggctctgctccgtggatgtgctgtgtgctaaaggggcggtgggggaggggggccctgagaaaggaatgttcaggcattggttaaaataggtgtcctagcctcttgtcatgccttcatattcacaaatgttcatttctttctttctcttttttaaaaaaattcttcctagggatgatgactgacagattaatatatgtctaactacatgtctcagaaatcaaaaggaaggtgctgtcagaatcacttgtcagaaaatgagattaggcgcacttgtcatttgctgaggattgcagtctttcagagataaggtttcatttaatgagggtaaaaagcctccttttaaaaaaagaagagggagcgagggagtgagggtggggtaggcgaggagtgatgattcttttttctggtgtcagccaagtgttttatcacctaacgcgatcccgcggcacctggtagccactgataatggcaacctggccttctccacctcctctgccgctgcaccacttcaaaagcagctgcttgttacctgcttttacctctccttgaagctgaagctccttctcctgtgggaagagggagctaagcatgtactctagatttaaaagcaggctcaagaaagcatgcagtagaaaggaaacgtacagtcacatttcccaacaaactggaaagaatccacaatggatttcagtgagatatggagcctgtctgagtagtgaagggtaactaatgaggaacagagctagatcccattgcaaccaattgtgttttgttatggaaaatatttatcaagttcttttgcatttgttgattctcttacaagtgacatagtaagagctcctggcatgtgacttgatgcacctcctgcaccctgcgattcaggctggcaatttctatccctttattaagcttctctctacctcaggtgtggcctgtgctccagaagtatttcaaattaatcctcccccccctcaactccctacctccaatcgtagaaaactgcctctgaaatgaacaactttattgtggagaatgccggtgataaagcagaaaatccgtatttcagaaatgtttggtgaccaggcgcagtggctcacgcctgtaatcccagcaccttgggaggccaaggtgggtggatggcttgagatcaggagtttgagaccagcctggccaacatggtgaaaccccgtttctgctaaaattataaaaattagccaggtgtggtggtgcatgcctgtaatcccagctactcaggaggctgaggcaggagaattgcttgatgagcccaggaggtggaggttgcagtgagccaagatcgtgccactgcactccagcctgggcgacagagcaagactctgtctaaaagaaagaaaaagaaacgtttgttccagttctctactccaaaacttactggtgtaaagcagtacccttttcttctgttcctggatttggtgggtcagaaattcagacagggccaagcagagaagcagtttgtctctgctccaccatgactggtggtgacatgaatggctggggactggaatcccctggaaaagtcttcactcatgcatgaggcacttggcagggacaaaagcacctctgcaagccttgtccatgtagcatgggcttctcacagaacggcgtctgggttgtgggaggagttgccggaggggttgctaccagaaagcaagtatcccaagagcttgaggcagaagcagcgagacttctgacctggccttggaaagtcacatggagccacttctgccattgagctgaagcactgacaagcccaccaggctgaaggaaagaagatggggaccgctccatggggcagtgtcaaaggatgtgcagctgtgctttaaaatgatcatcatgctgtaaaggtttctttctacctgtgtttcttcacatctcacgaacgaaatggcctaggaatgtaaagtaaatgacatttggatggttactgacttggtataaaaggttattcctcttcattaaaaagaagaagaagaagaataagatataggccagatgtggtggctcatgcctatgatcccaacactttgggaggccaagatgggaggatcacttgaggccaggagttcgagaccagcctgggcaacatggaaaaccccatgtctaccaaaaattagcctggtggggtggtgcgtacctgtagccccaactactgaggaggctgaggtgggaagatggcttgagcccttgaggtcgaggctgcagtgagtcatgatggcatcactgcactccagtctgggcgacagagccagaccctgtctcaaaaaataaagagagagagagagagagaaaagatgtagacagagagagtgagcccaaccacattaatggcccagggagtctgaggggtggagtgtcctgttcctgctctctgttgctaatggtttaaaacagactcagacttcacttaaatgggcacctttctggccgggtgcgctggcttatgcctgtaataccagcactttgggaagccaaggcaggtggatcacttgaggtcaggagtttgagaccagcctgggcaacatggtgaaaccccatctctactaaaaatacaaaaattagccaggcgtggtggcatgcacccataatcctagctactcaggaggctgaggcagaagaatcacttgaacccaggaggtggaggttgcagtgagctgagattatgccattgcactccagcctgggcgacaagagtgagattccatctcaaaaaaaaaagttcacctttctgtttctttccagtccttctctgttacactcttcaaaaatcgtctgtacatacttgcctctatgttcttacaactttgtttagaacttaacatttaatatgtaacctagcttcaaccccattttctaacaattctcctgctattcaccagagacctcctaaatcagcgatccacctgtcttttctcagtccttctcctccagcacctctaacacatctgccatttttgagttctcctcctcctggaaatcccttcttgtcattcaactctgtctgtgactccttccccagcgcagtaaacgtggacactgtccaggtgtagtccttggttgtgttttcttttcacgccacgacattccctcatctctttgcagaagacatttgcaacttatctgcaaatccgagctctctttctgatgttccactcccaaatttctgaccgtggctaggctttcctcacggtcttctaaattcatctcgtcccaagcaaagtctctatattcccctgaaagcctccacatgcttctgtgttcctgatgttaaccagttccccagcctttacatcttagcatcgccctttgtgttgcatcactgccacacactcgtgcgttccttgaggttctgcctcctaagtgtgttttctcaccttagctttgccccgtgtctcctgccattttcctcgagtcacttttccttttttctttttgtagaggcagggtcttgctttgtctcccaggctggtctcgaacttctggcttcaagtgatcctcctgcctcggcctcccaaggttctgggattataggcatgagccactgcagcccacctcgggtgacttttcttaatgcttccctggatacctatcaggttctaccttataaaatttttataattttagtaggttctggccaggcgcggtggctgacgcctataatcccagcactttgggaggccgaggcgggtggatcacaaggtcaggagatcgagaccgtcctggctaacaccatgaaaccccgtctctactaaaaatacaaaaaattagccaggcgtggtggcgggccctgtagtcccagctacttgggaggctgaggcaggagaatggcgtgaacccgggaggcggagcttgcagtgagccgagatggtgccactgcactccagcctgggcgacagagcgagattctgcctcaaaaaaaattaataaataataataataataattttagtaggttctaccttccccacgtgtagttgtcctctctccctcctaaattataagtttcctaagggcagataacatgttttgttcttcttttttttgtacatagttcatacttagtaaaagtatccatactgaatgaatggctcttacttatactgtaaagaaataaggcatacagcggaagtgtgtatgcttaatacacatacaatacacaaactgttggatttaaggaaagattttgatgacatgaagaggctaacactgccgaacgtacttccaaatattgccttgcccctcaactctccttggagtggtactggggggagcaagacacataagcaacaataataacaagaatcataatagatatatttattgagcacttactttgcagttgatgctcttctagctaaggtaatcttcacaaccctggtcttttcaagacacactttgagagacaggtacagtatgttttccattctagagataaagaaactgacagaaaaatcaaatactactttttttattagttgggtgaatgcttagtaccaccaaacaaacctctttttgcaatccgtgctaaagcaagtaagtgccttaggctcaccaccaaagcaggccttcctttttcccttagtctaaattttattgtgggttgaccacgaagctcagagcaacttccaaggggcccctagctgagcttagtcatcaccagtcctgaaggcaacagaaggcagaagagaggcccaagtgtgtgcaggactttttaaattcaaagctgtggtttttcgaagcacagggaccctgtccactggcaaacctggcccaatcagagtcttatatgctaatactcggattggcaaccatgaggaaagctgggagagtttcctttccctcacacaaaccctaaatgagtagatgaataaatagaccctgcatggtatatgtaatcatataccaagcataatgagagacaaaggaaatgtggcaaaatgttatcaatggaggaagtcaagcaaagagtttttgggtgttattctcaccatctatcattattttttcctgttagaaatttttcaaaatacacacttaggcaaaactttaaaagacatctaaaacaaacaaaaatgagtaactgtaaaggtaggagtcaacaataaatacacgggaaaggaatctgaagccaggaacgttgtggcccatccaagggggaagtgcccagagagaagggaagaggtagaactggagacagctggtgcttcttagggagatgctcagcctgcccaagaggctaatttaaaactaaatcttatccctggatcccacagcccttaatgtgacccaaactttccattaccaaattctggggttttaaatcctgatattgtgtgcttgaatctggaatctgtctcatccattaaagatctgacctattgaggccacatgtgtctatgcaataagttcttttcaagccaaactttcatgttaaaaaaaaaaaaaaatcctgagaggaaatacatgtggtccctgtccgcttctagcccacttcaggctatttattgttttatttgattgttgagaagtcagaaatgactaaattggttctcaatgtggcctgcacatttccttggctaggaatggtctgattaaggcaaagcccaacttagaatttagcagtgttctgatctgtgtgggtttgggggaaggcatgtgtattttgttctttcgttctgaagtccttcccttgtggatttcagactaaagtgggtgtgatgacacatttacccttttggttttgtttttaaaacacaaagctgacaaatgtgtttaatggccccgtagtaccaactgacagcggcacggagcccaggaggctcacttgtaccttgactgtctcagtgaggaagctgaattttactcaccacttagaaggattaaatgcagaccatagcatacttctgacatttcattggcttatcaggaaattccatgagagtggggaggagggtggaagcagaagaggtacatacattgaatggtatatcctacttagaaattataaactctaagaaaatattaatagaaggaggaaaatatttatttttcagcacagagactattctctgtttatacattaggtaccagatcataaagaatcacagagagagagagattattcatcccaactggtgtgcattttaatggtgaagaaatagttacctgacttacccaaagtcataactagttgggactggacctgttgtaaaatccagggcttctgacctttctaatccagtacagtattcattcagcacctcatcttccctgtcatggtctacaatagccctgcaaacagtcttctaaaactcatcagagttggctgctcatgtgatccggtccaggtcggttctctaatctgcctacaggtcagttctttgaaatcatttccatgcctcctcatgcacccccaaactcagctggtcattttgcaaatgcaggttgtcagctgtgagtgagcactggtaacagaaagaaaatccatcaccacgagtgctgatggaaaaacaactgggaacgtactgcctagtagaatgttgtttgtggcccgatctttgtataagaaggaaaacatcataaattaaaagaaaagctaccagccaacaactgtatttttaccagcctcctcttcttccagaaaactcattgcgaggaaaataaatagcattctttcccagcagcacaaccgaaagtcttgttagttataggcgagtggctatttgaaagcctggctacaattttcctgttttactaacacttgtaattaaatccatcaactccctctaagattctgtgtaaataccagatgctccctacatttttttctctcctggagaatatgaaaagttgtacattagcagtagaggaacttcaaaggaggcacagacctgagtgaaagtgaagttctgaagatccacactcgcttccctgtgaatttcttagagtgttccagggagggcagcccaccacacttggccagcacaggcccatcccatctctcacccgagtggcggatgttaagttgacatccgtgccccagttcaggagcagatggctctgcgtggggcatggtggtttgggagaatccacccgggcctggcgggaatcctgttgttgagggaggagtagggccctgcctcccgctccccgagggtttgcagcccgcttttcatgtgctattgatgctgcccccacccgctgtcacttggagtcattcagtcaatcacatggagaatcagaggagaggcttgggatggctctggataaatcctccctcgctactgggggtgagaaaatcctcttcagagcacatgcactcctcagagggcatcagtgtacatatatatatatatattttttttttcttctgtatgcaaagaagagtaacttgttcccccaaggtgaaggatttcagcggtaggcaaagcaacaccactaccaccccaacccgcccactttgcttttccagaattaaacgtagttgcctagagctgtcatgacctacagagaaagctgaggaagtgttaagtgaatcatgaaagcaaatcaacagacctgctggtatttaaattttagtgtattccagtgtggatttcttggtatttgtaatgcaaaaactgggaacgggggctccacctcctctcccagcagatccaaccctatgttccaacttagtcccagcatattcgaccccatgttttgtgtgaatttactttaaagtctttcacactcccgaggccgtcagcaaagcactcatatcttatgggcaacccccagccctcttcgcttataaactaactgtccgtggctttggggttgttccctaccagttttattgggcaggttgttagctaagggattcattctagaaccagaggtttgaggcagacctctaagatcctcttgactctgagtgtgtggaggagagtgagggaaaggacagaacccatggcccgcgccacctcagcttctttcagtttctatttgaaactgaaatcacagaagagctgtcagatggcagctgtgcatttggtggaaatgagaattccagattttatgctaattcagtttcaggttcctttgaacctgcagtttatggggccgtgctgaaaactgcaatctgttttggataaaagaagggattactaaagactttttagttgtacaaacattcccagcctccaaaaggaaaggggggagaccagatttattctttcattaaaattgtcatgttaagttttcttctgctttatcaaatagaaaacttttccttattttggcaatgatttttcttatttcaagtttttttgttgttgccgtgatttattttcatttcagtagcactctttctcgaacttcaaagtccttgtcacttcctcccagaggcaggaacacaaaggtggtgcccatggatgtatctcatcctggcatgtgctcaccttcttccattctcgcagtgttgattgaggctgacccagatggttgtttcacttacctattattgctttgtaacaaaccacgaatttggagcctggaaatacaatgctgccattagggcagggctctgcagagaagcttcctctctgttccacatggcatctgctaaggcaagttcagctggagctggcggagccacacccaagatggcttcttcacgtggctggcaagttgtcaggggctgttggctgggaactcagctagccctgtggtcccaaggcctcagcttacttccatgtggtactgcttgggcatccttactatatggtaactgtgttacaagcttaaataaccagaagctgctgggcccaaactctgaatctccagcatatcacttcctcctcattctattcatcaaaacagtcacacgtcagtcacaaggacataagtttcaccttctaatgggaggcatgacatgcacatacagaattatttgggagccatatttggagatgagcaaccacaatggttaatgatatattttttagaattttgattttcaggagaatgtacccacgctctgttgttagccatatgggtttctatattctgtgaaatcccaaactgttggcaattcgtggaaaggactttgcagtttagttttatgtttgagataatgtcttcattctcttctgttttagttggcagagatctggtcatttatttatttactcattgatctgaccactgcgtatcaacccatctcttacatgtgatgcatgagaatactgtactagatgttaagggcaatggtggtgtgtaagagtacatcacagtcctggtccttgagtgattgaatctacagactgctctccaaagcagtatcttgttcccagtgaggatacgtgtgcccctaaaggaatggcagtgtccagaggtgagccgagaaacaactacatgttatatattgtcttagatctatgtttccattaggaagcattcaagaaaagctgtagtttggagcagaagaagaaatttctggtgtaattcatttgcaatacagatctgtaaatggaaattacataggaccagagaggagctggcgggtctttgtaggcacacaggcttgccctgaccctatgtaacagcggcatatgatcataataactggcatttctgtaacagttaaccatctacaaactgtgctaatttgattgataaagccccagagatggaggctattggaatggccatagtagggtttcccattccattctgatagcatggaagagacagagagaaaaactaaggccagagcaagagggaaaatcagaaaccttgctcaataagaatgctttcaggaaatcgaaactaagggaattctacgacattctagctcctcagctactaccccagcaagtgtatgattccccaaaccagtagaagcaaatattttgtcctcagccaacaagaattcctgcaagtcaatatttggaccatcaggatgcttaataataaggctagggaaaaaaaaaaaaagctttgttagatcattgtatattagcatagatgcaggagtcaaattttcagtaccctaaagattattaatactttcaggtaacgtttccaggaggagatagcaaagcctttgagtagaaggatggactaacatgcggttggccaccattctcaggatgtcagtaatctttcaaaccacaaaacctgggaaggtaaactacttgtatatcccaggaatagtcacgtgacttatagacagccttaccatgacccttcagatcttaaaacctctctagagtttagacagcagaatgattttgtcttagacatctggccagtggagggagaaactgagatttacccagcagtggggataggatggtgtggtgtggtatggtgtggcgtgatgtggtgtggtgtggcgtggcgtggcgtgttgtggcgtggtatggtgtggcgtggcatgttgtggtatggtgtgtgtggtgtggtatggtgtggcgtggtatggtgtggggtggtgtggcgtggcgtgtggtgtggtatggtgtgttgtggtatggtggggatggacagtgggagcatggtattagggaaggaatgtgacatgcctgctggcaccatgctataatcctcattccttcactgcagaggacctccttacactcctgtatccatttccttatctaaaataaggaagaaactctccgttactctctttgcctcacaagattgatgtaagagcaaacgacattataattgtagcattctggaaaaatatgtgttactctagggcatttttggcagcgtcctttggagaggctgaatcttagaaccagtaaatggcaccgtcacatataatttatggctcatgctcttttttcagtctagggttcacttcttggttggttgatttctccctcccttccatttcaaggcactgaaatgaagactagaatcatattttgagcttgactcagtcctagaatagcagcagtctttccctgggactaaccaaagctagaaatgagggtcctcagatcagatacagaaaagtagttcttggctgggtacagtggctcacacctgtaaccccagcactttgggaggctgaggtaggtggatcacttgaggtcgggagttcgagaccagcctggccaacacggtgaaatcccgcctctactaaaaatacaaaaattagccaggcatggtgatgcacccctgtagacccagcttctcaggaggctgaggcaggagaatagcctgaaccagggaggcggaggttgcagtgagcagaaatcgcaccaccacaccccagcctgagtgacagagcaagactctgtctcaaaaaaaaaaaaaaaaaaaaagaagaagaaaaaagagaaatagttctccctcagtagtcctccctcaaactgagctgaaatgataataacatatgtggtatgacttgttgaatggtaaacatggtcggagaactcccaaaaaggtagtatttctttcaatattcatattagtcattccagcatccaactgaggaacatctaaggtggtttcagggccctcttttaccctgaattgttttttaaaaaaagaaaaaactgcggagagctcagcctaaaatggctaaaatgcctcttacctagagaactggaaaacgcgatcagttcaccagcagttccccgtttcccacagtggttgtttctaacattgccacttagtgcatctgctgaaacacagatggtcgcatccctaccagcaattgcagagactcccttcccaccctcccagaagctgcacccatgcccgggagcccatggctacagctcttaatttatacatgggtgcaatgacagccactgtttgctgagcaagcccccgccccagcaccatctcccccagctcagtccttcttctttcatagtaagctcctgtctgggatcctcacctgtcaacagaccttacagcaaggctgcctttgtcaggctaccatatgtcctgtccccttaggggactgggtgcttgacaaccttcatttataaaactaagaggggctgctagaagtcagctttcctgaaactataagaatgtctactcctaggtgacttgtcactaatgatgaaggtaagttgctgttccaagtgctttacatacatgaattcatttaaccctaacaacagttgcagcaaagtaggtgatgttatggccatactttctagatgtggaaactgaggtacagagatgcaaagtcctctctccaccatcacacagtaagtgggagtggaggataagctaggatttgaacccattggttctttcatgagtggctaagcttttaaccactagaccaactacctcttagttgtccccaaacatagaaatggctggcacctgtttaaaggccctttttgttttgtttttgtttttggagacagagtcttgctgtatccccctggctggagtgcagtggcgcaatctcagcttactgcaacctcccgggttcaagcgattctcctgcctcagcctcccccgagaagctgggattataggcacctgccactatgcccggttaatttttgtacttttagtagagatggggttttaccatgttggccaggctggtctcaaactcctgacctcaggtgatctgcccacctcggtctcccaaagtgctaggaccacgcacacgtgagccactgcgccagacccgaaagcatcttttcattcattcatttatttgtttttaaatccaatcgaatttagcagtggggagttgtcttaagtgtcttcttttccgctgaacacattattttcctcaatctgtcatctctgatgactgacttacacattgtgttctacgccgatccgtcctttcagctcatgcagacattttgtatacattttcattttaattaccaccccccaactctgccccatgttcatatggaaatagaggagccaggtgttggatacatgagccggtaactaaggcaggatgcgtacctggacttagtagggtcccccagggagcatggactcaatatgaaatgcaggtcgctagaccccaagtttcaaacacccatcaatatgacatgatgtgagaaagagcaaaccaagtccagacggaaacgagacagccatgaccaggggaggcagagaggcctcacagttctcatcacatgcactgctgtaaaaagtaagatgagatacctacagccaattgggtgacacgagcagggattggatttatttgtatttttcattgcctttctttgcagggttgtcagattctgaatattaataccttaatgtagatttggtggttaagtaagatatattttatggattttttaatactttttcccctttgtagtttatagtacattgtgaagtttgaaagtaaaattcctttccttgacttctacactcggaaaatatttattcccccctgtgtctcaatggtatgcatcataaactaatccagttcagtttatttacttccctcttgttgcagatccatgatcaattgtagcaacacgggcatataatggcagaggtttttactttacagcagtacgagcatgagctattgcactctcctttcagggtgataaggaaggaagcttccattttcagaatcacccattcagaaggggttggggggcactgagcagaggaactgggggccacctgacgttgattagccctgaatcgctaaggaagacatcccaatccatagtttcaaatgaatcagcctacacagaagaaatccctgggaaccagaaagagttttaatctcctgggctgaacagtgtggaaggcagaatattaggaattagcagaggtgacaagtaggacaacctcggcctgcctcccagtggcgggcaacctgttgactccagttctccatcctaggacccttgcttgactgccatgagtaagagcagtgggcaccgaagtcaaaatgcagatccctccaggcttctcagtagctgttgtctgccctgagcattctcccaaccttatcagttacccagacacttgttgggagccctcagactaactagcatgctgggacaatttccaccgtgtcttcattcctctcatcatgggtatgttgagcaaggcctcctaactctgtgctgggtacaaattccaagatgtggacaaattctaagatgtgaattctatccacaagaaaccaggtgagttcagaaggcatggctcggggcatacaggaggatttatcatcacaaacagataataaagtgttgtctccagacacacatctgttatttatactgctgctgtggcatggacaaagacaagcaagacacagtccttggatagtcacatttaaagccaaattgaggtggtgggtcctccatacagagaaaataaacaaaaaaaacaaatcatggccgggtgcagtgactcatgcctctaatcccagcactttggaaggccaaggtgggaggatcgcttgaggccaggagtcagagatcagcatgagcaagataaagagaccctgtctctacaaaattaaaaattagcccagcgtggtggcgcatgcccatagtcccagtactcaggaggctgctgcaagatgaccccgtgagcctagtagttggaggctgcagtgagctctgattgtgccactgcactctagcctgggcaacacagcaagacgccatctcaacaaaacaaaacatgcttctgcaccagtaagacatcatttttatagtcgtaggcaaaacggtagtcctcttaaaactggaaattacaatttaacatgtctaaatgacataattgggatgctgctattttatgttttaagaaattgaagccctcactattaagagtttcatcacatcttaaggctggcaggcttttataacattttgctggattcagggtcgactttataatctaccaagaatatccatgtggctgggtgcagtggctcatgcccataatcccagcactttgggaggcagaggcaggaggatcacttgaggccacgagttcaagaccagcctgggaaacatggcaaaacaccatctctagaaaaaaatttttaaaaaattagccagatgtgttggtgcacacctgtggtcccagctactcccagctactcccaactactcaagaggctgaggtaggaggatcacttgagcccagcaggtcgaggctgtagtgagctgtgatggcaccactgcactccagcctgggtgatagagcaagaccctatctcagaaaaaagaaaaagaaacacccttattaggagacccaagctatccactgtccaggttctgaccctgtctggagggattctttgcagtaggtcctctataaagatgtcgttcccagccaggcacggtggctcatgcctgtaatcccagcactttgggaggctgaggcgggcagatcacgaggtcaggagatcaagaccatcctggctaacacagtgaaaccccgtctctactaaaaatacaaaaaattagctgggcatggtggcgggtgcctgtagtcccagctactcgggaggctgaggcaggagaatggtgtgaacccgggaggcggggcttgcagtgagccaagatcacaccactgcactccagcctaggcgacagagcaagactccgtctcaaaaaaaaaaaaaaaaaaaaaaagatgtcgttccctagtagagatggtacaaaccactgtacccactttatgggactggtgtcattttgatgttcatgtggttattttcattattgtggtgatccccactgggagaacccagtagaaggcaaggctatggccattgtggccctaataaaatagacttttattttgttggtctccacggtaatcaaaagaagtgtgtcatctgtaatcataatagacaacaaatatatcctccttactaagtgccaggcactgttactgatgaaggccccaagaggtgtggctcctgttatctcactttctagataaggaaactgaggcagggagagtgaagagatttacccaagctgtcctggctcagaaatggcagagccacaattattaacctgatgctggctccagggcccagctccaaacctctaccctgaagaacaagtagaaacttggattttcagagcttgcagaacctttagaacttgaaaagaatggagacttccatagtttcagaaataaaccaggcatggtgacatccttgccgaggctagttggagttatcaccctccttcaatcacctagtgatcttttaaaactacatcatccataacgaaaggttcgaggaaattctggtgaagacttcctcttcctttaaaccacctcaagaagcacacagcacatgcgctgttagagtgcctgaacttcattatatttaggagggggagcacaatgaaattaatgaactttctctgtataaaacgcttaacagaagactataatttgtaagaaatattttgctaaaatatatttagcttaaatctggtaatttgtgatataaattgaatcccatctcagattataatttttaagaatttgcaagtataggccagacagagtggttcatgcctgtaatcccagtactttgggaggtcaaggtgggagaatcacttgaggccaggagtttaggaccagcctggtcagtataggaagaccttgtctgtacaaaaaataaaaattagttgggcgtggtggtacacacctgtagtcccaggtacttggaaggctgaggcgggaggattgctttagcccaggagttccaggttatagtgagctatgattgtgccactgcactccagcttgggtgacaaagtgagaccttgtctcttaaataagttaataaattcataagaatttgaaagtatagattgacttacaagaatttccctttgtttttaaacctagtttaaatctttagatgtatttttgagatttgaggaagaaggctccatattttaacgtagctttacattttttttaaactgattaatcataaacttggctaagatctttgggcatatattaaaaattatttctgaaatcattaatctaacaccagagtggaaattgagtccacattcttgctctctgctttctattagaaagggttgccgctttctaagacttgttctccttagattgggttcagaggctaaaggtgatgttaagaagccattagtgtttagtatgttaatccacctccatgtaacagaaaagatagcttccagcctttgacttggcatctttatattaaaactccaataaaaggaaattaaatttctcaaggaaaaaaaaaaaaaacaatcttcctgattattgaaagccctctgacctggattcagtccctaatatatggattatcaaatttagtcttctttcttccttcttcctacttctgatgctgttgtgtacctggtcccctccaattttgacattcattcccatccccgcttccagaaagcatagggaatagagcagtttggaaaccagtcagaaatgggctcatttgtgagtctggagagaggatgagaaatggagcaggtcacagtgggtggtgttctgcaaccgggccagccaggggaccctggggagcagcactggaggtggccacagtggtcagaggcttggcttttggcgttcccaggttcctcttgatgagagatcatcaaaagatctggacacatgcagatctggctgaggccgtcatctgaggcctaatccctggtaaccattgatgacaatttttttttttttttttttgagataaagtcttactctgttgtttaggctgtagtacagtggcatggcgtgatctcggctcactgcaacctccacctcccaggttcaagcgattctcctgcctcagcctcccaagtagctggggttacaggtgtgcacctctacacattttattagtagagacggggtttcgccatgttagccaggctggtctcaaactcctgacctcaagtgatccacctgcctcggcctcccaaagtgctgggattacagacgtgagcaactgcgcccagactgatgacaatctaatgcaaggcatgataaatgtcagaagtgccacctaatgaaagcaccctggagggccaagtggtttcagctggtcagctaagctgccatgccatcgtgctctcagtttaccctgtaggggatggtgcaggagctcaggcagtttcttccctgtaacaccgattttgctagaacaacaagataagaaaactgttccattttgattgttccaaaagaaacaaccttttaatgtcttctctagaacatttcatgtccacctttgagctatcctggtattgtctaaacagcttcagaatgaatgccgcctccctggaggaccacagctgggtattgtgacatcttgtaagcaactggaaaatccatctccaaacctataccttctgagatgccttttcttttgacttctcaggaggcagtggtagagaaaaatcactgttacctatatttttaaaaagacttgtataacaccacattgtgctaccagtttgggggagggggtgatgaagctagagagagaaggcttcttatttccaaacttagaggctagaggagggggaagtatgccatacagcaagcacccccaccttttttttttttttttaacttgagaggtttttcaagagtgccatgaaatcaaatagtgatagacatgcaacttcaaagaggcaaggagtggccatcattactttaaaccagtctgcatgtcattcatatgtggtgtgcatctctcccaacccctgttctcttcctctcttcctccagccacactccaggtaacggtggcactgggaggggacttagaactgaagttttcctctcaccccaccttggtgtgcccactgtactccacaaccctaccggttgcaacctagggcttgcttgctctttttcttgtactaggaaaattgcagcagcttttcctctgcaccaaggagggaccttgtcaagctgcaggtgtggaattaaaactccagatgttttcagagggtttcctcgcccggggtgcgttctggtgggagtgggttgctcaggggaatctgctgagtgcctcatttctggccattcagtcccccacaccctctgggggcactgcactgtgctctaggggatacagacacgatacatgttaggatgatagacgtaactgctgcccatgtagcgaggctttgccattgctttcattctttccctacattcggtgaatgccaggggaagcaacaggctccacttttgtggatgcagggtgtgcacgtgtcagagggtgtgaggagctgggaggagaggatttctaagtggccagttcatgctcttaagttattcatcaaaccgagcacactgcggtcagtcggctgtggtggggaaggaggttaggtgaagacctttgtgtctgagacccagaccgtgatccccgtctccattttccacaatgcaatgattattttgtattgagcgcctactatgtgccaggccttttacatacatgactttaccactgagccctcacaaccgcccagagagcctgctctttgcagatgtgactggcttggtggcaattcaaccccaggctgcgggcctagtggcctttccctgccatggcgcaatcttggaagcggcaactgcggggagggcgaggagcggtgcagtttccgccgcgcccgcccgcaaggaaggcagccggggggagccgagggctcgagccgcggggggagcaacagctgtcgatgtcgcgcctggggaccgcgcctccgctgggccgacccggcgccggggacgagaggaggggcggcgaggggcggggcgcgcggggcgggacggaggaggggcggtggcaccggcggctcgggctcggcgcgccgaggaagtcccgctccgagagctgcgagcgtctggaggaggcgcgctcggcgcagtcggggagcgaagtccggagcaaggggcccccgcgtagccgccgccccctcctgctaccgtccagccagggagcccgcggcggccgccgatggagttcacttgagctgtgaaccggcgggagaggcaggcgcccgcaagccgagcgcgggccggagcccagccagccccgggcgctcacccgccagcccgcaagctccggccagaggcgccgccgccccgcgccccgccgttgcagcgcctcctgggccgcgcgccggcgagatccgcacaaaatccagactcccggagcggctccctccagcaccgcggcgggcccaggaccaggcagcccgcggcgcggctggagaggcgggaccggctgtcggggagccccgggcggccgccggggagaagccgccgcgcgccctcctcctcctcctccctctccctcctccctccctccgcacatggtctcctttgtcctgtcgccgccgccgccgcctcgctcttagctccgcgcgccgcggcggcggctcaggccgctcttctccgcctcgccctcccgccggccggcccgggacgcgccttgttagcccccgccgcgccagcgcggccccgcgcgccgcaggagcggcggggagacagtggcgagcgcgggccgggcgatctcggcgggcgcgctcctcccgccgcccggggcctcggccgcgctggatgtgtgcgcgcggcgccggctctcggtcgccccgaagctgttgcccggttcggatctggttcggcgcctccgctctcggactttggcgaggaaggagcccagagactcttgtggacagagccgggtcgagagttgggcgttttctcttcgtgtgttttggtggtttcccccctggtctttgacgatcgcccttcgggagccctgctaaagaaccaaaccatgaacttggggctgaccggaccgtttaaccctttgcaaccaggtaatgaagcccccggggcgcggctcgcttgcctacctctcgcggtcggaagggaggcggccggatcgggggtcttttgttgcggcggccgggccggcgggcaggggtggcaggggcgggcttctcccgtctggcgcgcccaagcgccccttcgctacccctcctcccttctttcctcccccctctgcggccctgtcgcccgcctttgtactttcctccctcggccggccgggctcggccggagctgcgcggtcgtgcccgggagggcctggcgttcgccgccaagctccgatgtgaggagggggccggggcctgcgtccgcttgagctgggggccctagcgtggcgctgcccgctcctggggtcgcgcttccccagcgcggaggtcgggatcccggcccgcacccggtgccaagggaggcgaaaggagatctgggctcgggttcggcagcgggagaaagaactcgcgcttaagtttccaggaggtttctgttttgttgttcgaaagccccccttctcgcctgtgcgggtgcggagggcggcccccggggtctgcgtccgaagggagtgagggtgggcctgaagcaggaatcgctgggtcccaccccgtctgcacgcacggctttttataagttttccttattctccgcgttcccgcctccaatctgtttcacttacttaactttcctttaaacgccaactacggcttctagcaatattttttttacatccaaaaaaacaaaaaaacatattcccccttcccttaaataaaaagcagccaaaagagagctttggttttctgtcagttttagattcaaccacttcatgcccctaccctccaaaaccgagcgaggggatgaaaggaagtgagtaaaatcttcaagtctgtagcgggtagaggtgcccccgtgttcgagagaaggaagagctcaattcgtcggctcattctgggctcgccgcttttccatttgaataataattttttttaaaaagccaggaaaatggtccaggtaatagaaggaaatgcagactattttctgaaagcaacgaaaatgataaacatccccaagattcagacccaaggaacaaatcatttgtacaaatgccctaaaaccctaagtagaaggaaagttcgttgaggaaaagcaaagggtactcgtgtcgtttcccctgaagattttggcaaagaatctctcttctgacttgttaggacagtggccggccacagttgtaaccacctggataggagagagaagggatccagaatgttttcacggtcagccagagccccattgcagtcgtcatcttttgggtgtttttctggggaggcctttctgagacaccccctttcccagttgcaagaggcatggtgtccagccctgtgacttgtatcagccaagtaagggcttagaaagcttttagtcgaagatacactcctaagcctctctgaatatccggtcagacttacttccttaataacttactgatcggcatcataataatggcatcctcaagtttggttcagacatgaggatcacgtaagtgtctgtctgagaatcccatgtggagctgacaaaggtggcagaagcaaaaggcctgttcacccacagcttctgtccttttcactcgaacacacacacacacacacacactaagtgcaaataaaaacttggtcaggaaccatttactttccctgtttatgctttttgcattcagagacagtaatttgtttttacatttcttggggccaattagagtcactttaataggtaatcccagaattttcaaaggttatgtcagtttggtaaaacactttaataaacaggcttttttttccccttctatcagttcattaattttgtaagccatgaatttaacatgaatttacattcaaaaagaattccaacccgttctaagaaacactttttcatgaaaggatggtaaaatacacatatctcgagtttttagctgggaaactcacagtcctagaaatctcacttaatatttcagtgtagcatcatcatgcaatttttggctttataactcactattcttgatctaggtatgacttgtttctctcccattaacatttttttttggcagtttgtttttatgtaaaggtactgttatatatagtttaagatgtcaggaaggccctctgtatttttcattattcctgcaaaataggaaaaaatctatctagggtttatgttaaactgcatgtataaatgtatgcacttcaatgttcgttttgcacatacattcattgtttctggattggttaatcatatggacacccccataaaagtaatgttagaattaaaataaagcaaaaaacagtcttaatacaaatattttgtctttctatatcacttgcattgagaactagaacatgtcccccagatgtacacaggaatatttcatctttgtcagtattacatggaaagactaaattgaatatcctctttgtccctaaaagctagccccagagtcaaaatatgctgcacttcagaattccccccccccatttcctatatttcctttttccatatttattcaacattctaggcttttgctttctcagaatatgcatctctgtgtatcaagtgtgaaagatgagtgatttctcatgagggttatgtagtgaaaacagcacaaatatagcttggccattataactttaaatgcagatatatcctcacgttatgtagtggagatgcttaatttttattttttcaagttctagaaatattcagtgctgaaacattacagcattttccttcaaaccgacttccatgtttattttccagaacattagtgtataatttaaattggctttagttttactgtttaaacaggcttatttcaccttcctcaagccactgtaataattagcagacatgttctctagaaaatggaaaggaaataatgctggtggcatgcatagtggtcggattttggggcaggccggcttgcatctttttgaacaccaaggtcgtttggttactgcaagggacagggatcttggagtcatcagatgaatcttaaaaaaaaattaatttctggcagtgttggcttacactttttagtgaggaaaagcttagcattaaataataggcatttctgatttgtgaaagaaaattgaaaaattggcatgtctgcaaataccacgaaaaacataacatttccaaaataatgatctgtcaacgaaattgcaaaatcattatgtgaatgagctgaattgctttgtgtatcatctcatagaaatatgttttgcacagataatgtgtctaataaggacacatttttaaaatcagatttttttccccccagcaaatagctgcactgcaggtctctctcaagcagtcaactagcaccaccttatggatgatttggggacattgctgcttccctgctaggctttcgtaaaatgtagtcaactgatttaaaataatgggaatgttgatggtgatgacaatattaatgacaataataatgcttttttcccccttcttgtttttcaggcatcagatgccagctctgaaaaactcttcaacactgttattgtaaacaaaggtaagacccattcattctcctgagtaatggcttatttttatgttagtttcattgtcattgcctaggaagaaagaagagctagagtgatctttctcttataattctgaagctactgttgatgtttcatgtttttgcttgagatggaagtctgcatactttgtgatgcattaacattaacaaccagtttattttaaaagaatacattgagtccctatttaaactgatttgactaatcactactactatgtgactttaatatagaaagctgtactcgagaagaatagttctcaaaatgcctgaactttattgttacttatcaactacccagcaataggagaaatataaatagctgatgtgcattgcagactccagtaatcaatggatgtttagaattcacagtattatggtcataaaccaagccttactctgctgtgggctttctgtaaagttaataaacgagcgagagggcagaatttaaatatgcactatcccattaatttcttccaaaccacgatctagagtaagagaggctaatgatatagcagtacattaagggaaaactaaccttaaatcattgccagtaggtttctgcgcagctttcatttgttagcagtatcgttggaaataaggaaatttaggggagtctgtaatcactggctctgaaaggtgtgtaatttgaaagggacaaaccatataaactatttaatcttcccctttccactgtcgagcctgatttaggggctggcatgataattgctaagtaaagatgtgctttctgtgataatctctttctgggttacatgggcgacacttggtagcacttgaacagacttgggccttcacaaagtgaaatttgagaccatttcagccttctgtagttgccttggctagcatttttgctagctggttagtaagacatttccaagtgcagttattttgagctcccagattattttagaatttgaaccaattgcaattttaaatagtacattatgtttagagttcccttgaggtgtatgtgattgccgttactcccagaattactgtcatattgaattttatctttttttattgcataatggagtattccagttttatatttcatcatattttctgatggactgaaagtttgtataaatgtgttatccataatgctaaaagcccaataaaagaagatgtgtgccattcatagcatacagtactcgtgtgtaaaaatgcacaattgtctaccacttggcgtttccttgtgagaaaggagggtgatgggagagggagactggggtagagggcaggtcaccaaaggcagggcttcttcgtttctgcagccccccaggacctctgccacatgtgactgtgtctgtcttctgctgatttgctactgaaagctttggaatgtatttcccctttctgggatcaggccctagaataagagttggctccaagacctgcactctggccgccactgccctgaaagattgtcttcagggcggatgaacagctcgcctctgcctcttccctctggttctttccccccctttttttccttttccaatcaaacgtttcccacattcttatttttgtttacttacagagtgtgatttgtggcatctatttggttgtgaatagccctccccctgacagggtgcctttcttctgagctgcttttctaggggtgatttagttgccttgaaaggattaaggtttctttgtgtacactaaaatcaacataggctttttctaagctttgcttgggaaaccatacacaaataagcattttagttgatggcagattattcctttgccccttatttccatcaaaatggcctttcttttctcctccagagtttccccttaatgccttatgctaattcctgttggtaacatgaatgacaagagacggaatcagtgcgaatccaggtggtgcaaagtagactgactggtatcccgcaccccctttcctccctggggagaaagagattaaggggggtgtggagggggaaagcatcggggacagttttgttaaggggattagtattcaaactgctaaatatcaggaaaacaacttcaaaaagggattcattgtgtagcgataatgtcaataattgcttcaggacaggtgcagagtctccttataggcttgtggttttgggtctgtttttactccgggtagtggcagtgtttacaggatgaatggctgacaaggccttcaaggaactgtcagcttcatgcacatcaagttcaagttttcctgcaaggcggcctgcctgcctgaaagtcaggtctcctatctttgtccagtatctttagccaagagcaataaaaagcatcataagaaagggcaaatttacaccaggtaacaaacacaactggggaaatcttcaaagccccagcttatgggacaatctaaccagagtgcaggggagctgacacgtgtatccctccacctccagatgtttaagttacacatcacttctccctctcaagagactggtagtattctggccttagaggagtgtggctttaagctgctggtgagattatgctgctgagcctggtggcaggcagatttggtccataaaatttcaccgtgggagggcagtgctaatctcacaagctgattgtggtgggggttgggggggcgcagccctgatgttgggctgcacagtgcggagatgaagctcaggcagaggcagcaggggccgtggctcgaggcccatcagtcagcttgtgagcttgaataagtcatttaccctctttaggtcaagattttcaatcataacaaaacctattccagggccaacatctctggtggggataaaacaattaattgggaaggggcaggggttgaaacagagtggatacagtgagtatattttatatcacgtttgttcatcgattttattttgactttccctgtgttatagatgccatccagtttcatagagatttttgtgtttaggtgttccgaatggtcgttttcttctcctgccttttatttcctgctttaaaacaagttaatcaaacagcacatgcttgcatgtacacacaacatgcctaatgaggactgagcatttcgaaaggggtgtggcattgagcagggcttagcgttgtagacacaaaaaaacagtttaactttaatcaaggtcatagttgccatatttaatctttatgtgtttaaatgtttacaggatgttcatgtgaattttatgaatccttctgtctttgtgattcaaccatctgccaaagaaaaaattaattttcccactgagacagaggcacagagagagacttagtaaccctatttagttgattgaaatgctataggagcaacaggacctgtaccccaaattctggggtatttattctataaaggaactttcagtctattcaacatggctagtatttattatcctctcttgcctactgtagatccttgctggtgtcaccagtttggtctgtagacaaaagtgcagaaaatgagttctttgctgcacacaattatcctgccaagataatgaatctttcctaaaactcttggattgctccagagcagagctgcttgaggaggaaagaaaagaagggaagcctgtctgggaggaaggacaacactagtcaggcgtcaggagttctgtggagccctctgtttataggatgccagtcctggcatgtggctgtggtctaggttaggggaagagaaaaatccctgaattgctctcccttcttggttcagagccctccttcccaggatttagcccgtaaccaagacaagtcacagatagacgatgacaagtcaagacaactcatagatagacggtgagaggggcacagtggtgtattttaccccgtgactttctcaccccttctctttccttcaactttgtctcaaattgcagaactgggtactcctggggaaaagcctcctgagtgagccatcggggagctgtgcccagctaaatgggcatttctgaatggtttcctccagcagggaatgaggcccctcattctgcttctttctactgtgggcacccagtgtctcctgaaatgtgaacagcaacagagcagctgctcaccctcgtaggcaggaccccacctcacctccatcagcctgggaggttctagtggatagtcactcaccaagaagagcaccagacgcaacgctctggccacctggagccctctctgaccaggactgcttttcctctcccgggccctaccaggcctattagtggaacacacccggcctcttcttggggttggttttgcactgagaatttccggtggaacacagatgaggttggagcctttaggttagtgaagcctttggatatttttggcagtatggttctatcagcattgtagaaagaagacctagcttaaaaattgcctgaaatctgaggagatgaggtaagaaacaagttacccagcgatactgctggcttagtaaccaggtacctaataaattcttccatggcgaccatatgaccttattctttaggtttagacacaagggatttccttggtttggtgacagaaaggtaagagttatattaccatcaaggtcaccatttgacttttaagaaaaacccattcccgccgagcatggtcactcatgcctgtaatcccagaacttttgggaggctgaggcaggaggattgcttgagctcaggagctcaaaaccagcctgggcaatatagcaagacctcatctctactaaaattccaaaaacctagctggggttggtagcgtgtatttgtagtctcagctacttgggagggtgaggtgagaggatcacttgggcccacaaggtcgaggctgcagtgagccctgattgtgccactatagcctgggcgacagagtgagacaccatttcaaaaaaaaaaaaaaaaaaaaaaggcctttccataaaataattctatgcatgaaaataatgcagttgactgtggaatagctctcttaagaaaaaaatttggtttacagtttaaaatccctttataatgaacatatggagaccattttacaattcctcctagggtcttgggtttagtcgcagggaggacatgatgtaaagtgcatttccgatgtgcacaagagcaaactgcccgtttcagtctctgtaaattagtttggtttttgtcatgccttaaattccacataagggagagttagaacatcactcatttatttttctccctctggaccttctttgtactatttcagagcattttcttgagtttttaggagatagagatgtctggagagttaagtagtatttaagggtaattggtacttgatgcaagagacaaaggagttatgagtagttcagtccctcctcctactccatactgcaaatagcatgcaatcagctccttttgttatggaaattgaccttcctatagaagccgactcttggagaatttgttgtatagaatcatcctttgagcgttcttggaaacagatgccttgtactgttagtgtgaaaccaccagtaacagtcaaaaaatattccatgttgcatgaaagtgtctcccgaaaattttccaatagttgctttggccgaactgatcttttgccgaacttgtgaatgcgtgtggtggtgaatcctgggatactggatcccatcactggaattgtgaaccgggtggaagattccaggcattcgaagtgatcttgatgatgccttttgggtagaacttttgacagctgccacttttccatcctgagtgcccctgtgatggaggaggcgtagattacagtgtaacccattccattcttttagtcagatgttcaaacatcactctggttacttttgagctcagtggaaagcccttgacttatactgggcgattactgctgtcctttgaaagagttttctctatccttggcaatattgaccaaaaagcttgaatgttcatcagcctctcttcaatccattcatatttagcgttttgtgtagttaatgatgtagttagtatttggttgtctcagaaagtaatatgcattcatgatagacaattggaattgaaaaatatcagatcagttctctagagtctaatgagaacagttgagtgacaaagggctcaatcacgcgggccaaccccagacaggagggttcctaaatggaggaagcccgtggctagcccgtggcctctggattatttctagtttctgacaactgcagaaaaatgttgttttctctgaatatgtatgtttatttaactaggtttctttttgcttcacaatctggattccattcagtcagttaccactccaattaactaacaattatttaacattaacagtaattacagacgccagttaagcgcctacagatgtcaactgttagctttgtacctaatcactcaatgaaatggagaaagttcaacaaacatcaattagctaagcaattagtatgagttaggaaagagcatgttatcatgtgtgagctgattcaatttattttattttggcagtaaaatacacacaggcaagcagcaataagttcctcagataagataaaactctattgttttgcggcttatataagaattccttcctttcctgtgcataagtcaaatacactctcgtctggaatttatttaacagaatttgtctcaattactcagaaagcgcagtctcaggaagcacctttggtgaattatgaatccagtgactgtactgtataaggaaatgccagaaaacttcagtggagaaaatgattgattcccactcgagtaatccgctccgtgcatttcggatttttaccagtttattcctgaacctctggtggaacgagtgcaacagtgattttattaatttcatagtgcctgaacttttactcagctgtcttttatttagcccggagctaacatcaaagtattttacctacttgcccagtctgtgcttttaaaaagtagaaacagctgtctattgaagagccatttcatgaattcaccaaggagattccagactctcctgaactcagaggtgctgttccactctcttttttcccccttcgcctcctccaccccacagacttgactcttgtcattagctgagcttgcctggacttactgggagagtgcactctgaggcctgattgtatgaagtggcccagaaagtggagattcattttacctccaagaggaaagctgggcataggagctgggcctctgggtctcctcctacaaatgacttctcatcaacccttaaagcccttggataggagtggaagaagtcaatccctcgtggggtgctctgataggtctgtgtgcatcctatgtgcagaattttccatccgaacaagcctctcagcatgaactgaatgtgggagtagggaaaaagtattctgccactggtatggcttggggtgaagggccaccttgtcccatgtgcagtttctattataaagcatttcctcgtatacaccacgaccccagtacatgctggatcttgacagatgtctgctcttctgcatcaagtcactgggtctctgtgagtctgctttgtcaaattttgctgcagtaacaaaatagctcagagtcctacaacaacaaaagtcttatgttaggtgtcatctgccaatcagccgcaggtttctttgtttttattctgggatccaggccaaaggaggagtccccatcgtggttattcggctggtaaaggggaaaagagcagagacagaaacagagaatgcctccacttggaggtgggtgtggcgtttccaaaaatctcattggccagacaaagtcacatgaccaagcctgccatcaatggagtaggaagtaaactcctacagggaggagcagaagagaagagggatccacagggatccacagggccttggaaggaagggaaagcaaaccctgcatgggtaatgctatctgccacaggcccatcccagaaacctaacaaatcaggagctgttgcctcttactgtgttaatgcaaatgggatggagggtggcttgcatagctttgatgatctccgtaggcttttctgttagagacctggttccctaatagccatttggttggagtttatattaagttagatctgataagttgtcaagaaattaaatgcttttttattgtttatctggattaacttattgctggcttggaaggacttatggaaaagttgccccagagtgcagaaatgacttcagtgatttgcaaagaataattgttggactggccagatgtttagactctgcataattaacctgaggaagcatgattgctgtaaaactttactgcaaagtagtatgcgttgtcatggttaccttgaacatgggctttggatttaagattctcacagacactgctttgaatctcagtgctttgaagacgcttactagctgtggaactttgggctagttaaaacaccttagaaccaatttttccttctgtaaaatgggaataaccaaacccatctcttacaggtgctgtgaggatgaaacgaggcaatggatagaaagtgcttagcctaccttgtaccatattttgatctaatgatacagtgggctaagtattttacatacattctatcccctaatcttcacagcagctcttaatttagaaaagaatttagaaatagcatctgcattttataggcagggaaactgaagttagatatgaatagctagcatttattgaggactttctttttgctaggtattgttcactttatatgtaattcactcattttttaagtgagtaaactgaggctcagaaatgaggcaacttgtccaaggtcgcgcacctagtaagtggtggagctcggtccagctgactcctagacatgctcatagcagtcatactgtgctaggctctggggatatggcagagaatagaaaggaggaggatctctgtccttcctgagggagacacaaagcgggatggtaaaaattcggattgggggaaactgggttctatgggaagacactggcaggaaccctcaacaagggcttccctagggcttttcctcccataccttcccaaagtatttaatcttctcataaaacataaggtcccggaggttctcatccaggacttctccaggatgtcaaccattatcccatcacctgtggccagagtcgccatagttactgcagcgcagtggggctcagcttaaggcacctccagtttcctcgctcttccatgcccattcttgtgcctttgcgtgaactgatctttacttttcagccagattttattagaaatgatttaggaatttcaagcaggggcatttccctagcaaccgatgacataagcacaaggcccaaatctgtgctgttaacagggaatggcgttctgtgggctccgatctgcgtctctgaccctcgtaaaccttgtcttctaaaggaggaggctgagagcacatcattgcttttctaagagtccttttgaagagggaaatgtctcaagtgtgcccgttaatagactgatgtgggaggcagttatatttggatgcctttaaaagccacttggaaaacattttccccctcttatctatcacctttcacatctctcagcagagtaacactaaaacctaattttagccaagattacatcattttctcattctctgttcatagctgggaaaggtttttccatagtaaagctcctctccccgaaaacccagctcctccgcaggacctcttgggcttctgtgaaggcttctttatccataaagtttagtttgacaaggggtcttctgaaagcagattggtcagctgttaaagaaatgacatcagtggtgattccattgattcgttcaattggcttaaggtggaaaccatattgaaatgaattcttttcattcacatattattgagccccaaccatggaacaggatctggaggtaacaacactgaataatagatgacacccacctgaccagaagagtaaaagagtttaaatgtattttgaaatgtttttcaagtggtataatagcaaactcactaattaaaaaaaaaaaaatagccttaagactttcttaggtggaaaagcttatctgaggtgagccccgaagggtcagcagaccaaaaattgaccagccctcaaactgcagaattatgtctcgcatttagagagccccagaatctgccagcttgtgctcatcgttagactaaaacctacccctttgagttttccattttaaaaattgatgctattgttatatgagttaattaagctattgcaaaggtttttggcagtgccataaagatctgtacatcacctatcaatacagtccacttttttcacgtttcttcagttagattttattgtttaaatacttttttttttttttttttgagaccaagtctcacctcattgcccaggctggagtgcagtggcaccatctcggctcactgcaacctctgcctcccaggttcaagcgattctcctgcctcagcctcccgagtagctgggattacaggtgcccgccaccacgcctcgctaattttttgtatttgtagtagaaatggggtttcaccatgttggccaggctggtcttgaactcctgacctcgtgatccgctcacctcggcctcccaaagcactgggattacaggcgtgagccaccgtacccggccttgttgtttaaattcttaccaggttggcccaccgcaaggaggtggcaggagggaagccccatgcccaagcctgagcaagactatttgtaaagttgagcagatcactccatttgacttgcttttctcatgggtatcatgagaaactggggggtggcctccaagactccttgtgaatctaaagaccaaagtttgtgttagaaatattctagggccagccagcacagtggctcacgcctataatcccagcactctgggaggccgaggcgggcggatcacttgaggtcaggagttggagaccagcctggccaacatggcgaaaccccatctctactaaaaatacaaaaatgaggtgggcatggtggcacacgcctgtaatcccaggtgctcgggagactgaggcacgagaatggcttgagcccaggaggtggaggttgcagtgagcggagataggcgctaccacactccagcctaggcaacagagcaagattctgtctggaaaaatatttacatatatcttttagggcctctcagaacctgacgcttctgctgagggcacacattttccctgctagctgtgaaagagattctgaacacttagcattcaaaagcagtagtgcctcgtagccgataccaggacttcagtcctgaacttgtgaacaggaataagcctctctcctcttcaggagattgcatctgtgtaagaaagatcttaaaggtaagaggggattgagccccggcacaagggaggagtggaaaagacagtggctacaatttgaataccagctgttaaggtattacggtattaacctccagaataagagtaacaatacagagtcctccttctctgcttgcctgcatcttgggtgctgttaaaagagatgatttatctgctcagtaaatgtttataaaaccccactgtatatataagtacttagggttcctttgtacttgacttctcaagtggaatgactgtcatttggaccacttcctaggcagggattgctgcaggttagatgagggtggggggcaggggcgagataccagagaaagtgcccaagagcaccccaggggcaactgccaggcagcttctttttctatgagatgactcattttaccaccacgaattgaaatgaggcttgcatgggccattgtagataatcgaaagaatgtcaccaccctcccatctgtcttcagctgtcacagactcacacaccaagcatttcatcagagttctagttcttcaagttcatctaggtctttttgactggagcaatctgacttcctacttttcttttgctagaaggtgataataattgcagcttcattcactcagtgctgcatttgctgtttgttggtttgtaattcgatgcgcagtcttcttgtgtctttgcgggagagttggttttagaggtggcacacaccaaaatcatgaatggatttaaggagggagaggctgaactaatttgattgttaccaagtccataatgtgttccttgggaaaattccacttgtctggactgtgctcctcactttctgagattgagaactggagaaaggaggaacgtcacagacaagacagcaagaagcttaaaaaacaaattcctggatttggagcagtgtgctctggtggaatattagatgataaactacactttgtggttttgttttgtgcagttggctgtagaggccacatggccctgtataatgacctcttcccaagatgttagacatcaaatcagtttgatttctacccccatgggaagaggaactccggttgtaaagaggcagcttgagaataactggtaaagggtgacttgccatttccccgctggtcttgcctcccaggagtaactgttatttgaccacatgacccagttacaacctgttacccctgtgtggccagggcctcacccccccagagcacaccttcgggtcaggctcatgcctgatttgtgccttctttccttctcagggccctccaggttgagggaagacagctttacacctccaccttctgtattagctccaggataaacttgaaaactgcctactctgagggtttttttggcattttaaaagttaagtctgactttccgagccctctcagcatcctgccaggtatcttatcttattcaaatatcctaattgcttctggggctgcacatcatcctagcacctaactgacaaaatagaccttcacctgagggcctcattatgctttctgcctgtgcatcaggccaaaaatacctccacaatacctgctcgacatcctgggcttccaagtgacaaacaaataattgggtgaaacaaaccctgggcgccgagcagctgccatcagtgtcggagcacagaagagtccacggcagtaacagtcacagcgctgcctggttcatgtcagagcaaatctttgaacagtgggttgtgctgacaccagagaatgacagctttggaaatggcatgctagttactgctgcaagtgaggcctctcatgtagaccatgacaagcggctgtcatttccatacaggtgaacaactgacatcctagaagggggagggcgggagccacgcaggaggctgtgtttggcagtaggtggggccagacttcggagaggggtcccaagtaccggtgaccctggcgaaaactagcctaaaaacacagtctctttccatgcccctttactcactccccacacatcttctctgttacctctttggagttcatctgagagagggctacagaaatacaacccaacatgcttaaaggatgtttgcattttcactctgttccctccacatcttttcttctttttctttccttttttttttgagacagggtctcactctgtcgcccaggctggagtgcagtggtgcaatctcggctcgctgcaacctccactttctggctcaagttatcctccagcctcagcctcccaagtaggctaggacttacaggcacaagccaccatgcctggctcacttttttttttttttttttttttttttttttttttgcagagacagggtttcaccacattgcccaggctgggctcgaactcctgagctcaaaatgaaccgcccacctcagcctcccaaagtgctaggattacaggcatgagccaccacgcccagtgtcctccacatcttgatatgtcagggattagctttccggtcgcaatgcttagttttatagaggatggaaaaggcaaggtttctgctgataaggaactcaccatgaaaaggaatgggttagatgaaattaagtgcagaattgggtctagaccggtggttctcaaagtctccatcagcaatatctgcatcctctgagtggttgttagccatgcagaatctctgccccaccccaaacctacagaattggaaactctggggtagagtcacaactctgttttcacaagccttccaggtagttctaatgcagacgactgtggtccagaaaaaacgaggaagaacattttggcagtgaggttttgtaaatgctcagacgatccacagagtcactgggtgaaatcatactctattgcacagggaataggtctaggttcgtagttgggcagccttttttttggaggggacagagtctcaatctgtcggccaggctggagtgcagtgtcacgatctcagctcactgcagcctccatatcctgggctcaggcagttctcctgcttcagcctcctgggttggtttgtttgtttgtaaatatcaacttcacctgatctgttcaaagtgcccctgcacctaccatttccaatccttccactctctatagccttgtgaacaggcctactcatgtttagcgtggttctgacagatgctaggcctgtacctagggctctgctcatctgaatagagtttgaaaccatgaccttgggccaatgttatgctgtaaccagctgagctaacttgctcaaccgcttctgaaagacaaactgttccatcgagttccttcttggcaggtgctgcatcaccaatgccggcctgccatctgtgtgaagggctatcacagcacacaacacacacacatactgggcaaatgtgccgtgattaccactaactattttgtaaacaaagtactgtgttaattctgttttaaactgctttatccaggattgtagaacaatgggcagaagtgttttgaaatctttttttcttctgtattgaatattagagttttaaggccataaaattaacatgtaaattgagttttcccaaaaaatgtaaaactcttaagaagtttaagtaagttacctaaatagtaaagctttttcagttgtccttcaagaataggcatcttccaaaactagttgtgttaaagtagtggttctcaaactttagcctgcatcaaaattagctagaggacttgttaagatacagcttgccggccgggcgtggtggctcacgcctgtaatcccagcactttgggaggccgaggcaggcggatcacgaggtcaggagattgagaccatcctggctaacatggtgaaaccccgtttctactaaaaatacaaagaaattagccgggcgtggtggcgggagccttgtagtcccagctactcaggaggctgaggcaggagaatggcatgaacccgggaggcagagcttgcagtgagcggagatcgcgccattgcactccagcctgggcgacagaacaagactccgtctcaaaaaaaaaaaaaagatacagcttgcggggccccacctccagtgatttctgattcagcgtgtctgggctagggctccagaacttgcatttcaagtaaccaggtgatactgatgtttccagtcccctaagagcactgtgtgatctacatgggttaaatttaaatgcctttttcaatagggaatattttcaacagggaatatcacaccactcaaaggtgtgaaatgtatctttacatgtaagatgaaattgacacatgaaagtgaattcaattttatcatgaatcgggagctttttacaaaatgaaaattttcaactctaattcaatatagaaaatgtagaaatgaacccccatatatacccattacctagattcatattaagacttttccacaattatttttaggtgataggctggatagggcgatgtccaccttttttttctttattgctgaaatattttaaagcatgtctcagacttcatatcattttacgactacatactttagtgcacatctataaaaaagaacatttcttacaaaatcacatgttgttatcacactaactaaatatgcagtaattcctcagtgtcatctgaggaatatacccatccatgatctcatctccatgattgtcccacaaggggtcattttacgtgatctgtgcacatcaggatacaaacagacacacatactgcatgtcttaaatctagagtgctccaccctccccagcttcccattctttcaagtcattgacttgttgcagaaaccaggtcagctgtcctgaagactgccccacattctggaagtccttgcggtgtcatttagcttgttcctctgtccctcgtatttcctgtaaatggaagttggccgtaaagctttgattagattcaggttagagttcctggcaagaaaacttcataggcattgcaacgaacctcatgttgcctcacatctgggaacacacagtgtctgggtgtcccagttttagtgatgtcaaaattattcagtaagtttaggttgtggcaacctgatacttgcattggcatgttccccgtcaagcttttatctcatggtctcatctattgatgatgcttgcctgatgcagtaattcattagagatggcagagggtgacttttctagcattattccacatttattggctgaaattcttcagtacaatggcactttccctcatcaactagagttctttggttacactcaaatataatacaaggaaaaaagtaaatgctcaattctctccttctaattgcatgttttcagagcaaaaagttggtgctctaccaggagtttattaataagtctgaacagttctctgcatttttcttacaataaatctaacctatgctttcagtgcattgagcttttcttacatggtttgtgtttatcaattggagggacaaaatatctaaaaattagaaaggtactgcaagaacaacatcgtcaaatgaggtcatacacacttaagtgtgtgtgaatttagtcatacctgcccttcatagctctgttcaaatgccacattctccaggaagccctcctaccttcccaaggtttgaacctttcctgtggcacttcctgcatcctgcctgtctttttttcttttcttttcttttcttttcttttcttttctttttttttaagatggtgtctcactctgtcacccagcctgtagcagtggcatgatctcagctcactgcaaccttcgcctcctggactctagtgattctcctgccttggcctcccaagtagctgggattacaggcgcatgccaccacacccagctaatttttgtatttttagtagagatgaggtttcaccatgttagccaggctggtctccaacccctgacctcaagccatccacctgccctgtcctcccaaagtgctgggatttacaggcatgagccaccatgcccactgcctgcctgtcttttattgaagttgtagatgtcctcttccccttttctctgaattctacccctatcctacccatggtgacccacagggtgctttgaattaaaatgaattaaaatataatatcctaaaagtgatttcaaactttggaatttaggttatatcctgagaatcttaagtgacttgattcaagaaagtaggcaaaaacctgaatcgtgtttggtctgatcaacccatttggaattaatcgaaaatctgatgatcccaactgggtacttttcaggaaaggagtgggaggctgcccacgtatattgagtgcctacagtgtgccagggcacctgctgatttatttgattcatacagtagcctagccaggtccgtctattacctgtgagaacactggtgactggtaagtgacagtgagttcttgccatctcctgttctttgccctttctcttataccagcccagcataaagaggatcgggggcttcagtttggtgaatttaaaaatgtctcttgttaaaggccgggcacagtggctcatgcctgtaatcccagcactttgggaggctgaggcgggtggatcacgaggtcaggagattgagaccatcctggctaacacagtgaaaccccatctctactaaatatacaaaaaattagccggatgtggtggcaggcgcctgtagtcccagctactcgggaagctgaggcaggagaatggcgtgaacccggccgggaggcagagcttgcagtgagcctagatggcgccactgcactccaacctgggtgacagagcgagactccgtctcaaaaaaaaaaaaaaaaaaaaaaaaaaaaagggaagtctcttgttcacaacacagcttctcatccagcctgacctgtttgaagtatgtctggggtggaagatcctggtgatgcaattccagcctgggaaaacttgaggagaggttcagtatagcaccatgggcggcaggctgtcagtgtgtgttagatgtattcggttacttcgttttatgggagatttcatgtgatactaagacgtaacctcccacaaaatgagatttatagaattgggtatatgtctaatcaataaacatcaaactggaaaaactgtaaaggcatttcaagtgatagtagttatggctggaaatctcagtggagttattttttttttttttttttttattactgtttaagccttgacacttttatttatttagacactgggtctcactctgtcacccagactgtggtgcagtggcacggtcatagcttactgcagccttgaactcctgggctcaagtgatcctcctgccccagccttgcgagtagctaagactatataggtgcatatatacgtgcgtgccaccacacctggctaattttttaattttctatggagacaccgtcttgctatgttgcccaggctagtctggaactcctggcctcaagtgatcctcctatcccagcctccgaagtagctggaactacaggcctgtaccaccatacccggctaactttttaaatatttttgtagagatggggtcttgctgtgttgcacaggctggtctggaactcctggcctcaggcgattaatcctctcacccctgcctcccaaagcatcgagctcctggtgcactttctaactcacccttcgaggatgtgtgtatttatatgtgtcagggagaggaaattgatctcctgaggggtgggtggaagagcacttgtccctagttaatccttttttgcctgttctttaaaaagcgtgatagataggccaacccactatgagttttctggtggcaaaagtacaagaaatccctgctatttatccactatctgtgtagcttcctctttgaagcacctcaagccctcgccagcctcttcttgtccgttgctgatctttggctctgggtgccagtcagcctcaggggcggtgctgccttttttggcagagtatcactgttaagccactttttctctttaaaaaatgctacacagaggtttttgaacctgaaatgcaattattttaaaggcatcctcaccactcacttcccgagtgctctgttacacccagcgccacctgccaaccacagtgaacatccagccatgtcatttcttccattcctgccctggagtaaagtagatttactgagctgatgacttgtgtgcatttgtacattgcaaccttagcttacctcttgaagcatgtagagcattcatcacccaccattcattcactgcctactcccaccacagctgtttcgtggtctgtctgctccctgtgccacccccaccccatcaggtgggccttttgcaagtgatgaagtcacctgtgggggaagagctttcctttcctctcctcaactcagaaggcctcttcctcttgctcaagagggtgctgctgctttctgcctccttccccggccggcctccatcccagttcaccttttcagacatggcccctcagtcaactcttcccttttctcctggctttttatttctcccagtctcttaagagtatccttagctttaaaaacaataacacagaggatgggtgcagtggctcatgcctgtaatcccagcactttggagcctggggcgggcggatcacttgaggtcaggagttggagactagcctggccaacatggcaaaacaccgtctctacaaaaatacaaaatattagccaggtgtggtggcgcacacctttgatcccagctacttaggtggctgaggcacaagaatcacttgaacctgggaagccgtggttgcagtcaactgagattgcaccactgcactccagcctgggcgacagggtaagactccgtctcaaaaacaaacaaacaaacaaacaaaaaaacccaataacacagaaatgcaaacaacagatctagccctgctgcttcttcatatacttcaaacaaagaaaccttttttgatatctttttttcattccccctttgtataaaataccttgcattggtatatctttttggtgataattaaggtgactatataacttactgtccaggcctggacacttttgagagtgaaatcgactgtttcttcatcattatcctgggacaacaggcctcaccctggactgtccatgtaaaccagggcatataatcacccaagtgatcatccaaggtttttcagtttgtcagagtggttcaatccactcgtgatgatactgccatttattgagtacttactatgagatgagctttgttctgatcacttcaattaacccatggaaccctcacagtgcccttttgaggtagatggtattaacactgttttgactgtgaggaaactaaggctgaacaagttgctcaaggttacacacctagttacgtcctccacactcaccccatgctacatcagcccccaaggtcaacatccatatctcccctgagctgttagcagagatttctaaatgtctgctcaattaaaaggagtgtacactgtaaacaagagtatcgccttccaaagtaagcgtttagggttgcctggttgtcaagggctcaataacaggagtgaagtacttaattcttctctcaaatagtatgtggagccggctcggaacaagcagggcttcccctatcactaatattctctaaaacacactccccaccccacccacccccgaaatggagtctcactctgtcgctcaggctggagtgcagtggctctgtctccactcactgcaacctctgctgccctgattcaaacgattctcctgcctcagcctcccgagtaggtgggattacaggctcctgccaccatgcccagctaatttatgtatttttagtagagaccgggtttcaccatattggccaagctggtcgtgaactcctgaccttgtgatccacccgcctcagcctcccaaagtgctgcgattacaggcgtgaaccaccgcacccggccaagacacacatttttaaaacaaagaaatggaaaagtctagactctaagctggttacaccccacacagtgaaattctggttatttgtttctgctgatttttctcatctcacaggtttctcattcccgaaggtaatttaggatgatgttacttaagaactggagttaacttagtgaccagatattaagccatgaatttcttggtcttcctaggaatgggaattttacacaagtacaagcatctcttttgagaacttaggcctctcacagatctctagcctgacgtctcattcgtatctcttttctttcccttgctgttgctgttcttcttcccctactttaaaaagcctttcctgccaaaatctgaatcgttactccacggagtttattatttaggcagatccgaagatcaacacgaagtctttttgttgttgttttcttgtatttttttttttaatgccaccagggtgacaggaagatttactgaaagctgaacttattttgtttgctctaatattcacaagcctcaagagtttaaggaagtggtaagtacacccgctgcctcggggaatactgttagggtatgagcataaagttatccacactcgtctccaaatcgcaggcgtcaatctgtagggattatgcagcgggggaagaaggtggctattacccagaagagagctgcttgagagcttttcagcattcttccccacgggcacagagcatcttctcttcatgttcctacaaagtgttatggagaggaaagtagttggtagggatctttttattgtacatatgttttaacacacacacacacccctttctttcagctctggttccctctaaaaaggtcctgttctcatcctggccaccagacttcttccaccaggggtcccttctctctttctttgtcaccaggccaagtttgttaaccatcttcagaattacaggactttagtagctgaggaattccttttaaagtggttccaaactcagcacctttaggcaacacagcacattgttctgctttgttaagagaagcttgttttgaagagctaggaaaatgagttcaagctcagatttctctgggtagaaagggtatcccatatcagatgatgatgtgaagaagcagattgtgaactgtaaagtgaaaaggtcttaaacacgagagataagcaaaggggtgtgtatttcaggtaacatacaaacacaagggaaacagacctctggcatctcatcgcatctataaatctggatgatttcaggcaaaaatgaaaacatttgcttttcttcaatcttgggaatttctaaaacattgagttttttaataataataataataatagcaccatttgctgagccccaaatatatgtcttctgctctactgggctcctgatatacgttctctctagtgggcccaggacctgcaaggctggtattgttactgctgtatagaggttcaaggagatgacatgccagaggccacacgactgacgtgtgtgacagccagaatttcattcgtgtgtgtgtgtgtgtgtgtgtgtgtgtgtgtgtttccgatggagtctcactcttgttgcccaggctggagtgcaatggcatgatctcagctcactgcaacctttgcctcctgggttcaagctgttctcctgcctcagcctcccgagtagctgggattacaggcacctgccacaatgcccggctgattttttgtacttttagtagagaccggttttcaccatgttggccaggctggtctcaaactcctgacctcaggtgatccacccaccttcttttgtcaatttatccagtgatcaggtatttgagtgcctacctgacattgtctgagagacagtggacactgagatgttgtacatagctttgcttgtagcagttcatgacctgctactgggctagtcagatattgaccctgagtctattggaccgtagctcactttctttttatgttgcaaaattgcaaacctgtagaaatgttgaaagaacagtatgacaaacacccatatacccttcacctagatccactgttcttaacatttttctacatttgctttagctctcttttttttagataagtcatttcaatgttaaaagtatcatgatgcttcagtattcatctgctgcactttctgcataatctcataccattatcatacctccgaaagttagctgtgattctgtaatgttatctaggatataattcatattgaactttccttgcttgtttccaaagtgtgcttttttacaaaatagtgagcttttttttttctttcatttttgaatccaggattcaatgaagaccacacctttttggttgatacgtctctttgacctcttgaaattaaatatagcccccagtcccggccccaaccccttttaaaatctttaaatgacatcagcagtttaaagagcccaggctggttgtcttttaggaagtcctactttgtgaatttcctcatggtggggtttgttacccaattattttttaattaaaaaaaaattccattttcagtctgtgttcacactgctttatgagtccagtttgcttagattttttgtgggggtacttagatgtagctgctttgggaagagggacacgtggaaaatatagagggagatggggaatatttagttcagcattttatatgctataaataattatagctgtatagccaaatgagcttttagagctctggattccattggaatttaaggatttttctcttcccctcttttcttgtagagattagtttgttgccaacaaccctggaactggcgaactgcttaaggcataatgttttcattaagaaaggatttaactaattagatttgactagcaagctgacaggttaatcaataagggaagtggggctcagcaccccttaagttgggagtctccattaagtcattatggtgtctgctaaaacattcttcttcacaatgattcttaagaatttttacgtgaatccctctaataaatgttagaaaatcctgtccctttcaaattccgtaaagatctgtattgtgttcatgtatttcagattcaaactgttgagtattttagggagcctcgcagtgtcagacaggcccttaaatattgtcttatttttacttttgaagacccagtgggcctgttcatcctttgtcatgttacttcagcttttacaaactaacttcactgcagtttattatttaaatttaatttgttcccagataaacctgaatgttgattaaaaccagtaatttggttaagtgtcagaattagaagaaggatgtggaaagtgacgagtcggggataggagtagagaacgtgagcttcttgagtcacctgcaatgggtggtgttttataatgctctcttccctaatcatgttaatcaggagattttccttttggaactcctgactgaaagcttcttagtttacacacatgttcctccaggatgaacgctgaaaataactttttcggttttgtttgtttgtttgttttcctctatacaaccccttgcaattgctttggtttagaacacctttggattctaagtttcatggttgttctgggagacaccacattcaccctctcaacccaagaccttgaagatgggaggtttttcggacctcatcatagacctccaagggcacttggaagctcagagaggccaaactgccccaggaccagtgggctggcaaatggcacacctggatttggcagaaagcccctagagcctgcactcttagccactctgttaaaggagctcttctttttgagtcagacagacagcaggaagcgcccgctgtacagattgtcaagtgcatagtgcttggaggcatttgaaggaagtaaaaggctctatttttttccccagagaaactgttttaatttacctttctgagttgtagagaaaaatactcgcgtagctctgctcttatttatgtattttcaataaaacaaacttgtgtatttgggttttagtttaacaggtcattggcccacatgtaaagctgatttgttaggagtcattacctagaaaataaaattctgaaataaagatcaagtattcctgaaactaacgttttgtttatagacctttgcaagtatacatgtagactttttgagaatttgagaagggtttttgagacagagtctgggtctgtcacccaggctggagtgcagtggtgcgatcaccactcactgcaagctccacctcccggttcaagcagttctcctgcctcagcctcccgagtagctgggattatgggcacctgccaccacacctggctaatttttgtgtttttagtagagatggggttttaccatgttggcaaggctggtctcaaactcctagcctcaggtgatccgcctgcctcggcctctcaaagtgttgggattacaggcgtgagccaccccatttggctgaggacttcttttataaatgaagatgtggctgtgattttgcaggcacatatatacctttaggtgttttcagttactttcatatgtgcttatcagcaatttgattccatatttgatttataaccctgcaggtgtacaaaactaatattataactagattctctgttttatagtaagcttatcaaaaatcaaggcatagtgagaattaaaacatcagtttatttttggaagaatgattttattttcatcctgacttttttttttttttttttttgagacagagtctcgctttgtcgcccaggctggagtgcattggcgtgatcttggctcactgcaagctccacctcctcggttcacaccattctcctgcctcagcctcccgagtagctgtgactacaggcgtctaccaccacgcccggctaatttttttattttttagtacagacagggttttaccgtgttagtcaggatggtctcgatctcctgacctcgtggtccgcttgcctcggcctcccaaagtgctgggattacaggcgtgagccaccgcgcccggcctcatcctgacattctttatgtgtaaggtgctaaggtggtagcatactgctaaaactagattagtagtacttaatctagagggatcttttcaataattccatacattaaacaatttactgtctccattacaaggtgtaccattgacttaatactggttttttggggagggagtgagtttgagaaacactaggacgttaaaaactgctatgttgattgtaggatatctggatttcagaaacgttagcacatgcttgtgcaggggtgggagagggagaacctgtgtcttagaaatgaagaactatggtacatttatgtaggatatgatatcacattttataatttgtctgcttaaacaatgatttacagatcttttgagaaagagagcaaggaggttgggccttttagtaagacagaaaaatgaccttccgtttaagacttagacaaattaaattggactttgaaagtggtttacccttttcctctcgggtaaatgtcggaagtgagtgccctggctgaacataagggaaggtccattgtcagcaccctgaaagcctgtttgaaatgtcatcaacttggagcattcattggcagcgactatcaacagcccattttaaaaggatgccttgggtagaatggaaattacagtggccagccgttaatcctttttaataagggcaactgttgaggagaattatgttgtaagaatgaatgaaatttgggagcaactctagtccccatgttctgtcgtgactgtcaacaccaaatgtactttcatttttgcaactgcctaaggattttccatttaacaaacttacatgacaaatgggaaagcagtggcattccctgagagtccaaaatctggtttggctctgccgttagcacatttgcctgcagggattgatgtatctgattgaagaatgttgagttcagccaagagttaaggttaaggtccttctatttgttttgggtcagttcctacaggtagagaatttgaaagccctgaagtggtttcattgcccctagtagagataaatggccaaatgtaataaaaatagacagtgctgtccttaattgtcctcccctttatataaaggacctgggaggtggatcacctgaggtcaggagtttgagaccagcgtgggtggtgggcgcctgtagtcccagctactcgggaggctgaggcaggggaattgcttgaacctgggacattgaggttgcagtgagcagagatcgtgccactgcactccagcctgggggacagagtgagactccatttcaaaaaaaaaaaaaaaggacctgggagaagggaaggctagagggctagagccagtttgtattttattaggggtcaggatttactatgttaagttttaggatgtgaatctggaattttcttttttttcatgttttaagaagagaatagaaagatgatagaagatatttgacacctgaaatgctacctctcaacacattagaagtttttatatagagacaatggatgtgtttattagaaatctttatttactcataaaggaaatctcccaaggaatattttgctgtcataccatacatatatttgaatgagaaatggcatttcttaaaaaaaaaaaattacctcattgactcatttccaccacatatttgaactaatgaattgctgtatggaaatatactaaacaacttacagacatcctattgtcgtatatgtgatataaatgtcaacatttcctatcaaaatggcatctgatgttggccctcttaaagttctgtggcttaaaatactaacagtaggaggaaaataaacagagaccaaaatgcaaactcaacaatgagtaaaaataccacagtacaagtggaaccttctataattctgtatcccagaatttttgagaagagaagataacatcttaagcattaagaaatcccaagaccctgtccagcttattgctgttggagagccccaagaccctttaatgctccagtttagaggatcatattgtcaagtcagagaggcttaaacacaatagcatcttctggaaccctagtgacctgtattgagagtggatctggcgcttttgttcttttgagaggcaggtgtaaaggataacacacgggattatcttattttaaagcatctaaaagccaatcccatcccccttcctcattctctttcctctcagcttttagagtctttgatcaggtaaattctaaaggcagacgctagtgaagagtaggtaggtaggcttgtgttttcacttctccgtgccagctttctgtcctcaccctcctcgtcagttagcactgatgaatgtgtagaattagtgaaggctgggtattaacatcggtaatgtaactttcagaacctctgcagtgtctaaggggaggaaggttatttccaccccacctcgtgggaattcaaaggtagctttccgattgtgatcaggttaaacaattccctccaggccagcgtgtgggaacctgcacattcctaccaaagcaacggtaattgtacacaagtgtgttttcagatttctgtcatagcaagcaaaagggaccacagccgtgtttgttagagccccaaatgcctgtttgccacagggctgggttttttttgtttgttttgagatggagtttcgctcttgttgcccaggctggagtgcaatggtgcagtcttggttcactgcaacctctacctcctgggttcaagtgattctcctgccacagcctctcaagtagctgggattacaggcatgcatcaccacacccggctaatttttgtacttagtagagatggggtttcaacatgttggccaggctggtctcgaactcctgatctcaggcgatctgcctgcctcagcctcccaaagtgctgggattacaggcatgaaccactgtgccaggccaggctgtttttaaaacttacgtttcagaggttaaaaatttgtcttaagataaaaagactttcttaatcatctaatgtatcccaggatctatgtcttggttttataagacaggctggcagtaaatttcagacctgacctaacaagttaaaatcctactcctgggcagaagtcttctgtgttagtgacaatgtggaaatgaaggaaggcttccatttgtggataagtgtgattggacaaaggccaggatctgcaggtaatacagtggaggaaacttagcaggacctgattgttcagattcttctatgttcccctcctctgggaatagggagggcacctctcaaatgatggttttatggtgtatttcaggggaaggttagaaaatcctttctaaattttatgacctgctttggggaaagaagggtgggaaggtgagagtgacctgctgctactgctgttttctcagatcccaacaggccgtgttttagggtagtatgtcctgaagcacatcgcttatagaaacaaataaaaaaattgtttgctttgtgatgctgtcctgatctgtggatcttaattgctattactctgagattttcttaaagcatataattctttttaaatgctttatgccagccaaagttagaagagaatcctaaacttatccttaaagtgcaggattatcatggtttttgtagtgcagcattatctggttggaaaactaggtcagaaagacccttaccaggttgagttcctccaagcaatttcaaagtccatctggaggccgggcatggtggtggctcatgcctgtaatctcagcattttgggaggccgacacgggtgggtcacctgagatcaggagttcgagaccaacctggccaacatgacgaaaccctgtctctactaaaatataaaaatcagctgggcatggtggcgggcgcctgtagtcccagctacttgggaggctaaggcgggaaaatcacttgaacctgggaggcggaggttgcagtgagccatgattgtgccactgcactccagcctgggagacagagcgagactctgtctcaaaaaaaaaaaaaaaaaaaaaaagttcatctggaggcagcaccgtgcaagttgtgcctttgaccattttcccaattggtgattctaccagtgagagagaaattcacatcttgtatttttgtgtgtgtggcctgagtaagagtgccaaggcagcctgcattcttaactgatccattaactttcttcctccacagatcgtttccttaacaatgctccctgattagaagaaatgtctcctctcctcccagttactcagtgaacagcgctctctcccaaggggccacatgaaagggaaacccaggcaccacctccgggcaggattagcagcctgggaggagccactttctgttctttgtgaaagctagagctgctctgctcttgagaacagccatttacaaaatggggcgaaaacgacggccacaccctccatcactctttttctcctggtgctttccagagcctttggagacctgtgccgggggtggggcttggagctcccgtgccgatggttaaaggtaccatggctgggccagtgcggaccccagtgctgttccccactactcctctgcctctctccacttcccagttccttcctggtcaggagcccggcagccccaaagactggtaatagcctggcctgtaccagatgccctgttacttccccaggggtctcctccttcccacacttcatgatgcccagtttctgttctgttttctttccaggaacgtgtccctacctggaatccccaggggggcttccatgttccattagagaacttcacattcaaccctcgttttctgttttaaccaatcttgccagtaagtggtgagatccttcagggtaggacccaggtcttactcttcagtaaactcctagtttcaggtgttgaaatttggcagtcagtcaggcgttgttgaaatgaccagtaattgtttctgtactgtaggtaataaagctgcggaaattattctcttcctgaaacctgaagacttcagaaatgtgaggaagccaggcctcaagtgccctcctctttcagatgttaggataagaggttgagaagttgttgtaattgaatgaactgtataagcacaatgtcatgaacttctaatttcctcttgctgaagatcatgacactgtttgcccattgtatgtatgtatgtatgtatgtatgtatgtatgtatgtatgtatttagagacggactctggccccatcacccaggctggagtgcaatggcgcaatctcggctcactgcaacctccgcctcccgggttgaagtgattctcttgcctcagcctactgcgtagctgggattacaggcacacgccaccacgcccggctaattttttgtatatttagtagagatggagtttcactctgttggctaggctggtctcaaactcctgacctcatgatccgcctacctcggcctcccaaagtgctgggattacaggtgtgagccactgcacccagcctgtttgcccattattaagcagtaaaaggacaaccagtttttttttttgttttttgtttgtttgtttgttggttttttagttagacttcacagaccatgaaattcactcttttaaggggtacatttcattgacttttagtatgttccaagagttatgcagctatcactacaattaattttaggacattttcattcccccaaaggaaactctgtacccttagcttctgtacccctcatcctcccaatccctcagcccaggcagccactaatctgctttctgtctctggctttgcccgttcctgggcacttcatatacatggtgtcatacaacatgtgatctttcgtgtctggcttctttcacttagcataatgttttcaaagttcatgttgtggaatatatcagcatttcatttttaattgccaaataatattccattgtatggatatgccacgttttgtttattgattcatcagttgacggacattcaagttgcttctatttttttggctactttgaataatgctgccgtgaacattcatgcacaggtttttgtgtggatgtaagttttcatttcaggtatgtacctaagagtggaagtgctgggtcatgtattagctctatggttagccttttgaggaactgccagacggttctccaaagtgactgctcagtttttcattcccaccaacagtgtatgagggttccagtttctccatatacttgtcagcacttgctattgtctgtgtttctgtttatagtcggtgtgaagtaatatttgattgtgggttggatttgcaattccctgaatgactaatgatgttgagcatcttttcatgtgcttatggccatttgtatatcttctttggagaaatgtctaccccacccatttgcccactgttaagtgggctatttgtttttttattgttgagttgtaatagttctttatacattctggatcctcgacctttactcttaaaatgatgtgcaaatattttctcccattttgtgagttttcttttcactttcttgatagtgtcttttgaaggacttctttttaaaataaaactaaagactgatcactcattttatttcaccttttagtgagtattcattccaaatgacggtcaagaagatactatttttttttttttactttttatttgggaataattttaaacttataggaaggttgcaagaataagaatagcacaaagctcatatatcccctttacccagatctttttttttttttttttttttttttttgagacagagtctcgctctgttgcccaggctggagtgcagtggtgcaatctcggctcactgcaagctctgcctcccgggttcatgccattctcctgcctcagcctcctgagtagctggtactacaggtgcccgccaccatgcccggctaattttttatatttttagtagagacggggtttcaccatgttagccaggatggtctcgatctcctgaccttgtgatccacccacctcggcctcccagagtgctgggattacaggcatgagccaccgcgcccagtctcctttacccagatctaactcttaatttgttgctccatttggtttctatttccgtttcttcctccccttcccctccgccatcccccccgcacaaatagacaatttttttctgaaccacttgaaggtaagatatatatcataaccttttatgtctaagtaattcactgagtatttccgaggaataagggtaatgtctttcataaccacagtacagctaccaattgcaataaatttttcactgatgtgatgcctttatctaatcagctcttcagattccaggtgacaaaatgtcctttacggcattacttttcccctccagtataggatcttgtctagtgtcgggtgttgcatctgagtgaaaaaattaatgtctataagggtatttcctaaacatgtgattaataatcatactaaagtgtattatgcattacagctttcaaagtgttttcttgtttctttattattaaatatatttatttttcctcatagcaaatacttagaatagtgcttaggttagcatagtaactaatacttagattggttcgtgcatcagaatttctagcaggtctcatctgacccatctgccctttaggattcctcacatggagaagaggcttccatgtcctgagcacttccctagagaagagggggtgaaggagatagggatggaccagtctacctgttgagaaagagacagagaagtgggtctcagtatccgaggttcctgggttgacctgcagacatcacagggccaggtcctttccttcctagcagtgctatttgtcaagacccctgtctgtctcccctgacagaaacattgcggtggtgggggttgtgggggtgcatccagcatgaattctccttatcgttttgactcttcctgttcccgcctggctctcattgaacccacttaatcttcttcctgatgagttggcccaggcaggcccagctttccctttaacaatttgtcatcttatacatcaccagattccaaactctctcaattctagcaattctgctttaggataagaaaaaagcgtgtattacttttgcaaacaggtgcaaagtaaattggtaatcgtactgaagtacattatgcattgcagttttttaaagcattttcttgtttattgtagttatctggcctcataacacacacttgaggtagatgtggcacatgtgatctccattttgtccacagaggaactgtggtttaggaggtggcccctcaccaaagctcacacctgtcttctctgattttgcatcttatgctatttccacagggctgtgcttcctaatcagtttgttaataaaactcagtattgtgcatttggtaggaattggtttatacaccattcaagaatagtaaacatttacaccctagatttttaatgatctgagacagcaccgaagtatataaaaaagttaggctcctgagcacttaattcttcaaggaaggggatggaggaaaatctctatctgcagagataatagcagcttaagggtatcttaaatgggatgcttctcaggactcttggagacttagagctagtggtgtttaataaccacagtttacatcactcagagtcatggaatagttctattgcataaacagagcattttatggaaacttagaaaccctcactgctgcaggacaaatgctgtacaaaatcgaagatgccaattgtctagattattttcccctaacaattttgtatgaaaaatttcaaacatacagaaaagtgaagatcattgtacagtgaacagctttattcccacctcttccactcccacctgtactctcaccacccccctacccccacatctagattatgcagttgtaacatttttctacgttagttttttgggtttttttgagacggagtctcactctgtcacccaggctagagtacagtggggtggtctcggcacactgcaacctccgcctccagggttcaagtgattctcctgcttcagcctcccaagtagctggaactacaggcgcccgccaccacaccctgataatttttgcatttttagtagagacagggtttcaccatgttgaccaggctggtctcaaactcctgacctcaagtaatcctcctgcttcggcctccaaaagtgctgggattacaggcgtgagccaccacgcctggcctctacattagttttatcacataaatccaggctatttttgatatactttgttaataaaatcattaagcatctttgatgttttggatggaaggcaccctacagtctcttggtggctgagtttccttttatttttcagaatccctttgaaccccggcaacatgggacagagctgagagcaagggccttgattctcatactcaagcctcccgacagcccgctgcatgcgccaggcttcacgttgtactcgtttgtccagataccatgaaaaccctggtcgggtgtggtggctcacgcctgtaatcccagcactttgggaggccgaggcgggcggatcacgaggtcaggagatcaagaccatcctggctaacacagtgaaaccccgtctctagtaaaaatacaaaaaaattagctgggcatggtggccggtgcctgtagtcccagctactcggggggctgaggcaggagaatggcatgaacctgggaagtggagcttgcagtgagccaagatcgcgccactgcactccagcctgggagacagagtgagagtctatctcaaaaaaaaaagaaaaaagaagaaaaccttgataaatattagtatggggatacattgtcccctcccccctttttctctcagttaaaaatctgtcccagaatgaggtttggcgggacatatggtttggcgtgcttgtgggggctggcagggtgaggtatgtatggtagtgtagttatctggcatcttatctgctcactggaaatgttgggcactgaatagattagtcagagtttccagaaatagaaaataaagccatataataaatgcagaagtcccctagttaatgtcagctgttgtgtgatatctgccctaagtcattttattgcctttgtaagattcttaaactgtttatcattatccctgccttttttaaaaatggaagcaacatcttcctaaagaggttgttatgagacattagaaggcctgctttcatgcctaatagttatcaaaactgaaattcagtatagcagtgttgaaggtgaaagaaggtttgggtacttttaggtagcaagagagataattataagctttcaacccaaggtcaagataaatataaatctggaggaggaaaaaaaaaaaagaagtctagcttctcattagtaggacagcgttctcattttataagaccttaatacccaataggaaatggccgtcaattctgttcatttcatattctcacagcctgtctctcaggtgggagaacacagctaattcttagggtaagtgtcctcttttagaataaaaccttaccaaaggagagctgaaatgggttgtcccccaaggctgggagatgtgtttggttccctttgcctcacttcgacctttctgaaatcaagaaacaaacaaaatgaaatcgacttgtgaaaggatgtcaaaacgacatggcaaattcagttggtttgttcagaattttcttcctgtatttcctttttgaagttacaacagtcattcaggagcacgtccagaggagaagagctgggagggaggacgggtggcttctagagtcaaggctgggtttgcctaaccctgaccctcacgggggtgatgcggatgttccgaagaatgcattagcctttgactttaaggaccgcgaggagagttttcttccgaatcaagtgaatgcgggtgcatcaccctgtcttcctcattccctgtgtcagggaatgcatcggtagcctaaatgactttccctggaactgaagcatgtgttggctctactgtggtgctttaatgtttcctgaaatcctccatttggaggatagagtgcccaggagtgagagaatactgtgttattagaatgcttgttaagagggaaaaagaaaatagagcattaacagacaggcaatgttccattcccccgaggaagatttatgtgacctagatgaacggaactacaaatcttggagggacaagagacttcagaaatggcaagttcttagtttgggaggctaggtattgaagtttatccaaattaatttggaagtttagatcagttgcaatcaaaatccttatttgattgacagtggggatggataaaatggagtttggatttgaaaatctacataggaggaggaagtaatagtatatctattttattatacgtgtgtgtgtgtataactataacaattagaatatcataacactgttaatagaccataaagtgacaaactaccccaaaacaaatcccattttcacataaaaatttaatatatgataaaaaagccttcacaaatcaaaggggaatgaaaggcaagattattcatcagatagttaggtcttcatcttacaccggaataaattcaattgaactgaagagttaaatatgtattacaaaaaaaaaagccagcagaaaaatcaatagatcatatcaatcactcctctagaaatggacattatgaaaagtagatgtcagtatggaaaaatacttttactaccaagtgatataaaatgtggattgaagaaaaaaggtgaaatgactggcatgctttattgccagttggtttagggggtcaggtgtagatatttttgttacttgttttccaagatctgtgatgtggttggagtaattcaagagaaatgtatttataatatgcatgctttaaggtacgtctattcctacttttaaaagtggcagatttgtgttttttaatgcataaattagttgaatgttcatccatccaaagagggatttcttctgatagattggggtgattagctgaaagactcagttcctggagaagagaacactagtggaaaatgcccaactgttaggggaatgaggaacaacagtgctgttcactgcattcctaacgccggcttatcagagttttgttttctgtttcatacacttaggaaagtattgttgccacaaagtgcatctctgcctgttagaaggatccagacatagcgtagacggattgtgcaatggagtcagaaataggctgtcctgctcccagtgagtgacttccccaccccttcatcctccttgtaaatcaccggcattcctgatcactttccgtggttccagctaggttaacaacagaagggatcatttccctcataacagtctccccattagtcaaaagttttactctcaagtgactaaaacgttactcataactgcttacaaggagaaaagatttattttccttttacttctttaatgcacatctggtggagaccctgataagcagtaagaaatggaaaaagcagggacctagaaagtgaaagtagacagatttgggtagtgcatgcaggctaattaatgatcccaggtgggctggagtgttctggttacattttccatgggtccagccctagagcagagaccatgggcatcagcctgccccttcccattatgtggctcaagcaccaccgtgtgccaaagggcgggaacattagatttccccaccgctgtaacatctgtaaattccacagtccatagaatcaaaatggaagagaacctcacgtttctgattgccagtcagaaggaatttatttttgaaacccagtttgctctgttatttgtagtgcaagatagaaatatcttaaccgattttatccagttcttatttaatgtctgtgattttaggaggaagagactattgtgtcataggtatttgaaattcacaagcccctctccaacctaattttaccgaaatgtgttggtttcccctttccttaaactcacggaccacagttactaaatagtttccagagtggactgacatgcatttttctttacagctctgtcattactttctttattatcagagagtacacaggatattgaaataacctaaaatccagagaggaggaggagccaggggggtgaagagaagtcctgacctattttagagcccttgggcttcataggtaaccttgaaaatggaaacacatcattgcccattttattgaggttgtgattagcagtaaaatataatgcagactaattattatgttgcagccaattagcaataaagagaagcattttaatatacaaataattagattttaaaattttggctttgggaatttacaaagccctctatttgaaggcttgtacggaagacattctgaaaccaactttttgtcagataaagtccataaagctgaaaactgacatgaggaggtatggccgggttttcctgcgtctcacagtgcagttaggaggctttgatacttcatgggcccttctgcaaactttccttagtattaggaaatgaagtcttccaagtcagtcaagttgtaaacatgcaaaaatgctgggagtggcagtctctccaaacaaatgacccgttctcactgcggttttctcctggtgctagaacctgtaactcctgagttgattctctccaattggccagagaaatgggcgttgctgctggagcagatgaaaaggctattaaggcttcctgaagcacttagattaactagcttttttttttctcttggagcaaaaagttggaacaagttttttgttttttttttttttactttttggacatatgacaaatgtgtataaagttgtgtgttgtgcctgaggagctggtgaatggagttgctcttttgagagttgcttttatatcattgctagctgtgaggtacgtggtgggcatgaagagaaccagtgtcagtccctctgcagaagcagaggctgtgagctccactgtgagctgccaaggcccatactgctgggggatctttaatgcatggcgcaaggctcctgtgccccaatcccggaggagcggtgacagtccagggaagagaggggaccacgtgagtgttacatgttcttgatcacatttttctctattggaaaggaggatgttgaaagttaatcatgtggtttttctagtcacttaagtccttaacacactggatatacatagttcaaatacaaggaaattaacctggtttcaaatgtcttttcctcattttatggcacatggagtatagagcatattcaaaaccctcccatcccccactttgtagacaacacatctactcagaaggttttaacttaactttctgtattctggtgatgtccacgaggttttgaggccttttttttttttttttttttttttttttttttttgagagagagacagggtcttgctctgttgcccaggctggagcacggtgttgctgtcatagctcacttgcagcctctacctctagggttcaaacaatcctcctgcttcagcctcctggttaggtgggaccataggtgtgcaccactatgcctggctaatgttttttatgttttgaagagacagggtctcaccatgttgcccaggctggtcttgaactcctgggctcaagcaatcctcctgcctcggtctcccgagtagcttggactacagtgctcaataccacaccccactaatgttgcctttttttccttttttttttttttttgtagagatgagatcatattatgttgcccaggcccctctcaaactcctggcctcaagcgatcttcccaccttggcctcccaaaatgctgatattacaggcatgagccactgtgcccagtcacattttttatctgttaaaaaaaaacaaaaaccaagtttggatgttatgatgttagtagtgtgtctggttctgaagttacaggataggagatagagaaaaattgtgacctgcccaaagtctcaaagctaattctaaataactaaagttgtagaatcttttgtttggaggaccatcttaaaggtgtgatctgtactcagccatttgtctgatgtgtaaatcctcagtctgtagcttcccggccacgtggtcaccaaggctgtgcttgaacatccctgagacgcctttcaaggagcaccgttctgtctttgggcagctctaattgttaaaaaaaaaaaaaaaaaaaaaagtcttccttacgttaggctgaagtctgttccccatgtagttgttccccttggggccatgtaatacaagtctacttcctcttacaaaagacagcccttcaaatgttggacaacagcagtattcccggccctcctggctcccctcccctcatccactaccaaggaagcatggctgtgagtttgttcatcatcctttgaatgtgctccaactcatgcacagcccctttaaaaggaggtgtgcagaacctgattctcccagtggagcttaatcagtacctgtcatccccattttcccagtgacagatttttattgagacagccaacacttggattggtgttgcctttgacgaatttcaggttactgcaaagtgaatccaaataccaactattttcaaataaaagaaaggagaggcaagacttagcagcagcaggctttttacagtccttcaggtttcaattgtgggaccttacacgtggtgctattgcagctccaattttgtttttttcttttaacccatcatttcagcttgttaaactttggagattcatattctgtcattgagagttgtccttccttcctttgctgcttcagaggacttagtgatgcctttattagagcttttactacattgcattatggctctttatgtctttcctcctgagttctgctaggatcataatcatgtctcatcatattcctcttctctcttcaacactgacagctcatagtaagtgcttaatacattttcattgaatgaatgagtcaaaagtatttgctcttccaaattctgcttattgatagtttattaataattatatattattcatgctgtttcaatatttatcgtacttatttgaatatatacatttatatttatataaagtaataaatgtgggtattttattaataaataagttacttattaagtacattgaagaggacaatggctagatgctgttttgcagcccactagaaactttcccctgggccaggcgcagtggctcatgcctataatcccagcacttagggaggccaaggcagacggatcacttgcggtcaggagtttgagacccgcctgggcaacatggtaaaaccccatctctactaaaaatacaaaaattagccgggcatggtggcatgtaccagtaattccagctacttgggagggtgaggcaagagaattgcttgaacctaggaggtggaagttgcagtgagctgagatcgcaccaccacactccagcctgggtgacagagcgagaccctgtctcaaaaattaaaaaaaataaaaaaaaaaaagaaacttttccctgggatgactgttgatctgttctttgacattctttttaagataaggtttattttatcaggaatttccctaattttatagtcagttctgttacaacgctacatacagtttccttaaaatcaccatgctgttcacagtggtacaaatgaagccataagacttatgggagaaatgggattagggaccaaaaatttatcactgacagaaaaaaaaaaaacaggaacccagtaaaaacagtaacttagttttacacatgctaaatggttaagaaataaataggccgggcgcggtggcttacgcctgtaattccagcactttgggaggctgaggcaggcggatcatctgaggtcaggagtttgagaccagcttgaccaacatggagaaaccccatctctactaaaaatacaaaattatccgggcgtggtggcacatgcctgtaatcccagctacttaggagactgaggcaggagaattgcttgaacccgggaggcggaggttgaggtgagccaagatcgtgtcattgcactccagcctgagcaacaagagtgaaactctatctcaaaaaaaaaaaagaaagaaaaaaaaaagaaatgctacaataaatatggcatctaccttgtaaaaagcctgaagtttgctcatgggagctgacatgaggagggttggagccggtggttatagtggcgtggtggaaggaggattatctgaacttggaaagaaggttgtaacagcagatctgaatgtgctacactcgtagcacacacagtcagctgaggaaggcaagggatgcttgaggctgtatggttaatgtattcctgtgggctccagaatgcggctcagttttctccattcaccttgtactttttgcagacaaaattgcacctaagcaaacgttacattcacattagaataaactcacatttcaaagcaagtgtcgcagcagctcctgtttctttgttgtgttatttgcttgatcagtaaagcatcttttttgttcttatagtaattccaggcactggtatataaggatacataaattatactacccactcactctctaaaactcttgttcttaaagattggcttatttttgctaggaggaatgaaagtacatgttaaagagacatacttggctgatctagccattttccaaagtctccccccgccagaggaatatctcataagtctggttcctaattacatttagcagatttctctaaaatctaaaagctggagtttgaatggttcttacttttcagctagtatctaaaaggtgattcacttaggagcagcatagaggagaaacttgtatttcacctatcaagtttctgatttaaaagtgaaatttcagccaggcacggtggcacacacctgtaatctcagcactttgggaggcgaaggtgagtggatcacctgaggtcaggagttcaagaccagcctgaccaacatggagaaaccccatctctactaaaaatacaaaattagcctggcgtggtggcgcgtgcctgtaatcccagctactcaggagggtgaggcaggagaatagcttgaacccgggaggcagaggttgcagtgagccgagatcgcgcccttgcactccagcctgggcaacaggagcgaaactccatctcaaaaagtggaatttcacctcatatcatttacatgtgtgtgatttgatgatggctttaactgaaaatagactaatgccaatagaatcggagactcttagaactggaaaggaccacagatatcaggaagcccaaacttctctctttttcagatgaagaaaccaaggctctgcgaagtggagtgttacatgcacagtcacttagctagtggtaaagccagaacttgaatccagttaattttgaaactataatatgttgccttgcaaaattgtatcatagaaggacataaaatctgtgcatttaggaggaaatctaaactcatattatttcagctttttagtctgtttagtaagggagtttcaccaattcagttactactgataataagcttccccttgttttatttttgtttctttaagaaatctgggccggacactgtggcacacacctgtaatcccagcactttgggaggctgaggtgggcggatcacatgaggccaggagttcaagaccaacatggccaacacgatgaaaccccatctctaccaagaaatacaaaaattagccgggcgtggtgacacgcacctgtagtccaaactacttgggaggctgaggcaggagaaccacttgaacttgggaggcagaggttgcagtgagccgagattgcgccactgtactccagcctggctgacagagggagactctgtctcaaaaaaaaaaaaaaaaaaaaaaaaactagtatgacacaaactcaccaaagtggctattcctcagactctgtgctttataaattcacgtttgttagggcagacagaaaattctgtttctttgtacccaaaaagatttaagcatttgtcgtgcattgatctggggttttgagggggaaacatccttggttatgtctgtgggatttgtggtgccttctggaggattaagatgtcattgcctctagtcagggcatgctctcttttccagttggtgggtcttattttgtttacatctgcttcctcccagcactgacagatttgaaatgtgtgcctgaagtgcacctttgtgccaggcccatagttttgactggggccctcatgacccattggccatggtcactttgcctgggagcaatcatcatttctagggtataggaacttgaagcaaagaatttgctgcattttcaaaaagcaggaaggggtggttaaagtgtggatggaggggtaatctccccccacccccgccccagcccctgttttgtaagagaggctatccaactcatgtatttccagccccgagtgttggcaaaaacattttcatattgttctcacttttctgactgagtccaaaaagttcctgggaaacaggttttgtttttcctcgggggatgtttggatttgaaaacaccaaatttcaactgcaatcgtttgtccaagtgtggtgttgaaagtactgtctagatctgagtaaatcagaatctgaagaaatatagccaacgtcactcattaacaatgggttttccaagggtgagtgacatgaggccatttgtctgcggtgaggtagatgcgctcctcttttcagtggccccctgaggccaccaatgtcacgggcaagcacatcctcggtttggggccattagctgaatgccctctgtttcatcttgccttttctaggccgccctctcctgtctttaaggtcagggtttcagaatgtccttcagttctgctttagtcaggactaaaagccttccacagtgccttgacgaggaggacatataaggaagaggcacaattcaagtaaagtcagtctgtattgattttgtgaacccggggaacagtaagccagccttcagtgccgcctggctgccgggcgcatgccgttgtcagaccgatgagcgaggctccatgcagacaggtgacatattcgaggtggcaagagcagcaagagcttctagatcctgtcattttgcttctgacagtgtctttgtgtctttgtacagttggaggacctgactgacacgtgagccccccttggcagccatcatcttcagaatactgctttcctcccacgggaggagcttgtacctctctcatgtgtacagggtgcttatgtgctcatgagcaggcaaaggagcaggggacggtttcttccagatcacccttccaggtgctctggagttgatgtggcctggccaccttttcatcatcgcccctccagttccattgcagtgatgcattgcaggctctcctcaggaaaatggtgatttcagtattatattaataattagcaatttttttttttgcagttttaaaaaattgactcttaccctctgcatttgagaaaagtccttattatacgtttctgtattgtatcatctcccagtttgatgtgtatgtatcccgattgtatttcactatcattacggagatttttattgtgtcaagacaaaaccctgtttctgtctccccagccccatgtactttgagcttagtcattcgggcatcatttcttccagcattcactgctcctcagtgtttcatttccatttaatttttctatttagtttttagcagttctcgttggctaattttaaaaagatttgtactttgatttgcttataatgagtgttttaagttacctgctgactgcgcagttgtttgactttgtatcaggtttccggatttaaagccagtgttctgttgaaaatttaaatactatagaaggctgaaaatatgaatcctctgacagctcctcataacaattcccagggtagcagctgtttatattttcttatttttttctttctatgcacataaaagtgtgtttgtcctcataaagagtgttgactgctatagacggagcgtgcagaccacaggcgtatacctggaggcttctcccacctttgattattaacactgctcgcctttaacattatttgcttttgattgctctttttgttatacaaaaataaccaagctattagaatcttttatgatttaaaatagaacattagttttattgtatattgaaaatagttccttaaacttcataatggcttccaattatttcacacttgcttgcgttatatactattattttattgcagtatgatgtccaattatggaaacaactccagagagacatgatttttctggcttaacatgtaattgtttattgagtatttttctcattatgatttttttccttttgaattgcagttataaaggaacttgcttagattttgtaaattattatgtggttaaagaaatcaacgatttatcaagtgctcactctgtggaaggcatcgtgtgcagaatcgaagtaaaggcaaagattgaaagaaatcattcctcaaaaaagttgtgtgtattaaaatatgaagagcagtaaggttttttgttgttgttgttgttattttgagacagagtctcactctgtcactcaggctggagtgcggtggcacaatctcagctcgctgccacttccgcctcccggttcaagcgattctcctgcctcagcctcctgagtagctgggattacaggtggctgccaccaggctgggctgatttttgtattttcagtagagacggggtttcaccatgttggtcagactgatctcgaactccggacctcaggtgatccgcccacctcggcctcccaaagtgctgggattacaggagtgagccaccacacctggcgtaggattaagttttattgtcattcaaatatgaacatatttaatcttgtataataaaatataatttattctataagaaacataatgtgttgcttgctaataccaaggacattaagtgtagactagaagttcatcagagcagatggctagcaggggctgtgagactggataggggttaaccgtgaggctgaaagatgggattcgaaagtgcacctgtgtgggaaaggggagagcgcaggatcttggcgcactggacggtggctgaaggagagggagaggggggcaggccttgatgaggagttgggagggattctgtctgtgatgagaagccactggagagctttaaaccagcttttgtgaacacggggagtagcagtgttgttataagtagtgattattgtcagcatgatcgatttacattttaagagctcactcagggtgctggcggacagtggattctgtaaccattattttgttttaaatagcgtcacataagcaataatttacccatgaaccaccagttaatattgggggaatgaaaacaatggatgctgtgattctgagcttagatgatggggacaggacagagtgggagtggaagggggtgggtgtgattttcgtcctgttgagctggaggtaatggtaggacagccaggtagacaaggccctcaggcaacaaggccatttaggttaatttgtgtagctgcttcttgaagaagaaacaaatgaaggccgtattaccttctgccttcttttttgaaagcatctctgaagataaagttcaggtgattgcaggaaagtagaagtcattctgacatgcatttccgaagcatcaacttggttgtctgagagcatttcccttccaggattataattgtgagtggtaagcagcactagtgtattggtgacttactccagctgtatccaaggacaggtaaaacttcccactgtctctttctagaggctactttgtagcatttcagatgtgaaaggtgactccagcagagagctcatctatttattatttatttttgagacggagtctcactctgtcgcccaggctagaatgcaatggcgcaatctcagctcactgcggcctccacctcccaggtacaagtgattttgctgcctcagcctcctcagtagctgggattacaggagcccaccaccacacctggctatgttttgttttgtttttgtttttgtttttgtttttgttttgtagtagagatggggtttcgctgtattggccagctggtcttgaactcttgacctcaggtgatccgcccgcctcagcctccccaagtgctgggattacaggcgtgagccactgcgcccagcccagcgagctcatttctttattttattttattttattttatttatttttgtttttgagacagagtctcgctctgtcgcccaggctggagtgcagtggcgcgatctcggctcactgcaagctccgccttctgggttcacgccattgtcctgcctcagcgtccccagtagctgggactataggcacctgccaccacgcccagccaatttttttttttttttttttttagtagagatggggtttcaccatgttagcaaggatggtctcaatctcctgacctcgtgatccgcccgtctcagcctcccaaagtgctaggattacaggcatgagccaccgcgcctggcccagagagctcatttctaacaagctattatcaccatcctcactgctttctaaaccttataggtatgtagcttcaaagtttatatttgaacgtttttcctttattgatgacaaattaaggataatgaaatgaagtaatggcaagcgatgaaataatggcaaaagattttattttcctacaaagtatttattacatggatgttttatagaaaatcaatgtaaaggttgatagacttgtcctttaaaaaagatacatttcttcaaatatagggaacagcagaatgctccctgtcaccccctttgtaaaaacctctttcagctttgcagccatcatggctggggataagtagatttatttcttctgttcctaaagattattatagatgaaaatcatttggtgtggagattcttcatttacagctacgtaggatgtagcacttatcaaaatttctgcaaatcaaggagaatagtgttcatgaacctaccagtgagatattttaaaagaccgcgttctggaaaagtgaaggaggataaagaagcagtgttcttctgagggtgctaccaacatttgggactctcagaggccctgtagcccagtccccattccactccatgggtaacacctcatggttctttcatgggtgttcagcattctcttgaatgcttcccctaaaggcagtttgttctcctgtgaggcagcctagtccatttcacttgaaaattttcttctgcaatatgcattgtttggtcctggttctgtccatgatgccatttccaatcaatctgcttcctcttcagtgtgagaagcatcaggtccttgaaggtgctcacagttgtacttggggcaaggctctggaactcccttttctgcatggtccagtgaatctgcatagagccggactgggaacagtgcctcaaacaggagctccctgttgctggctttcgtgaatatgttgtttttgggggtagctcctaatctggtgaacatcaccactgcctcccaccaccgcatcctgtccaacctacatgtcggtagaggacccaccctaggaaggaatgaaggaaagaatttctaaggttgggtcttgggaagcagagacagagaaggatccgcagccttatggacagcctccctcagcagtggggcttgctgaggctctttaaccctcccagcagtgctgtagaacagctctgtgcaaacttgaatgtgcatggggcagggctgggcggcacggggaggggggtccgcgaatgtaccgtcctaacaagctcctggatgatgctagggttgctgggccgtggaccacactgggaatagtgaggctgtagcatacatcgaagtcatagtgtgagctggtagattgtttgggaccagaaagatcaaaacttacttagaaaaaaatgtcaaagtcctcttttccctgctcctcctcctctaacttaaagaattaagggctgtgtgatagccagaaagctactttcatggattcattttagcagcatctctggtgctcacgcataagctagtcagggagattgcagggggttggcagcacccaggtcccctgggccatagcaggttgtgtgaacagacttgaggagaagttttgtcttctgtcctcaggagtacaaacaggcatgtctgaatgctgacagagaagtcatcgccaaaggatagtagatattacccaaggcaaagcctgcttctcagtgaactgttgcctatgggacaagaatgatactgggaaaacagtgattgcttttaggatatttgataaagctctaaaggaatagaagagcttccacctacactacactccaagtgacagctgtgtgaacttggtggaaaacttgactgaggtcgctgagactgctggtggaaattaatcaccctcctgctctgcagtgatattggcaaaagatgagcttagggccagagtggtccacatgcctgggtgtctgtggtccctcccctgcagaacagaatgaaacagtcactgccataagatatcacagacacttctttctactagggtaacttggagcctttctttggctacctggaccctgatgagagggtaatctggaggaataggaagtgggcacagggatagtgcatggtacaggtgactcgggtgcggagagtatgtgtgtgtagggccagagctaagaaaaagcctaggataaactcgacagatggaaagtcttttttttttttaaacagggtctcactctgttttccatgctggagtgcagtggcattgattacagctcactgcagcctctacctcccaggctcaggtgttcctcccacctcagcctccacctcccaggctcaggtgttcctcccacctcaccctccacctcccaggctcaggtgttcctcccacctcagcctcctgagtagctgggactacaggcacacgccaccatgcccggataacttttgtatttttttgtagagacagggttttgccatgttgcctaggctggtctcaaactcctgggctcaagtgatccgcccactttggcctcccaaagtgctgggattacaggcgtgagccaccacacccgtccaacagatggaaattcctactttgcctcttggcatgcatacccagcctcttttctaaatgggtctcagtgattgtccaatgtgtgccccaaatcagatgaaatacaatcatcagatgcaaagcaggaaggtggtagatgacggacagtatgtaagtcggtctttgctgctagtggctttacttcatccttgagaaaatcatctttggtaaagtcataagtgttgaaactcgaaactagggtttaccctagacccacccattggccaaccttaatgggcacactgactttttaagagtgtgaaagttattagctaaatgacttgttccatggccccattatatcacagacatgttgatgtctctgttatcaaaagacgtgcaaaacaccccaaaatcgttgatgacattaacaggtaaaatgacaggggcgcgttgcaacacagaatgtgtgcttcagatggtgaccagggctggattagcctcatggttatggcccatttggggtgtggacatcagcttctcggatgaaggtgttagggttagcagagggcagcggtaggaaggaaggtgtcagatctataatgcaccccatctgtgagcctcgcggctttgccttccacacaatatttagtaatgtaaatactggaagcagggctgcctgtatctttattttattcaacttaatgtgaaaagcaggatggttagatactgggaagactatctttttaatttttttacaccaaacatctaaaattattcctattcagtgccttggtctcacccttgggaaaatttccaaaataagctaacattttccccattgtcttcccgcctaaggaatgtgtgctgtggcttttaggtcaatgatagccttgtccttcaatttcatctttactcagagtaggcgtgctgtgtggtgcaaatccatacatgtttgtttgaaaatccttttagaaccttgccttgttaggacctcctacacctgtgtcacagacacagaagtaccgtgtttaagtattgagcatacactagttttttgtgacagaatctcactctgttgccaaggctggagtgcagtgggacgatctcggctcactgcaacctccgcctcctggggtcaagtgattctcctgcctcagcctcctgagtagctgggattgcaggcgcgtgacaccacaccacctaatttttgttttttttttttagtagagacagagtttcaccatgttggccagggtggtcttgaactctggacctcaagtgatccactggccttggcctcccaaagttctgggattacaggtataagctgccacgcctggcctgcatacactggttttaagggtggctgtgcttgggctgtgtatgtgcgtagtacacagtgtcatgtgagcacttagttaacagccaggcaggggtggacaggccaggacagctaagaatcgcggaaggagtctgggggtagcaggaaggctgcactgggaatggaaagcaagcaggagatgatcttatccagaggaagcagctaataaatattgaggctggcaggaggatacaagcaaacaaacaaaaagtggggccgtgtctttaaaagctttctccgaaaccaatatttggagttttcctgtgttcttggaagtgactggagattgcatccttcataccttatttctcctgtcaggtctctacatatcacatcacaggattcagctgatattggcctaagacccttggggtcggtgcagtgggaacgtgttatagatataaatgccttaccgttgataactcagaataagatataggatatcatcattaagtctgattatctaagcttatctgtgagccttacagaaaacaaaaacgaaagatcaggaccacaggttctttgactaccatttccctatttttttcatttgtcctgaacagggcctaacacaaagataggcacatgaggcagggtagtacaaatgagtttttcccccgtatgaagtgacaatcacatggattatatgtgaccttgacattgttgagtttctaaagactttttaaggatgccatacccacccccaatagatcacaacctatttctctcattctaatgttggtcatttgattacatagtcctttgtggctctgtttgcttgagactgcaaaataaacaaaatgtttgcaagtccaggttgaccctaaaagctcttcattctgtaggccaaagccatgattcagagaacctgtggtctccacagtcaagattgtggttgatacaccccccttgaaggcagatgttttggttttaaggcatcaggaatgtgggcatgtgcatcaggattgatgtgttttggtgtggggtttaggagcaataaacttgaaacaagtttaagtacactcaactgcggtgtgttgcttttcctttaatccctagcagattaacccctatcagggttaatctgctcaactagatgatagccaaactagcttctctgataacagcagcctctaatccactggactccacacagctctcccagtgggctgctggtgttttggcagatgcaatggctattttttcctatttaggattttgcttttaataggaaccctgaaggccctcagaggtttgtgatacagacttcagcccacagctcagcctcccagatggtaattaatgtttacacaacatgacaagcacaaaatagaatctcttcgagccctgccaagcacccatcattccccctgatcttccactcttgcagtgtttgaaaattaatttgccttgaacaaacagtgggttttcctcaatttatttgtacagtttcagtgaccaagaagaagagctgcaagactgaatgtcatccttccattcgttcaagtaattgaatcttctaatggaacaaactggtctctgcttaatgatttgaagaaaagagggagaggaggaaaataaagtgaagtgtatgttagagaaagtggacatttttctgcaaaacatcactgaatgtagaattttggagatacaatcaaaacttagcagggggaatttaaagtattgctaaattaactcagtagggcggttggggttttaatacgtatatacaatgtgcagtctttgcttaaaaagagattttgtttgaggcaacagaatagacaggtgaaggtaattaaataatgaacattggccgggcgtggtggctcacgcctgtaatccccgcactttgggaggccgaggcgggtggatcacgaggtcaggagatcgagaccatcctggctaacacggtgaaaccccgtctctattaaaaatacaaaaaaaaaaatcagccaggcgtggtggcgggtgcctgtagtcccagctactggggaggctgaggcaagagaatggcgtgaacccaggaagcggagcttacagtgagccgagatcgcgccgctgcactccagcctgggcgacagagcgagactctgtctcaaaatagaataaaataaaataaaataaaataaaataataatgaacattgattgggcagggtggctcacacctataatcccagcactttgagaggcctaggcgggaggattgcttgagcctacacgttaaagaccagcctgtgcaacatggtgagacctcatttctacaaaatataaacaattaaccagcatggtggcacatgcctcagcctcccagctacttggagactaaggtgggaggatcatttgagtccggggagtcaaggctgcagtctgctgtgattgcaccactgcatcccagcctgggcaacagagtgagactgtgtccaaaaaaataaaataaaatagacattgctaccagcttgaggtaattgcatgttgattcacagaaatttgatatttccatatgtctctgggattgccagtgtttaaacatttcagtcccttattaatgttcgcactttaaagtctgggttaattttcttatttgactgtgatctgtagtctttctgtgtggtgtgctctttgtggctttgtcatttggacagtaacgagagaagctaactggaagatggaataataaaaataggacatgtctctttctaagtcataaggattagatattcaaaaagatacggatgaatggatgatgcatggatggatggatgttctaggagctagtgccccccacatagttttcttgatgcctttggaagcttcttcaggtttgctgcggtaatgaccttgtagttagtaagtcctgttaggagacttcgtaacagaatatgaagatgtgaagaccagaagtgcagaagctgtactttgggagagttggttttttgtgtatttttgtttttgttttgtattcctcctcctccttcatcaatattcaccctttcctttctgtccaaataatacccagttagaaccagttagaaattctgaagaacaggtggaaggtttaatatgcaccatgttctgatgtgtgcctgtagtcccatctcctcaggagactgagtggggaggatcacttcaccatgtgagtttgaggctgcaatgggctatgatcactccagcgtgggcgacagagcaagacccttttaactttttttttttttaaacacatgcaccatatttttaaaaattaaaactatgcaccatacacagagtcaaatatttatctgtcctcttggtgaagagatttttaaaaaatctattcaatagtccaggcatggtggctcacgcctgtaatcccagcactttgggaggccgaggcgggggtggatcacttgaggtcaggagttcgagaccagcctggccaacatggtgaaaccccatctctactaaaaacacaaaaattagctgggcatgatggcaggcccctgtaatcccagctactcggaaggttgtcagaagaatcagttgaacctgggaggtgaggcagaggctgcagtgagccaagattatgccactgcactccaccctgggcgacagagtgagactccatctcaaaaaaaaaattcagtaggtaaggcaatttaaaaagacttgaacgatcactttctcagttggcttattttaatggtagaggtgtattgtccgcgaaaagagttaattttaaaatatagcatctctttttttactttaacaataataatactcttatttactttaataaaaatttaataagtatactttactaattacagtaaataatactattatttaataactatatataattatttgctgtgtttaataacaaagtgaacattgactttaatttttatattgtgcttaactttccaaattttctataatattcatttgttttgcacttttcctcctcctcctcctcaattttgaaagttaaaagcacaatatgagaattaaagtcaatgtttatttctggatgatgggactgcaattaatgtttatctttccagtctcttttctgtgcatacttgtatacatttacacacgtagttttcactattgagatcacactgataatagtgcactttatttaatggcaattttgtcatgagatattttctgtgacattaaatacttcttcacaatagttttgggaatattgattgattacttacttattatgtgttgtgcattgtggaaagcactttacatggcctaatttatttccacaaccaccctaggaggttgttactgcatttgtgcagtaagtcattggacttttagaagtgtaggagttcatcagagtataccgaatctcaaccctaccagacccagcataataataagaaatattttatagcgcattcattttttactttctggaatgaaatagatacttaatgtacccatctacatacataatttaaaagtatatataaagccctaataaaatataaaggagaaataagtggaaaccaagtcatttataataacatacctttaagtatgtaagtgcttgtttatattagaagacaatgtttgactttatatctagaatggtatctaaatacttctactacaaatgcagactcacacaaatacatggtcatggagattcagatacctggagcagccttaccattgtgtcatgattttcccaaatagccatcaacccttgcatatgacccagatataacaaagtacagtccctgcattcctggaaaaatcagcgtatattaaaacccatgcaaagaattactttgtgtttatatacaaaaacagaggtggtgggttctagggttttcagctgcacaaatgtcgggtggaatttaggaagtgcattgagatgttgtcgtgtggggttgctgcgcacgttgcagcaaatcagacatccctaagagccaccagtgacctgcagtcatagtgatagccacacactcccacaaatttccatctcttcccatagggagtagtatcctccaatgggaactatctattacgtgactgacttagttcgcgcttttttgcactgaaaaacactttgaaaaaagcaattttgtgggggaagccatttctgaaggtttacaagccctgtaattttcttgttaggttcattcccaggtgttatggtttttgttattatgaagtggatcctttctaaacttcattttctgactgttgctggtgtatagaaaagctgaggttggttgtggtttttctttatttggatatctcattgcactctcttattagttctaatattttctcagctggttgcctctgttttccagctaggtaattatattttttgtaaacagtttttcctctttcttttgttgtataatatttgctgttggttttcaatttagttgacaggaataatttgtttcttaaaggtttggccaacattgtctgtgaaacagataccttttgggaggggaggtgaaggtttggattattgagtactttttccttttattttgatgatcctgttgggtttttaagtcaattttagcaatttatattttttcataaaatccattttattttcaaatttattacacattcacagattacattttcttatttttttatgcatatatacacacacacacaccccagttccctgtctatccagttctcactcctcccaagcccctaaacaggtagtcactgctgttactgttttcttgagtattcttccatggcttctttttttttttttttttttttttttggaaacagggtcttgctctgtcactcaggcttgagcgtaagtagtgcagtctcagctcactgcaccctccgcccaagtagctgggatcacaggcagacaccaccacacctggctaatttttgtatttttagcagagatggagtttcaccatgttggccaggctggtgttgaacttctgacctgaagtgatccacctgcctcggcctcccaaagtgctaggattacaggcgtgagccgctgcgcccagccacacggcttctttgtacgtaaaataagatgaatatatatattatttccctccattttccacaaaagatagtaaatgctctacgttgtacattcggcattcttttttacagctgcaaggtgttccattgtgtggatctgcaaacatacgtaaccagtctcctaatggttacatttaggtggcttccaaacttggtattcaaaccatggtactatttcattgtgtctgtagactaaatccttaacacaccacaccaagggaactccatttgttattttgctaaacctccacagaggttgtagagtttgcattctactagtaaagtacaaaaaaagggcccattttccccaggcaacttgtatcaaacctatatcaaaatgaaaccaatttttcctaatctcttaaagtttgtttattgaggtacaatttacatgcaataaactcaccctttttaccgtaaagtacgcaatgtaatttgaatttgcatgtattttagtataagcatgatgaactatttttataatcacaagaagagagagttttaaaccccaaaatgtaatgaatacaacatttaaataagactactcaatttgtacattcttatgtctttcaaattcagcaactttcattctttcctttatcctttggcaaattcagagtatgcagtgcaataccaagcgatttcttaaaatgtgttgctgccaattttggagaagtacagtaagacaaattgactgtcaagatggaaaagcttaactgggaagatacatttattgaataattgaaaggaagaggaaatgcattaccgattagccacaaaaatgcctgacgcctgtgcctcaagagactcttgtaaatggggagtcataaaactgtttcagcccccgaagttcttaccagctcaaactcatcactgctttgtttataggttgcagtaccagagcaacgatggactgattgctttcagggctggctgaagtgcagtgttacagccactctttgtagctttactaaccctctacactttaagtctgatgtacttaaatattttaactgaatcctggatttatcattacctgctttgctttgagacttctgctttttaggaggcagcatagtatagattggagaaaaggcagttggtgttggcagagttgggactggaactcaagccttctggtttacaaaacaaggacgtgacttccagcaagcaagttccttcacttctctgggcatattccctatctggtcagagagtgttagattagatcctgctactcaaaatgtgatcctcacatcagcagcctcagccttacctagaagatcctcagaaaggcagaatctagagccgcatcccagagctgtggaatctggatggggattctaatcagatgttcaggtgatttgaacatgcattaaagttaaaggagtgccgtacagatttgcagggttccctggagaggttggggtcttcccttcatctctggtagcttgttggaggtggtgctgacggccacagccttggcaccactcctcatgttctagctgtggttaggttgagattgagacagtgaggcaacagaggagacaagaaagtcaactccagtggcctttccggggccttgggaagcgagcccacgcctgcaggatgccatctgcaagcttggctgtgttatccaaattcttgaggctcgttcaagaacaaggaggtaaacagagtcaagctagatatctgtagtacttccttatgtgtctctgatgtgcctccttaccagcataagtaagtgtgaatgatatactccaagtggtgtcctttggaaaaggaagctgattttgggagggaatttgaatgtatacttaccaagatagaaagtatttattgatgtcttcaccagcccagtctggagaaaacagagtaatacaaaaagatttttttttttttttgagacggagtctcacactgtcgcctaggctggagtgcagtggtgtgatctcagctcactgcaacctctgcctcccaggttcacgccattctcctgcctcagcctcccgagtagctgggactacaggcacccgccaccacgcccggctaattttttgtgtttttagtagaggcagggtttcaccgtgttagccaggatggtctcgatctcctgacctcgtgatccgcccgccttggcctcccaaagtgctgggattacaggcgtgagccaccgcacccggcctacaaaaagatttttaaaaagtgtttctgccattgtaccaagcataaaaatcctgaattagctgtcagtgtgagaagagtcctgctcatgtacctagaacttctcactgggtgaaacccctcctctgttttgtgctgttaggatttctgggctgttcttactttctgtcccagacctgactcaaaggcctggatcatgcatatgaagcacgtgatttttcaatgcctttgataatagcttgctgtgggaaaatcctgtgaaagaaaaatatgggaaattttgtgaagacacatggagagacacagagctggatccctaactgtgacatctctgaataaagggccttccttcctcattggatccaggagctttgctagctggatggggacctatccgcagcaagggcttggggtgcccctttagccctgaagttaggaacaaaggttttgagaagcctttcaatttcagctttatcctaagcaaaaatcttcccagaaaggttgataagacagcactggacagaaatgtcggaagtccagagttacttttcatcagcgctttgccaagtgctcggtcttttcatacctctgaagcatgtgaagaaggcagctttcttcccatctcgctggtgttattgttccaggctgtttggagagacctgaagatagccaagttctgttagccaaaaatttgctttgtttataaacccaagttttgtttttgcttttgtgcatgttatcggtttgatctgtgttaccaaaagaacattgaaaataatgaattgctttgatgagaattccaaggaataatggcaaacaagtgtgtatatacaacagtacgtaaacagaaatatgtaagccgggcacagtgcaggcacctctaatcctggctacccaggaggctgaggcaggaggatcacttgagcccaggagttggagctgtagtgtgctgtgattacacctgtgaatatccagtacagtccagcctaaacaacctggggagaccccacctctaaaacaaaaaacagaaaaccccagaaatacatagaaccaacaagaataccacatacttttcccgtttgatacaatgaggtaagaggagaaagttaacgcccagggcagttcatttaagaatgcctgaaaaacaccttcatttcaaaggatgttgtcatctattctttttctcttttgaaattgtgtagtaataaaaggatgcatcttttcagcacaaaaatatgggaaggataattttcccccagttgtatacaaaagtacttactcccaaatggggccattcttttctattgagtgccctactggtctttcgttattctgttttgagatttttatggagtttggcttatggggtaatcaagccattctactaaatgtggcccttttgacctttggagggagatcttttgacctttggagggagtacatcttttacatccatacaggagcagctattttctatatttctttcacgattgtagaatttcacttaaatttaatatccaaggttagtctcaatgtccagcacccctttaacttggttgagtggggaaccccatgtggtcccaggggactttcttaaaagctctagcaagtgtagttgatgggaaactttatttcagttcccgtttgcacctttgatctcagaagttgctgggatcaggtgacgggcattaagagacctgccttttcacttggaagttgagcacttgctgaacaaaaaattatctgtaaatgtcaagtgtgtccctttggtcaaaatggaaagtggggaggaagggaaggccaagaaaaaacatccgtgtgatgttaaataatgtttgactcatttcaatagaaaacacttctcttttgtatgttcaacaaatgtatttgttttaaaagggaaaaatcaacttgtcaactattgtttcttaattgtgatgccataaaagactttctggagattaaggaaaacattcattttcagaatgtagtctaggctgctgttttttctcatacagagacagagtctcgctacgttgcccagggtgctcttgaactcctgggctcaagcgatccttctacctcagcctcccgagtagcttggactgtagtacacaccaccacacctggctaatttttttttttgtagagtcagggtcttgctatgttgcccaggctggtctcgaactcctgggctcaagcaatccttccaactcggcctctcaaagtgttgagattacaggtgtgagcccctatgcctggcgctaggctactttcttgaatgcagtctcctctggccagttggcctttctctcccttcccacacccccagggtcattgctccccatggtcaaaggctgttcctgcatctttctctgtccaccattgaccccatttgctgtgggcgcatacccccgcaggtggtggagacaaggacccaagccaggagggttggtgccaggtcctgttgctggagttgtgtgatagccttggagtttcctttccctccttatgccacactcgcatgtcattgcctgtggttttgtctttgctctctcccatgcagatccggagttaggtgttggcacgctaccagaacatgacagccaggatgcagggccgattgtccccaagatatcgggtctagagagaagccaggagaagagccaggactgttgcaaagagccaatctttgagcctgtggtgcttaaagacccctgccctcaggtcgcacagccaataccccagccgcagacggagccccaactccgagctccttctccggaccctgacttggtgcagcgcacagaggccccacctcaacccccacctctgagtacacagccaccacagggccctcctgaggcccagctccagcctgccccgcagcctcaggtgcagaggccacccaggccacagtcccccacccagctgctccatcagaacctcccacctgtgcaggcccacccctctgctcagagcctctcccagccattgtcagcctacaacagcagtagcttaagcctcaacagtttaaggtgagtggcctgctcttctttggcctgacttttgccctctccctggggatcaggtgggtgggagtcggggagggatccctagggagactgaggtttccttgttggaaacatcatccttttctctgagactagagacagggaatggggctgttgggtgagactcgggtctcttgggaaaggacaggttgggatgggtgggtggtgaggacattgtaaagaagtaaaatatttatgggcactcgagagtggaggcggaaggagaggaaggcttggaaagccctgggccagggagacccagcagcagtgggaggcagggagtcgaagcctggggcatatcagaggccatgcagtgtgagcagatcctttcaagagaggctctctgcctctgatggaagaagtgttaaagaaaactcgtctccctgcagctccaaaggcaggaagattgggacctgatgagtattccagcttaaggattttttttttcattctgatttacttcctcctatgtgggtcagagaagtagggaagaaacaaaacaagctgcatttagagaaagtgagaaatttctttatggaaatccaggctctctcctctgtcttgtttttgccaagttacaaagaagcgtctaaaaagcagcacagaggaacacagcaaagaaaagagaggcagaaacccagtgtgcagcgccaagtagagccgagccctggtgccccgggggctataattctaacccggcacagctcctgaggctgtgtgtctttgttactgtttttcttttgaaaacctggtggctttggtggttccgggccttgctttttcctaagaggggaaagcacagtctttggggggcaggtttcctccttccccaaggagccgggcccggcttctgccccctcggccgtttctgtggcctccagaccataaagtgatgtgagaacccaggcacctgggtttcacctcttctttgtgtgtcttcatttaagaggtaacaagacagatggggggaactcagatcatcgctttttttattcctttttgttaaccgttgctttataggagatgtagctagtggaggatggaaggctggggattttctaggggcattgatgagaatctggccacaggagcgagagaggccctgaggtttaggcagaatgagctgtctcgacaccaagatgccccacagccctgaagcagcagtttcggtttgctctgtctgcagtagcgatgggaaagtttgcaggagttgtgatttcagaaagtgtgctcgtacagggaggatctgtaaagaggaaggggcaagagagactgtggtgagggtttaggggaaggaggtaggattcttttaaagagaatacattgcttacctttttttatttttttcttttcttttttttcttgttccgatagcagcagcagaagcagcactccagcgaagactcagcccgccccacctcacatctcccaccacccctctgcctccccgttccccctctccctgcccaaccacagccccctgcacagcttcacacccaccctccagccccccgcacactcacatcaccccaatatgtttgcccctcccactgctctgcctcctccaccaccactgacatcaggaagtctgcaggtggccggacacccggccgggagcacttactcaggtaggacggaggggcctgtgctcgtgaccccgacccccaccgcccctcgctgtgacctcaccctacctatgttgtcccgattgcaaggttgcatttgcctacaattttttccttccttactgtgatcttcctcaaacgctctctggcctgaggtccagcaaaaatacctgtcagcacccatactaagctagctcagcccctgtgaatcagacactgcccgaagagagtgggtttgtttggagttaggaggcatttccagctaaattcagccactgagtggtcagacccaggtagtgtgtcccgtgtcgtctgggctcccctgagggcgatggaagcgtccccaagcccatgtctgtctcgctccaggatcttagattgtgtcctggtttaaggggtttcttttcattgggcagggcagggccttctcctgtctccttgggaggagatgacacactctttgtgacaatatatcccagaattttaagggcagatctcatgttagacacagggtccttgtctcctcacctgtgttaatcaggtcaagcgtcccagttttggtccagtgtagccatgttatgccgccaatacagagagccatatagcagtaattgacacttgaagaggacatgcgagccctgccgtgtgaacagctgacatttattagtgtgctatcactgttcccaagcacttaaacgtgcaaattgctttaaccctcaaaaatcaaacccatgagttaggcaatattattgtccccctcttggagatgggaaaactggccctcagatgggttatttgccatgcccagggtcactcagccagtggtgacagctggaaatcggactttggcatttggcctggagtttgttccccagattgatagactgcctgtccctgaaagctgggagaccagctagagaacagggagacagggtgcgaccgggccttggtctcgtctgcttcattgattgcccccgtttatctcagggcccagccacaccctgtcacccctgccactgtgtcaccagccccgtacccctccacaggaaggcagtccgatgtccttttctgaaggaaaaggcgtcatcgtctccctcttcttctcttccagagcaagacatcttgcgacaggaactgaacactcgttttttggcctctcagagtgctgaccgcggggcttccctgggccctccgccctacctgcggaccgagttccatcagcaccagcaccagcaccagcacacccaccagcacacgcaccagcacaccttcacgccgttcccccacgccatcccacccaccgccatcatgccgacgccagcacctcccatggtgcgtaccccaggcagaaatgtgaggataagtagagcacgactcttttctttatgcagcacgtgggaccgggctgggcagcggggccaccagagatcgaatggggactgacggctgttggctggagagaagggaatgtgtcctagtgccctgcctcaggcagctctgacttcaggggcctaaagtaggaacttctttctaggcagttgtatccagcactgcgggcggaaatgattccatctgccctcaaaacagtcatgtccagtgttgatggctaacttcttaaagggttgtttagttttcttgaacttcccgggggactgtcaccaggcagaaaatgcacctgcttgtgctttgcatcaagtgctagcacatacattcttgcagggtaatgggggtgaagaagagagaagagaagggagagagacctctgccaggaggctgggactgcattgggtgccacctgtgcattccgatggcttccctaaacccactttgttggaggtgttatatttcttgtgtttcataagacagtccctaatctggtattgtgctctgtcagccagtgttcagggatccccgcagggacagaacgctctgccttggggcaagaggaaccactggccatgacatggtcttgctttaactgggggctagcacatgtccagaaccagtgaggaatttttttttaagttaataacgataattcatagtgccatattagaatgctaaatattctcagatagagtcctgtctaacagtgagtattagagtcattttttacttatttaatttttaatatttcaggaaatactggattttaaggccattactataggcattgtgagaataaattgcatgattttaaaaggagtccacttcacccaactttgcttcctctccttcctctccctccccccatcttgtttaacttactttttaaaaatgtgtttttaaagtttgttttataaatttcatttcaaggaatattagcaatgaggccttgtgaccagaaatatgttcttaatagcaaatcctgtatctcttttttggatgaattatacttaacaattagattttgaagatcctaagattttgagaaagttttctgctggcctgtgtgagctgtttcacaaataaatttaaccaaaggtagttatagcatcaatatgatgacattatttagagggaacaatagtatactctttttctgttccaatgaaaggctgtctggcctaccccagatcactttgtatttgggtataatacatttcagaagacagctgcatggcaagacagtttttctgccaaagtgaagatgaaaatagggggaattcactgggtaaatcagaccaaatgctcacctctctctgatttatctggataattggctgttctctcctgtttagaggtttggttcgtgccaatctgtagaaagaaaatagtaggaagaaaggcatcctagtacgtgcagaactaaaacgtaccacttggtttttaattttgttcttccatttctgttggcttcttgtcagggagactcaggagctcagaatggtttcatatgtaatgaggttatggggtctcatgacagcttaatgacagggaagctttgtagggccacctccactgtagcagtgaacaaaaatgcagattaagtaactagcttttgctttgatccctttacagtttgacaaataccctacaaaagttgacccattctaccggcacagtgtgagtttcattaccatgctacacattgaatgtaactgctttgccatttttgtgctcttgccacagatcagtcaatgactagcagccttccttaatcatctttgcaagagttcccattgctcctcgccactttggatgcttgcttttgtggtgttttgcttttggtaaagatgcagtatcatcttctgaatcaaaagatcataagcattccaaaggcttgaaagcagagttgctctttagtggcagtcaggcatctgtcctgcaaagtgagatgtctgcaatggagtcagtagagttccaggagagtctgaaatcacagcatttcagtcgtcagttgaaatgccactaacacagaagttctggaatgcaacctgaattatttcctcttaaatagaaagtcccttgtctttttgactcatgactcttcaacaagtagattttcatttgctctagactaaatgtagaaccttcttccacatggctggtattgttctgttgagtttgttacaatagaaagtaaaaatatcacttaattaaaagaaactcccaaaattgaaatgagtgatattttctctttaaactcattctcctttatttaaaaaaaataaaaaaaacttgttttatgccattttaagagtatgttctggaacttcaattgataacaccctaagttataggttcagttaacttgtaagacaagagcttatttttattcaaagaccttgaatatttccatgatattttgatgatggggtgaatactgcatcatttttatctgaaaatttgcaagtttctttgccagtgatttcttttttttttttttttaatgaaaccagaaaaaagagaaggttaatcatgcttgtagccgtgttgattcaccatactcaactgttcttgcttaggtttgtagatagtgttatcatttgagaagtgctactttaatagatcagcaaagactgaattcattcatattctgaaccagataattagataccatgttagtcaagaggttagctgagaagtcaaggctagaaaatattagaaatcaattgaaaattatgtactctaggggcatttagaaataacgtaagatgaaagacctcttcaaaaagaagttagaaaagtgtatttgagtgatgcctcctccccctccctcccaacatggtccccgctgttctgctcagtaccagaatacaaaaacatatttcacggggacacccaaagcccagtagacctatgggtttcctctttgggtctggcccatggatgccaccattctgcccttagtctatactctgctgatttaaagtaaggaccagctaacaaaataattcaggctgggtgcagtggctcatgcctgtaatcccagcactttgggaggccgaggcaggcggatcacaaggtcaggagacggagaccatcctggctaacacggtgaaaccccgtctctactaaaaatacaaaacattagccgggcgtggtggcgggcacctgtagtcccagctactcgggaggctgaggcaggagaatggcgtgaacccgggaggcggagcttgcagtgatctgagacggctccactgcactcctgcctgggcgactgagcaagactccatttcaaaaaataataataattaatatagaaagttgagcacccaaaaagtggctcagatttactttctaggacccactgcggtgccttctgatacgcatattctacagtcctaggccaaagatggagaataagcctggaggcctgaatttttggaaggtgtatgtattattacttaggcgcttcaggtttttagtcagggggaggaatagtcagctatatttatattctaagaggtcaatgatggaataaagcaaaaagaaagtggtaagaacatccagtttttaaattgtaaacattaaagggaaaagcccacctggaggcagaatactagaaatttgagtgtgtttcactggggcatgtatttaattactcagctttattcagtgtactgtgggagagttatttcatattaggagttatagtggataatatatgaagtactcagtctcccctgctttggggattaggacattataaggggaattaagatgcaatgcactcaagtatctaaaacacaattttagacttaaaagtagttttaaatgagggcacttggcttgcaatcactgtttaagtggatttagttcaatatcaattagtctgaaaaactttgctgcatcattgaagggagcaaaatgaaataaagaccaacagaaaaaggacgtgctctgaacacgggattgcgaaatgtgaatttcagtcattaccaaaaataactaacacaaatactttattaagacgagcttcaattattgttgtaattttgacataataaaccaccacgaaggtggggcattatttaaaatatttgtatggtggcttgataaatggaaacaaaccaataggacctcaaaaagattaaatttttagaaggagggaaagttgtgtttgcattgtcttcagattctctgtatttttttcctcaattgtgtccttttataggctgttgattcaggaaaattcatagtcttcattcagaatcattcttttaccatcatagagtggactcctacgtgaagggcttggcttgagtatcctccaaagagcttgttcatttaatagcagataccattcagaagtggccataaaaactcagacttcatatgttaatacggaagtgctttgagtacctgagacttaaacaagagcaactgaaagctcgatagtgatattccagactcgggttatttctgtgcaactagaatccatcttctagacaaattggcagctccatttaaagtatacatcgagtcgttttattttaccctttcacaaatatttgtcattattttagatgagagaattaaattgtcctctggaactgccacttctgcaacaacctaatgaagcaaggattgtgaatatactctcatttcctcaaactattaaaagtctgaaagtactaattgagttttaatggtataaaatcctggcactcatgaagacttctttttcttccccctttttttttcttttttctgtctttttccccctctaattaacttgtaattttctgggcatcttatttggctcaggatccctcctgtttttgaaatgcattaaaatctccaatcatttaggacttctatctgatttaacaattaataattagaaaagctccctttctaatgatgccctcacccgggatgtcatttgctggctgattgatcctgaactacttttaactttttaagttacacattcgtggcacgtctgtgtgatcattccatcatggcttcttgactaatggcatcaaactgagattacgtggcttgctcatgtcgatgtctttctatgggacgggaatttgaatatgtcacttgcctcctactaaaatcttttttccccctctccgtctttggccacagctcttccattcctatcctcctgcagtgtcgggcatcccccctatgatcccacccactggcccttttggttcactacaaggagcatttcagccgaaggtaagaaacctcacagtgaaaacacacaggcatgtgtctaagtggcgtcccgggccaggcgtgcaggaagttctgcgtcctcttgcctgtgcagtgactcattaatcaggtcctaagtgaccactgggattagagtgagcctatttttcttttttttccaagtccatctagttttaaatggccgtgaaaatttacttttcaaactgtactacccagataatctcagttaagctaagatttcttgtgctcttcaaaatatacacaatatttatttttttactaccaatatcgtggacataacttctggtcaggaattctatgaaatatcagacacatgtgcgccaggttgttccgcaggtgtatgtaattagtaaagacacaaagctgggtccttactgattttagtagaagtggggataaaggttccacaactaaaattgtatcctatgaattctcattctccctcatttccctcgccaaccccatcggctgcaaacagggcctgccggcaggtggggtggtcgcctcccattttggtcctcctttctttctccctctctctcagccatcccacccctgccatggttacactggccaaggccaagactttgtcatcagttactaacatcctagtgtgaaattaacctttcatcctttataaaaatcaaattctgttctacctagtcagtgataatgccgtccagcgttggctacagctgtctctaaaggtcaatattgaagagtcattctcgaaacactctctttttaaatatacttacaatttctattttaccttcacacaaaaataaaaagagccgtactttcatgtgggtaaccattctcagacttgaagatattctgctgtgtgccattgggttttcgtttttcttttccccaccatctcatggctaaggtaaaacacagttttggtccagagtcttccaggataagcacataactgcatttccaaagacgtgtttcattaaaagaattaaaaggcattagaggtggggtcccctcccccttcaaaatcacctgcattgaattgcattgaattcagttcatctattgaatttgcctgcattgaattgcagcctatatgcaaggttacagatatacagggcttttatgactgcctcgttaaacacctcctgtctggagataaaatgatggtgattttaaactccttcccccagtctgcacctcactactccctcagaccctggtctgtcccctctaggttacaccaaatctctggggcctccccaaacagactggtaggtcatttaataaattagactatttccctcgctcacaattatccaatcacacagaaaactacatctgggcaagaaagtgtctctcctggtgttgaaataggcctttccaggccatcgtcctgattgaatatgtagattgcagttcattagtggagttcttcatatgtatgcaaatcaggttgttaacaactccagcttaattgttagttgtactgcagctgattgcttttctttctttcattcttttcccccccttctccttgtaggcaagcttcgggcctaaacttgagctccttttccccacgagtttaacttcctggtgtggggggtgttcatagaagttgtgatttcttccataaaatagctggtgtcgtgtcctgaatcctttcccactagaaatagtgattgtgcccaaagtaggctttttattgttgctaattcaaaggacagaagctcacagataaggttaatattagcaatatttgagaatggtggtgggaataggtaagagcaagcagaattgctttagaaatcatcaaagagcagatccgcaaggtccctaaattaggttctcttgtcccatttccaccactgctaatgagtaattactgagtataattccttattattgtctaccagttaaaacggagagcttaatgtctgtaaagtacttccagttattctgatgagaaacacctgatactgccaattataataatgttcacttaagcgtttcttggaatgtttggtgattaagcaaaaaaacagtggcagtccctgccatgggttcattcagaggaagaggagttccaggacagcatttacgtttgttgcttctcttttttggtcctgtgctttttattgcagtgaaatgttctggggacctctctctgcttttacatgccattgctggagagagcaagctgtggtcaggcccccttgagaaagagcatgtgtggtccctgagaaaaatgaatcttgcgtttcagaaggaaacaaacaaatgaagtttggcttctctcatttagcagaagggaaggatcttgctttcatgtcacctgttttgtgcttcctaagtaagctgtggtctaattaatttgtagacatccaaccctatcgatgtcgctgctcggcctgggacagtcccacacactttactccaaaaggacccgagggtacgtgcaaagtcaggcttggtctcaggtaacaccagggtgtgtgtgtttgcacgggacggccagcccagtgctcgcatcttccttagctcctttgagcgagctgctgtttcagctgttcttctagtttgtggaagaaaatgccaattactcttagaaaacacagtctctcctgctcactgcgagcataggacacaaagagaccgacttgccgatgggagaaaagaggaatgagttacggtctgagcccagaaattggacagtgtcagcttgtatagtttttacttaaccaatcttctctgtctgtatctccttaaattgtcttacacaaatgaagtagctacagaatgttttgaatggaaaagcactaaggcgcttttcttcctggaagtcaggctacacacatccccccgcttgcctggggtcaggaagttattgtactgcacggctctttggccctctatttttaatgtgctagggatccttttgtactctagagctaaataaaatatccattatgctttggttatgttgtttattcataatttattaccactgcctgcttccaaaaaaggaatctgaagttatacgatagatacaatcttgcctcattgttatttgtagtcatctttatacgaaatatgaaaaaatctttaacaatattgtctttttacctacataagggcagtcagaaattgataaccagagttagatagaagtttaaaatgactcaactatgtaagtatgtcatgatgtatagtgaacttctggaaaatgtctaatagctataaataatgtaaagtcatcaatgtaagggtattggtaaagagagcctaattctcctggatggatggaaaggacacctctccccagataccagttagtagacagctttaaaagccaggggtctgaaggccattctccctcagacctacccggtgtggtttggagctcaaaacagtgaaactcctggtgtgtgatgtgagcaaatcatgttgccagagggcacattgctattgattaaacttgtacaggggcttgtcagcgtagatgtaccaaggcttgtgaagtgggggaggggacacttggcacttttgatagtgtgaaaatgggttaattattctctaaaagggcttcatttaaaagtaaaattctaacattttaatttcccctcctaatgaagcactacaaatttgttaattagagcaattgtttgagtgacaggcatgtaaccaagttgtcattttctcttcacagttgacagatcctttcagacctatgttaagggtaagaaagcttcttatagaactgttttgcaacctctatttgactccctgtgggttaaaaatacaagtctattacaaggaaataagccatagaaatgttggaataagacattggaatgacggtgattgggtttttcagatagtgtgattgaaaatggcctaaactgttttgctttgaccgttggaggccattggctttttttttttatctctacaacagagaaaagtcaacgagtccgatctcttgttagcagttctggtaaaaggtttgactagttggaacttaaggggaaagactgaagctataggctgaagttagtctctcttgcacttagaaaatatgtagctgggtccatttattttggctggtggctccctctttctgtagtaagtgacattgacttgccatagccgtttgacctccttttaaggtgcaggaaggaggtactataagcatctggtttgttaacatcttgcttaaagcaaattgttctcgaggtctggagactggccagtgtgatgacctctaaatgaatcctggtggttgggggtaagacagacatgatgaattgttggacagaagatggatggacagcagatttcttgctatgcataactcatttctagggcacataatcagataatttgatttctccaggggaaaaaggagaattgtgtcatcacttaggtgaggcagtatattatttgtgatttcaaactacccataatttcattgcaagagaagagaactgacccagacttgcatttaagtatatattttcggaactaactccatactgtagaaaccagaagcttctgttcttcgccgatgtagaatgaggctgtgttttcttctcatctgtccagtagtcactgagcgcgcacgccgagcttatgggtagattacttagcagaaatgaagtgaaaaggtggtccctgcccgctgactggtagaagagaatacactcacagcactccactccttataaagcaagacatgaaataattggggagatgtggattcaaattcaaccccagagggtggaggatggacttgagatctgcagaggcctagatagagaacaggaaggaaggaatattcttctctttgtttctttctttaaacttaggaacagcgcccaccaacacgaatgggtagttgactcttagcatttacggtaactgggcttcaatcaaaatgtgaatttctttgtaccactttgggggttaaaataaaaaccaccacggtcttgggggaggttaggacaggttctgtaccctctcttattttgatttgactcacagacattcactaatgagctcttctgaacagctgatttgcattatagcatggcaacatttgttaagtagggcttcccactctaccaggtctgccagctggcagcagaaaagaaagagaagaggcacagagtgggattcaggcttttgccgtcttgtccttggtaaccggggaggcccttgtcaatgtggttttctgagtagcaaacccacgtggggagagagggggagctggctgtgactcccttatgactgggcgctggagagctactgatggaaggcacttggagagtacaaagcactcttgtttcacgaaaaaagcctctgcagccaaaatctgctgaaagctttggggaaattgaaggtggttttctctgaaatgtcttcctcctaaccacgttgctctttcttgttccagaaaccagggaagtggtgtgctatgcatgttcacatcgcctggcagatttaccaccaccaacagaaagtcaaggtcagtccgaccttcgtggtgtagggaagaatgggatgcacatgtgagtgtgtgacgtgctcgggagaacctgatgaaggaggcatttaaaacacattttacagacccatagttaggaaggatcaagcctctcttggaaaagctactcagaagtcttacttattttttcctagagtcagggtctcactctgttgcccaggctggagtacaaggggacaatcatagctcaccacagccttgaattcctgggctcatgtgatcctcccacctcagtctcccaagcagctgggactttaggcatataccaccatacttggctaatttcttgattgttgtttttgtagagatagataggggtctcactgtgttgcccaggctggtctcagactcctggccccaagcagttctcccacctgagcctcccaagtagctgggattacagtgcaagtcacagcagccagctcagaaatcttactgttaattagggaaaccactagtgaaattacaaaacaaaagcaaactgataatgccccagggttttgttccctttataattttgtcattttattgatccaaaggtcttgaatatggattaaatgctaaaataaagcttttggaaataaaattatagtgaccaagaattagaatacagaaaatactctgcatctgggaagagctacaaatgaatgttgggtttgggtttttgtaaaaatagtgactggtgcattcttttcattttatggctgtgggaaaatggtagagtcatgtgtgccctatatgaagatgatgccgctgaactgtcattggtcctcctgatggtcagtgccagggattggaatacagtcagtacttgcaggagccacgttctggctagttacctcgctgtccaaagacgatttttcctttttgtctatattttcatcatagggatgaacatattccatgttctgctagagcctttatgactcagtaggggagagatcaagaacttctgcaagtccctggatacagcatcagcgcttggcttagggaacaaagtaactgacaagtctgtattttacagtctgggtatttataggctatgttacgatgcctgcaaaaatgggagcaaacaagcaatcaagtaactccaataagcttcacttaatccatttcttcatgaacaagcttttagtcctaacagcatttgggagttctcatgaaagaaatacaggagaccaatgagccaggagatagatagagctcttcatcacagaagagacatgtttttaaaagggttacgtgatttttaaaataaaacaacccaagttccagtcactctagaggctgaggcaggagaaccccttgagcctgggagtttgagtccagcctgggcaacatagcaagatctcatctctaaaaaaaaaaaaagagtaaaaaataaaaacccggttaaaagttttaagatgcaaacctcagtaaatgaggtcactaagatattttgctttggttgtcagatacctgctctttcttataacatgccatcagtgagtttggctcatttgtactttattgttaggggaagtttaattggaagccttgtggtctatcttagaaaatgtgtgtgctttgaagagctaactagattttgatgattagttcaattcagtttttgttctggttgatgtggttagtggaacggtaggtaaagcacatcttccttgtaacttctttggttaaaagagatgagggatgttgcacgtgccactttagcaacttctttcccataaaagtgtccccagtgacttaaactttcattatcccaattcaattagaaagacctcttgaacatgagataacttcgttcatcttcccttttcagcaaactgcttgtaatccccaagctccattttgcttcatggccctaagttgtggttaatggaactgtgctatgtaccatgcaatattagcactaaataatttggccaccaaattaaaggaggtattcaaaagaattttatagattcatagtgaattagaagcttggttttgaggcttggctattactcgatactgggactttcattatagcattccctgtagatttgagcagaaattacatcttccctctctctgtaacgttcatttacgcattcttttagtcgttcacccagtgtttattgaaagagcctacgcctgcaggttccttactgtggcgggctgggggcatgcatccttcctggcgtctagttgcttagagttcagtaatgaggatcagttgtgtgtaaaaagtgaggaaagtgtgtgtgccctcttaatgggtggtgtcatttccagctggaggtgcacgggtagcttttgctttcagtaggggtgatgggtgagtgggacgttgccgtcagcagtaagagaacagcagacttccctgtctcagatcctcacgccatgctctgtcaatatagatgccccctcatggggctttgctgttgtacagcagggcaaggatccctcaggacatgagggagattgagctgaggctagaatggggctaaaggggctgagagcatcagatgagtccgggagatcagaagagtagccaggcacgatggctcactcctctaatccaagcactttgggaagccaaggcaagcactttgggatcgcttgagcccaggagttcaagaccagcctgggcaacatagagagagagacctgtctctaccaaaatgaaaaaacattagctgggcatggtgacatggatctgtagtcccagctactcaggagactaaggcaagaggatgcagtgaactatgattgtgccactgcatttcagtctgggcaaaagagcgagaccctatctatctcatctctttaaaaaaaaaaaaaaagagtgaaagtcagaagcaggtactaagggcagtgaaaacccaggagactgatggggaagaggtcatagcaagggaaattcaactagaagcttcaagtcccaggaccccatgccttgggagcagtgcttatccaaggcagtgtgaagccagttcaaagagaaagctgtcaagaaacaaggaggtggggcagctttgaaaccatgctggtgcaagggcctccagcctagagaaggatgccaggggaaaagattgagaggaagattaagacccaatttctactgcctaagaggatggtaggcggaaagattagcctgaggatagataaataagacaaaacagagtgatttctgtccatgataaggacttcacacaagagtttgttttttttttttggagacagcctcggtcacagcaacctccgcctcctaggttcaagcaattctcgtgcctcagcctccccagtagctgggacgacaggcgtgcaccaccacgcctggctgatcttttgtattttagtagagacagggtttcaccatgttgcccaggctgcccttcaactcctgagctcaggcagtccgcccgccttggcctcccaaagcgctgggattatggtttacttgtctggatggacactgccctcccccaaccttcctcaggtaattacaggtagtaggaagagaaagggcctctgttagttaaattaatactcctactttgtttttctttgttattgttatataacagtgatcatttgaaagttagcttatagacatgcaaatatttcttcataacttttggttactaatgtactgtgagctattagagtatggcaaagagtcattaaacaaacaattaatttatacagcagattgttcatgcagaattcctaataaaatgagctttaagacactattattttaaaccttactaaaatgggcctttacagcaaaacactgaactactttgggagtggtggcagtctccataaataggatatggttttatttctcaagccattaaccttgaagaccaaacatagctgggtgcggtggctcacacctgtaatcctagcactttgggagaccgagatgggcggatcacttgaggtcaggagtttgagaccagcctggccaacatggtgaaaccccatatcgacaaaaaatacaaaaattaactgagcattctgggaggcacctgtaatcccagctacttgggaggctgaggcaggagaagcatttgaacccaggaggtggaggttgtagtgagccgagatcccaccactgcactccagcctggaaagcagagtgagggagactccgtcacaaaaaaaaaaaaaaaaaaaaccagaccaaacactagtgttgtcactagacatttctggtgtaacaggcactaccggcctgcagatctgacatttgagggtgaaatggtttttgtgtagctgctttctctcacagtgtttgtaaacttgaacccaagtgcaccgttcacagtctccagctccagctcttcactaacacctttattccttgctgttggccttgggacccttactgttccccttgctgtgtagaaacagatgcagtcagacccacataagctggactttggactgaaacctgagttcctgagccgccctccaggccccagtctttttggagccatccaccacccccatgacctggcacggccttcaactttgttctctgccgctggtgagtgtgggtttgggtggggggacagagctgagaaatgtagttctcaggtaactaaataaatgaggtttgggctctgagctgccgctcagtcaccacctacaaaaatacagttaatgccagcttgcaaggcaacatcgcagcacatccagggagttgggaatcttcattgatacactctctttcattaaaggaggaggcagagatcatctttcccttacagggattcacattgcttcggttcattatttgcttctatattaaaccagtataactcacaagcatgtcagttgctattgagaaagatctgaaggcttgcaagggcagatcggaaggaaacaatgccaggaattatagaaggatgcggtcgcccttaatacggtgcccgcagagcactgtaattttgcaccgggatgctcagtcatgccgtgttttaaagtcctgaggataaagaaaggcgattaaggcagttgccaggagtatggtctgtgatagggaggttgggccactcggttgctggttttctctgctacaaaacgtaatactattgcctggttggttatagcggtggaagaaatttaggaaacggtgtaaacacccaagtgacctgctcatcggatctgtaattcatttaacctctgagaatacacactgtcaagtgtgcgtgtggaaggggtgaggtagagagtgacgattatgctcattcctgctccaggtacaaacaaaagacagcggctgtaaggactgtgtgtgtgctggatgagaacagccctcttggtattaagggtttcttgtcattctgtcttctctaaagcttttttaagtgtaatttctggcacacagagctcagctcagttaacacttaaaaatgatggcactgagctcattctgctaataacttcatacccactatgctaagtagaatttattcttctggacgtaagcagtcaaggggctccccatttctgatccttacgagacaagtcttacagccatcctgccagctgccaccccaggcttttatccaagactcactgttggtggacctctggctcttctgttcaggaagagagaagcacccacactgcaagaaatcatcattataatgggccttagctaccaaagcaagtgcgtccccctggagggtagatggaatttgctaaggtctcaggtttttctctgtcagtgctgtctggggacatatttgaaggctctgttaccatggcacctaggctctgagacagggctacatgaagagcaatttttggaaagaatagatttctctctggcttccatttgagccaagtggatgaattggcttcttttgcttcaataattctggaactgcaaggcacccctgggggccctgggctcagcaaagctctggtcttcattgaagcattaattagcttgcactacacagacagtatgtggccaaaattttatttagctgacaacactgctaacggcctgatgaatattctggaatatattcacttggtggaggcggggtatcatttttacacttcccaggtggaaaataagccagtatgcagggctgaatagataactcctcaggtgtcttccaattccgaactactgtgacggggatgatgttcctcctgtactgagtggcttcctctccaaacccaggccacaagacttttgcagcccagggaacagcagtccaaaacataaatcgagttaacagagtgtagacagcaacaacccctacgtttaatccattttcctaagggaatttatatttgtttataggaacttagacaaaatgcaaaggattatggaacagtttttagtaaattctttatccaggccttgtttatacttccattctagaatgtaaccttctttagcataagcagtatgggattctgcccaaaatagttatttggtgaaccttgtaactgatgtgtataacttgtacatacttaagaaatccagccattttcatcttgctattgggtgctaatcccatgaatataaactagagacttcttcagatgaccctggcaaatctctcgtctaggacaaagcctgccttccaggaagctagcctccttagctagtaagtagcctcgtattaacaagcccatttggtgccctaaggcctttagaaatgtccttccctaattcacatttgcacactctctttctctgtctccttccttccttcctttcctggcttccttcaggaacaggaatagaggcatcttcaagaagtacacattaggcaaaatacagagaagaggaggaaatgtggatcaagggacaactgaaggaaaccactaaattagacctgagttccctggcaggcaaagcaaaaacctgtcagagtcagttataagattttcagtgccccaaaacataagaatcaaccagcttttcctggcattgaaagttgagagacatcagaggacttcatctcctaaaacctaattgagctcacaataatgagttttatagagtcgggtcttatagtatccttcgatgtgggtgcatgcgaactaacatactcttcaggagaagggattctgcaagtccccagagcagcgtagccaagaaccacagcttcaggaccacccctcctgagccagagatgataacgggctgggtttctggaagtgtttctcaaagtgaaaacttggtcctccgagatgctctatgaggagtggattccatgatgaaatgttcccctcttagagaacgaaggagcctataagcttattaataagcttattaatggctctaagaagcccttcagtaaagaaacttgcttagctttttttaatccagtatttctccaaatttacttggttataaagcctcccctcctcccatgacccagggcagttatctctgtctttgtaatactgtgtgtcatcggcttaaaaaagaaatacctgtttttggtggtggccagccacgctgggaaagagaaagagggatgattgattttctgcttcctaaaaaaaaaaaaaaaaaaaaaaaaaaaaaaacacacattttcttttaccctgtgtcttgcctgcaggggcctgggtggacttcagccatgacctcccttgaacatattttctcacggggcccttaagcaagtagaagccggttgcatcttcgaagttggctttttgtaaactctggtttcgttatgtttgacttaacaggtgctgcacacccaactgggaccccttttgggccacctcctcatcacagcaacttcctcaaccctgctgcccacctaggtgagtcgcccaaaataatgggaactgagatgtgtgcttcaggcaaccctgctgtgtttaccatgctcccgctgcacctccgggcaagctggtgggagtcccagataccctgcttaccatttaggcaggagatggtgctctcttaggagtttcagtacatcccgtccagcttccagatttcatctcttacaccgcattctttcggtagtagagctgtgctcggcagtggttctgcctgaacttcccatggtgcagtgggtgagagccattccttggtatctcagggaatccgagtttacaacagcctgttcctgcccattggaagaagatggtgagctcttgccccatagcaaaggtcacctctaggaagcggaaagaaacacaagctgacgttatggagaggagttattctacatctcactgccccgataaatgagtctcttcctaataaaggtgcatgctttgtgtggcctttgtgtattcgatcccatctgcaagtgtacaggcagattcaggcattggcttgcacaacatcagggcatatcataggcacgccctcagagtttcatcatggattcagatgccacctcctttctgttctgttagaatctgcagagtgcattcctggcagaggcgagactgggcgggaaggcaagttagtacatcctagcttgagtagtgtccccactgggcaaaggaagagtaatacaaaatacacagttgtagaagaagagtcctcagaaatattttgctaacccagtgcctaaatccaagtgtaatgaaaaccttttacaccatctggtaggaaaagtgggacaggccaggtgggggcgtagagagggcagggatcccgcatcgccctgctcccaggaagctctgggttcctctcccagcagagcccctgaccatttccttcttccccatcttgtttgcagagccttttaatcggccgtctacattcacaggcctagcagcagttggtggcaatgccttcgggggacttggaaatccttccgttagtgagtacctctaacttttaaaaatctgccttggactttttatctcctgtgatccgcatatggctcaagacctttctagagaaaaggaaactatgctctggggggaccagtgtaggttatatcactgcaaaagcaggccttcacagtggggtgaggtggaagtgtgcagagccaccactgtgagggcagccccctgtggctatccagttctgaggggcaggaacggcagtgtagttgatgaccacagaaagtttactcaagtgcggagtttcatccacatcccatctctgctctccaagattttggctgcagctcacattacaagtgaaagcaatagttacagcaattgttacatttcatcttgcccgtggcattcgtggaattgaaaaaagcacaatgaaaaatagcaggaagacaccaccaggctgcgacaccaccaggcttgggataatcaagatttggcaccattttattctccatcatctaggaggactctgcagctttctactattaaaaaagcccatctcgattaggagaagaattacaaccccatctcacgttctaaacattagtgtttagtcgctgaatatgcaaattattttctttcatgctacataccatatattccgggtacaggaagagctaaaacgtgtctctgagcataccgtcacaggtcggtctttatttaaaacacaggaaggagacctgtgtgtctggtgagggcaaggtcctgtctggtctctggtgacacttgagagggccacggtgggtagaggagacagtgacttctactgtgaatcaatttagaattgttaatccaaatcccaccatcataacacacccttctgcatgcctggaacttctgcatgcaccagatacgttgaattaggtcatctcagtacccatttggtcccttttcctttttaacttcccctgtccccacctttgcttttggttttaaaaagaaaaaaaaaagctgtgagctacctctccagtgtaggacaagacttcctctaatgaatttgttaatctcctttccttttccagctcccaataatatgtattcattttaactctgaatgctgttaaaagttttttggtaagtaccttcattacagcagattatataatttctcttaaacctttttgttctccacttcaccatttcagcacccaactcaatgttcggccacaaggatggccccagtgtgcagaactttagcaaccctcacgaaccctggaaccggctgcaccgaacgcctccgtcgttcccgacccctccgccctggctgaagccaggggagctggagcgcagcgcgtccgctgcagctcatgacagagatagagatgtagataaacgagactcatctgttagtaaagatgacaaagaaaggtacggaaagaaaccgctctcgagtccccacgggggagcctgctctatgccaagtaccagtggaactggccgcccaccctccctgtcccagcctcgtgctttagccgccccggtagcctcagctcctccccacagccagtgcccgcagcccctcgcagtccccatggcccatagcatatggtgaccgtaggagatagcagagctagcgacagattcctgtctcagtcgcagttatacatcagcacgtcccaagtccctgttagcgtgtccaaacagaagtctttctctagaagacagggagttggagcttcgggccagacacacacagcatgaatcaattccatatttgctttcaagtccgtgcagtccatttaaccatccataggtttttctcgctcttttcctctttttgttttcttttagaaagccatgtttgcattgcctcatcatatttttctcaaattttgttcaaactcaaagcctggggctcacagatgactaataaaattttactcacatagatgtagagaaacgtcgacaagcagttttggtttggttttggtttcactagtggataattttgttaaccgttgtctctgcacttggtaacccatgcctaaaaaaaaaagtagcgttaaacagggaatgtcttggagttttttttccaaagaatatcgtaacgcattcttgacaaaaatgtctttttttttttctttctttaggctatttattttcactttaaatgaactgataaggaatgcacaaatatgcttgacagaaaatacctaatcccaatttccttgcagtatttaagattcaaatttgatccgaatctttaatgtttcttttctttgtataccgtgtatgtatgtgtgtgtgtatatcctagtaatttcaaagaaagaattcaactttgcaggctctaaatggggcagattagtagatactcatcagaggccatcatgctgactgataaaagaaaaacaaattttccttcaaggcagtatgataacaatctcttaaccactgggaggaatgtttatgacattcatctctgagctgtgaactgccaaaatgaggcacgcctagcaacataacctggccgaccctaggccgcgagctctctgtacacagcctgtcactaggtgcaatgcaggatgtggccaccagccctttgcgtgtttttctggatggcgtcaaaatggcctcttggattaaagtcaggaagcttaataaataaaatatactcttcttccatccttcccttaaaagttattcttcttctctgcatgtgggcaagaaacagcccttataggggagcctcctgaatactctgtggtcctctgatccttgcacaccagcaccaagccagcatggcagcctgctgctctcctcaactttgccatatctgtcttggcaccatccgtaagacctgcctggtcttagttttaactcaagttttaccttattgtcattccatttgtttttgcattttctgcccaatactcttgagcccccatccaagacaggtctctaaaattcttgtctcgtgttttcactcacagctgctctctaaaattgttttcaatgtccccatgaggtttcgtgtttagggacctgcttttcctactgccttccctccgtcttctcatcagactttggctttcttatcccatctggtgcacaagtgctctttgcaacccaaaagtcctccaactgtggcttccttttgagcctttctcacgtgctgtgtcttggagatggctctgtatccacgttctttgctctgaaactggtcacttgtccttgtaaggagcaagagacttctgtgacactgatgttgaaccctttcttccactggttcagtgttgcaaagttggaagaaaagtgatactgggcgttgggctcttaaaacgtgattctttacactagatgatcccgggagtccagacagtcgggctggattgccacatcattgccttattgaccacatgcagccatcttggctttctggaagctcttcttctgtgctcttggttgaggctcttaacatgcagagagattcttgctcccagcagactccccctcaccctcatccctggtccatctcccccattaagcttcctctaaaatctaggtaagtaggataagggtggctggctctgccctgtccagggcacggctgctgccttggcgaccatgggaagcagcccccagcctgtcctcttcacaccaccatttcacccgcagcccctggcccggccgactcgcccctttcatttcatctgcgtccttgtcttcccctctctcccccagggaaagcgtcgagaagagacactccagccacccttcaccagcacctgtcctcccggtgaatgccctgggacatacccgcagctccactgaacagatccgggctcatctgaacactgaggctcgggagaaggacaaacccaaagagagggagagagaccactcggaatcccgcaaggacctggccgccgacgagcacaaggcgaaagagggccacctgcccgagaaggacgggcacggccacgaggggcgcgccgcgggcgaagaggccaagcagctggcccgggtgccgtctccctacgtgcggaccccggtggtggagagtgccaggcccaacagcacctcgagccgggaggccgagccgcgcaagggtgagccggcctacgagaaccccaagaagagctccgaggtcaaggtgaaggaggagcggaaggaagaccatgacctgcctccagaggccccgcagacccaccgggcctcggagccgccgcctcccaactcctcgtccagcgtgcacccggggcccctggcctcgatgcccatgacggtgggggtgacgggcattcaccccatgaacagcatcagcagcctggacaggactcgcatgatgacccccttcatgggcatcagccccctcccgggcggagagcgcttcccgtacccttctttccactgggaccccatccgggaccccttgagggatccttaccgagaacttgacattcaccggagagacccgctgggcagggacttcctgctaaggaacgacccgctccaccggctctcgactccccggctgtacgaagccgaccgctccttcagggaccgggagcctcacgactacagccaccaccaccaccaccaccaccacccgctgtctgtggaccctcggcgggagcacgagcggggaggccacctggacgagcgggagcgcttgcacatgctcagagaagactacgagcacacgcggctccactccgtgcaccccgcctccctcgacggacacctcccccaccccagcctcatcaccccgggactccccagcatgcactatccccgcatcagccccaccgcgggcaaccagaacggactcctcaacaagacccctccgacagcagcgctgagcgcacctcccccgctcatctccacgctggggggccgcccggtctctcccagaaggacgactcctctgtccgcagagataagggagaggcccccttcccacacgctgaaggatatcgaggcccgataagccgagaacaggagcaagaacgaggaagaagaaaccctaggcagacaccaggccaggcttgagagacagaactcctgcatggctcacacagactgggggggaaagccccaccccttccccttgtaaaaaatgtatagactcagtgcacattttgaaatgttttgtatattatatgttgagatttttcagatcttttagcccagtcatatgttctcacgtctcctactttttgtttctcgtataaaactttttgatttgaaccaaaacagtgaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagctttactttgtacaaatgtaaatagataaagtaacataatacattaatacttcttaaaatgtgctatttgcaaacttacttaatatcagtgaacacagtcggctaaagctgtgttcccatatattgttatagacagctaaacccttcaactatgcaatgaatgttcgggcttttcacaaaagcccgcctaactcaaaggagccttttcaaatccatttacagcatacttaaggtcatattttccctgaacaagcgcttacgtgatatgactctgttttccttgcttgttttttttcaaacggagaaacatcctgttttgcaaattggaccccaggctggaacttagcatctgaagttgccgcttgtgggctctgggggaaagtgtagccccggagaggtaactgaggacatgagcaaccagtgccagggagggtgggatttgccagatgccaaaatcaggggacgggtggtggtgtctgtcagacacacacaggtcgccagtgacttcacacacacctcatgtgagaaccatgccttttttagtgtgtcctatttcatacctgtacacacttcctcgttttgtaatgagatttacttacacccaaacagatcctgaaagaaagcttcaagttttctcagatgatggatatgttttcactgtattcaataactgacggatgtaaggtgcacgtttcctgatgtgacgcactgtattccagctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtatattaaagtgctatctgacgttgttatcctgtttttgcaa

SEQ ID NO: 1605 - DNA, 1193980 bp, Homo sapiens
gctcgcagtttcgccctctcttccgctaatgattgcattattatgctcccctctctggggggtctcgcccctcttgggtcgctccggagccccggcctcccctggctgcatttcttaaaaatttgggagcctgggagtgagttttctccgaggcgtgtgtgagaggcggcgggggtgttttcctgcgcgaggggcgggtgaagttcattgcccccacttttcccgcgacctttttcggacccgattttggatcgagttgaggggggcgcgggcgttttcggggggcggggggcgcggcggagaatggccgcggggagggctccccggagcctcccagtctcttgatcaaagcattccgctattctgatttattgcttgcttggtgagttatttttttttcctctaaaggagacctgtgtgttcagccattactttgctcggcgctgctcccaggcatctccgaccctcggtgctgtggggagccccacacttgggctcctcgcctctcgccctcgctccccgtccctcctcccctctctccgccccttcccccttttctttctcctctctttcttcccctctctcccttctttcggccgccgtctcccccgcgccctcctcggggcggagggaagccgtgaagggggagggagggctcggtgtcaatttttttttgtgtggctgcggccgtagcctgtggcgggcaagcggggagaccccggcgcagcagaaccatggatggcccgacgcggggccatggactccgcaaaaagcggcggtcgcggtcgcagcgagaccgggagaggcgctcccggggcgggctgggggccggcgcggccggcggcggcggggctggccggacccgggcgctctcactcgcctcgtcgtcgggctccgacaaggaagacaatgggaagcccccgtcctccgccccgtcccggcccagacccccgcggaggaagcggagagagtccacctcggcagaagaggacatcattgatggatttgccatgaccagctttgtcacttttgaagcgctggaggtaagggggaccccccttcccccgggttccctttatgcacgaccccactcggctgcgcccggctctcctgcctccctcgccgcgctccgggctgtctgtctgtctgtctgtctgtctgtctgtctaggctgaggtcttattgttggtggggggagctgggggcgcgggcagacaggcagcaggagggagtcgcaaagccgtgcctggtctcgtttcctcgctcgcctttcccctgcgccccctccctgcaccccctccacagcagatgggcagaaagaaaggggttcgggcatcacaacaatgcgccccctctccacagagagctctgcccccactccttcctcctctccctccccaatcatggcttcttggctggtggaagtctctttgctgggtttggggcgcctgtggacggttctgtgtgctttctacagagtcatatgttcgtgtgtgtgtgtgtgtgtgtgtgtgtgtgtgtgtctgtgtagtatatacctttcccgggtgtcctcgggactggagactgatggggttttgtgatttctttgcgcctccccccattacccccccatattctttttttttttttttttttggtgaagctggggaagggggcgttttctcctggttgggagaaaggagggaggaggggagagaagagggaagggtggaatagctctctgtattctgtatggggttctgttacagaaagggttaattataatattatctatacacatacataggcacatgtgtgtgtgtacatgagcaatttagttaaaggacagaaaaaggtacaccagggaagactggtgggagggaagaataaaatcctagctgctatctgaagggcttgtcaccaattgtccctctccctttccttttttgtgttttcttttttttctttctaagtgattggctttgtgtgtgtctatgtgtgtgtctttctttattccttgggcacctgcagcgttgattttcaaatgcacattttccttccagccaactggctcctagggtagggggaaagggaaaagggagggagggggagactgtccagggttggggggaaactgtctttgcctggacctgtctcctttggtgtggtattggtcattggcctctataaatttaaccgcctaatttcctcccccacctccctgtccccaccccccacacaccatgcacacacacacagaaggctttgagattctgcagagttggtccacctttcttaagcacaaaaccaagatacggtttatagttggcttatagtgtttcatgcacctgatgtgatggtttgaggttcctgaaggaaacttttccctttccatttttttttttgcgttattatggtattgtttcacatgctcagatgcaagctttgttaatgacagcttaaatctcacatacggtaactgtacaggtttagattgctggttctgtttatgtgtttgggtgtcagctttaaatatttttttcaaaggaaggcttcctatcagtgttgtccttttctgtgtgaactgcttttggtttgggctgctggtggtgatggtggtggatggtggccagtggttgggagtaagggaggtattggtggtggtggtggtggtgcaggtggtggtgatggtgatgttggtggtattggtggtggtcgtagattttgatgttagtgattgaatcagttactctctggttctagaattggtgctttattggccaaaattttgagtgttgaggttcaccacttattagaataattccaactgtggctttaagtttgccaaggtgggtggtggttaccatacagtgtgacctctttctgtctctctctcttgttttaaaataggagttgaaatggcagcatgttcctattagaacatgctgcttggaatttggttcatcattgctgtctgtggttgttttggaaagtacttgtaagagctggttacaagtggttctgctttctgcatggttatcctgagctcagcaatcaagaggggccactggattcccacgaacatttttggaggacaagtagggatatatgtgtgtgtgtatatatatatatatatatatgtgtgtgtgtgtgtgtgtgtgtgtgtgtgtgtgtgtgtgtgtgtgtgtgtgtatatctcacttatgcagttctttttgatggttttatttttaacaaataggtatttgactgggcttgtgatatatatctatttatttggcttttgcgagaaaatgtgctcattttaatttattttgtgcctaaaaaacttgtaattttaaaagcagaccaagttcaaaatgtacagttaataccatttctttctttgctctgattatttttttctgctacttttctagattaaaatccaggatattttggttagctgaatactatgtcaccttcatatctaaatatcatatgtctatctatgtgtaggtagaaaaggtctaacttttaaaaaagtttacttaaaattctgtagaaaaaattaaacatacagaagtagacagaacacccaacatccaggtttgagaactaccaactcatatctcatcttgtattttctatatttcatctatttcctctcccacatatgatctcatccatatttctcacacagaaatacttctgtatgaatccctaaaccataatgactccaaaaatcctcagaccccaccaaaacccgcacagcagtattatcacacttaaatgaatgtataacagttcactaatatcaaatatcctgtcagtgtttacattttaagaggcccaacttttgtagggaagccgtaaatacatttgtcagattaaaaacacacaatgggaaatagaaatcatcatatatgtctggttctttggcaaaaggtagttttgttggctgtgtgctatcacattgtgtccatgctggatggtcagaacatatgtgttagtgattgttaaattaaaacctctggtggtccactctattcagtctggaagatttattgaactatcaccaagaaatgtgagggcttattgggaacaggcaactaaactatgagcttggacaaaaatgtgtgttgggggagtgtttgtaaaagttaagaattattatagatgctaagagttatcctaaatacgtagtatgttttcgggccttgtgtttagaaatgaaatcagttgtcaccacatgtcattaaggctgctgctggtatgatattgtgaaaagaaaccagaaatattggcttgcacagctaggtttatagcttgtgccagttcagagcaatagctggcaaacagtggagtagcatactttgtgtgttaatggacacattatttgactccatgattttgttctgagtagctggttttggacttctcttttaaaaaagaggctcctaactcattatgaaatgtgctaatataaatagttccagttcaactgattttactgatactggagtaaaagtgataacttgcctaatgagaacctgcatttttatcttgattattttttgctgttgttggattcttttttgagatgatgaaagctttaggggtagtttgacaagtctcacattttataggcagtgaaactggctgaaacagtttcatattcacagggacacttctcttgagtaattgtgccctgaagttcaagtgtatgattatgaagagcctcatgatagaagataagagggtaggcgaggaggctaaagttgaacatggtgttcttttcattatgcagttgagaagcagaattaacgttggtatatagtatattgtttgtttggatattcttcgagtgacaggatgagagcaaaaatccccagataagatgtctagttttcttaaaaagtggcttttagcaaagtataaatgggaatgttggggtcctactaccatcagtgtgtcctgatgtgttagatagtgttggctttctgctatttgggttttttttctgtgttgtgtctattaggaagccacgtgagtaccatggctgaaaacttgactttgcaaatccattatttttcccctcattcctcttttgtgcactgggttcttagggcagcctccttttgtacagctgaccaagggaagctaagatgaaatttgtggaattagcagaaaagaggccaattggagctttataggcttatgaaagtaaaggaagactcatttctagtggttagagcatcaaaccaagactttgatgcggtcttcacttcctggctctgttttcagggcttcccccacacatcagtagcataagtgggctatacagaatttggtgtacttataacatgccatgttaataggctctcacaatttattatggtcaaatcactttagttgtttaaaaaacaacatgagtcacatgccttctgtcagtctgcagatatttatggagtgcttaatatgtacaaggcactaagaatatagagaaaccaaacataaatctagcgttttgagaaagtatgtagtttagttgataaagccagcacctatgaaataattttgaaacaggtacttgaatgcctgatatcaactaagcgccataggcttttagagacaggctagtgagataggctgaagtgttccagaaggcttcatgggtggggaatgggacctagaagggtgaagtgatttggatatatggggaaggagttggagctagggagagcattctaaaggaataatgaaggcacaggaacaagatgctacatggttaggacttgggggcaaggaaaggctggtggaaatgagtacaaaggtggtaagtaaagagtgcttgttagtggggcaggagacctgtggagacccacatgccaggcttggcctgcctaactagtgtggcctttgaaagttaactttctaaaagcatcatttcctttatccattagtggagaggtttaaactagtttagagtaaagcttctcaagctggaagggaacatagctttacaggatgttcataaattgttttttagtctgaaacagagtgatctaccgccaaatagtttctgaaacttgatgggctagacaaaattaaatggatgccatgttctgtcagaattaaaagtctattgtgtgaatgtgaattttgaatatcagagaaggcaatgtgttgtgcctaatttcctaaatctattttgaccacagagcacttttattctctgcattgtaatctataatccagtatgggaaatactagaaaggatccaaaaaagtccctccagatcttggaatctggtgatctctgagtctggggtgagtgggctgatggtagacgacttggaaaaccaggcacagaagcttgtagtcggtgcgtgggagctgcttcttaagcaggagtggcaaggggagtgaaagtgaggaagatgtaaacagtgagggagactagtccatgtcttttcctgctcccctttcctgcctgacatctgcctttttactgattgttaccaaccccaccaggaggtgaatattggtgagtggttctcattaatagctctttcagtgtgatgatactagcccaattctgatgccaccaagctgcccttcagccaatgttttatcctctttgtcccttctggtttcatatattgctgctctttggcaacctgtaaaaaaaggttggttgggaaaggaggttgacattgatgttaaaacaacgatttcaaattatctgcctttggcttgctgtatatgaagtggtagttcaaaaaagggtcagaaccgctcttttgctgttacatagccaggaaaagctgtggaactgtgtttctgttgcatttttcactttcttttttggaaaatttggccatgggactgtaaaataaatgggtcagttccagcatttgacttctgaaagtatgcatagctttaggatctgagaagggatgagagaatttggaggaaaggaagggtgtgaatagtgtgtgtggttatgaattcaagtattttactgtacttactgagtttcattattttactttataaggcagagcatcacttgaggagtatttatgtgagatgtggttgaacgttgtgatatgatgattccatgcagcttttgttaattgtggagattaactacttgcaccttttttttggaattagaatgtaaatgaatccgtgaatttaaaaaatgaattatgaggttaggaattgagcctttgatcctgagagtagtgttctgtagttctcactgttgaaaaagggttaagaaaacagaacagtaaacatgattcaaggagtgttgagggtgatagattctgagactcttctacaccacagttttatgtattatcaaagataaatggtgattatttagttttaaagaatgttaggattagaaatgaggtccccagatggacacaacaatagttgaggctagctattaggaataatttaggtctaagagctacgagatttggaagcctttggacgagaaggtctgtggcatttcgggtgtttgtgtatgtgtgcacgcacctgtgtgcacgcaaagggtgaaggatggtgggttagtggctttacattttattttattttacccctatcctgtatagtagtcataatatactaaatgcagcctaactttgtaaaagtgtttcatgctgtttttttcctcctcaagaagcaacttttttttttctttcagaattaggattaaacccaatatgctgcagatgtaggataaagaacctagtaatgggagagcaactgttaattttagaaagttctgaaaagattcaggtagatttgaaaacttagatcattgaagtttagaagagcaatatgataatgaatttggtaaaacttgagacaggagaagatcaaaaataattagtgagctggggcagaactgttttctcttatataatcagaacctgttccatgaatgtagacttttttcccctctgggaggtgaagaggacatagaatttaagactggtgagaccctaagtgtgtcttctttcttccaaatctgagctgtgttctccttcgtttcttctaacacaatagcagagtaatgatagtttctattatagctttgcatctgttggtatgcaattaatacatactgtgaggtcacaaagaataggccctttttatgctattagtatgaggaggggaggagtgagttttctagaatttgactgcccctgcttgtttaggaagaaactagacaagtacaggcttctgtgtcttagtcctgttcaggtctctgattccatccattgcaaggggctctggaccctgaaatcatatgaattggtgccttctttgaaggtgtttatttcatatattagtgtatgtggctctcttagggtccagttagattccccgctcacctgctgcccacctccctcctttcctccctttctctctccttcatatccttcttctttctctctcttcctttactgaggtagagctatcaaaattatgaatgctgttaataaaaggtaatgcatttaggacattgtgtatgaaacgcagaaattcaaaaatttttaaatttcattatttgaactgtgacaatctgcttgaggaactctaatttagctctctaaaggtgaattgcttgccacagttttcttggccattacagctcacttttctaatttctcagcttatgtctgaattctagttagtttgtttgccagagcaaaccttataaatgatcaactacatacaaatatttttaaaatgacttaactgtcattttagcttgcactatacctcacggtgccatacccccttgttacctctggagccctggaaaacccatgtgcagtaaaatggagtcacaagagaaaagcccacagtttgtaagtaatggaaaattgctaatgcaagttgggattcatttttggcaaaaagtctttaaattgcaagtattgtgtggctgctattaactgaagcacagcctgcaaatatagattgtgactcttggttacatgggtgaaatctgatattttctttcttttattttgtttttttgagacagtgtctttctttggttgcccaggctggagtgcagtggtatgctcatggctcactgcagccccaaccttcctgggctcaggtgatcttcccacctcaccctcccaagtgctgggactacaggtgcatgccagcatgcccagctaattatgtattttttgtagagatagagttttgccatgttgcccaggctggtttcaaactcctgggctcaagcaatccaccctcctcagcctcccacaatgctgggattacagacgtgaggcactgcacccggcaagaaatctgatattttcaaactgtggctaagttctaaacctgagactgagttttagtcattgccagggacaagttgtgatgacgcctgagggatctcattttccttgttgtccccacacctaccctcgtctgcagcacaaaatctcattttaagtttttgtaaagtttctgatggcagtaatattttagaacttaaaaggaggaattaagagattacagtcccatattataagtatttcttagttgttatgttgaagtagacttcttttttcttgttttcttctagatctctttgttcagttatactcgttggctaaaggttgctggttaaatgttgtttagcgaaatattctatagttaaaatctttacaaagaaaaaagtaagaatgaagatgtggatagcacaataattgaacattagattattacttgttttctagccacatgatagaaattgcagtgacttccacccattctgtctgtacatgttcagttggcaaagagaatgaaggtcctggaccgtgcttttctaagaaatgattttatatagttgacattatactttcactggagcaaaaagggaaacaagcatttgattagtgtgtcttactgcatattgtggtctgctccctcatttgttacggtggtcactatgattgcttgacaattacagttttgagattaatatgcagagctaaatctttaggaggtatcctaaagttaggacctaaactttttcatagcagccttttgatccattttattccagccattgctagttgatgtgctttctaagccgtgtggcatcagaggcacagatgttgtctttagtgatgtagttctacctctcattttgcaaatgaaaacaacagcccacaggggttaattgacctgttcaagatcacactgggagttagaggctctcactgttaccctatgaatctaggagtctgcttcttgtaagttagtactggggagtcccaaggattgggaaccttggaaggagattttttaaaaacaaaaagtcttactacaaatgtggatgagcacccatgattgtaaagcttcccatttcagctaagaaatgttctgatttacacaatatcaagaacctttaaaaagcgttgttctctccctgcgctctctcccagtgtatcaccctgaaattagttggcctttctctgtaggtacattcatcgtttttaaacactgcctcccacctcccttttataaggatgtaaaataaaaaaataaatattagggtggtttctcatcattgaatgtctagtggaaagataaaataattatttggaagtaagatgaccttaatgtggcccatgtaaaatttttaacataatttctttgtgtaaaatattttctttagcctagcaatctgtggaaactcagagcaacttcataacattggtagcaggatgtatggagtgagtgaactttggagtatagtggagttgaaggctcaacgaaaattttcttcgaggaaatacttaaaatattaaatccacatgacgtgttgactaaggcatcttgtctgttcattgctgaaccagaacatttataacaactgtttctcatgtgtatgtattcatagccattcatataatgaaaagaagttttcatgggattgtaataacatatcaagatggatgtaattaaaacagaagcagattgacaccctgaattaaatgtaaaccataaaccaggatacctgagcattgtgccttacatatttgctgtagggggcagtcagccaaatatgcaaataaaaagacattgatgaatcttcctgggtgtgtatgtggttgcagagaacccaactattttattaatcttttatcaagcattgtttagatttgcagcagccatggaatgtattaatttggcagaccaaatagcttaggaccagaaagtaggaaataataaagggaagacatgattgatacgctgtcctataaataacacatgcgactgacaaaggggctgagtaatctttagatctgtgcttcatttcattaatggagttgttaaaccaggatgtttgagttgaacttcaatcagagaggctctgcctcccatttaaaatgcaggcctacctctactcactctctggactgatatgttgacaaaattggtgtaaatcgaatttttgtaaattggatcaaatgcactaggggaatcttgctgtgaaaaatatgagtcctttttatcaactatagtactcctcctctctgcagggaggctgggattttggtggagtgagtctcttcagatgggcattgcttcctctgagacagtttcctgcacgtgttcccggtgctctgttccccgtgctcctggaagacagtgactgtgagatttgcattttttcttcaggttttatacctcacttggtcggtgcttccaggaataattggtggtgatttgaataagcccgcatcattcagatttcagagcttggttttcaagtgcttgctaaggagggctcccagctatgaatatggaatatgatttccatatctgttccattggggagtccaggcgtgtcataaccacttcagagtcatgattgtatcgagacaccctagctgtaatttttctatatgacagttcagttttaaaattgtaaagatgccaaaagcagggctgcattgttattagggaagtcagtgacatctgttatatcttgttaaccaggggaggaaaatgctttaatcaaaacatctaattataccctatgaactgatgaaatatcctttgctaaatttttggaattggccttaatggaagaagctggcctctatcagaactgtgaagtaaatttaccctttttatttggaaaaatatttattcctaaccatagtgacataagggtattttaattgtatcagattacttttatatgtctgttgaaaatagttatttttcagaagttgttcaagccagcatcacgtttttgtttttgtgctctctgactcccttagcatatgaggcccccagagggagtttgtatttccagatgtgagcctaggaggatatgtggtgtcttagagccacctggggagggagcaaatgataattgcaggtgagatgcagggggataattcagcctgtgtgctgggaggtgcgatttcacacctgaatgttgagacctgctgtgttagacacttgtgttgttttaaaatgttttattactctaatatagaaatggaccagattgttccaggtcaccttcagttgaaagaatataaatgtttttaaatattgaagtataatgtgattccagaaatggttcctgtgtttaaaagtagttttacatatatctgaaagcattaaaatctgtttaactcagcatgtctatactgcctctacctctgttgatcattttttaaaaattgtaggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaattgtaaattattttggcaatgtggctttccactttgaatcattcaagcttcaaactgtccagtaaaactatccttttatctatatttcaaaactagaattaattttaactatagctgttagttgtttccagaatcactgacgatgattataatattaatgatagtacattattgatagtcttaatgctgggatatggattatttctgagaaatgattaggtctgagaaatgctttatttcttagttttgggggtatttcatctttctgacatggttttcccatgtatggagatcttggggcccacctgaaggagttttttgaagtgttgactgtgacactatgggcttcatgtttactttgggatctggtgggaagttcaagtgctattaatttttccttggtctgttttatgctttgtaatggctttctgtgtgttttttgggagttaagactagaaccttggaaaagagagagccagagttttctccctatatttctattttaaaacttttttttttttagacatgttctcgctctgttgcccaggctggagtacagtggcgcagtcatggctcactgcagcctcgacctcctgggctgaagtgatcttctcacctcagcctcctgagtagctgggaccacaggcgcgtctcaccacgcctggctaatttattatttgtagagacggagtcttcctatgttgcttaggctggtcttgacctcctgggcttaagcgatcctcccatcttggcctctcaaaagtgctgggattataggcatgagccactgcgcagcattttatttcttatgtattgttattctctctgtattctctgcctaaatgtaacccctgcactctttctgtatatatccttctggggatatttgaggctttcagaactgtttctttcttcactcagtaatctatgcatagtaggtactcagtcattgcttatttacagttgacaacaattccatgaaaagaaatttttgaagagggagctgctatttactattcgccttgtgccaggcattgtgctagcaattttgcattcgttatcccattgacgcaccccatgaaaaaaagaataataatctctgtttgatagttgaagaaactgaagcacagagccgttaaatcaacttggccaggatcagtataagagaggcaagaaatgtagcagtttttgcctgacttgaaagcttgggctccttatccctttactcattttcatacagatgcattttgtgaaagatggccacatggtctctagtagaccacatttgttcattgttgtgctgaaaattgttacaaaggattttctaggtataataataggatttagggaggggagagtacttattgtccaggtctttatttcctttgaaaagttggagcttacagttaggttgctgccactcatacaatatatctgtaacatattcgttgttgttttttctctgtttcactgtttctccctgttataaaatctgaccttttcccgggttatactactcaggtagattttaaaccattgtcaaaggcaaggattcaggctgatgatatagagggttattgtatgtcagtgtctgttctaaacccttgcactcatttatctcactgaattctaaaagtagctctctggaacacaaatgtaaaattggaatgaggactagcatgccctcacagattactgtgcatataagcttatattctgctatagattctgaagtattttgtcttgtctgcttttaaactgttctaggaagcagcacttgtcttgagaatctatttcacaataaaagagaccttgttttgagggctaggtgtatttttttaaaatctattaggaactctattctttctggtaaaagaccacactaaatagctctttttgcttttcttgatatctgtatcttgaagataccaggtgacaaatagtccattgatttcctctgtcattgtttcctttcattattctaagcagatttgcaaattgttctctcccatttcccattccaccctgttaaggtttgtttatgctacaaagagtatgctaatgaatataactgttagatttacttcttaaggaaatcccaactgcatttagagtactgtacatttttgagaaggctcctcctcatttcccctcggctaagatgggcctcctcacaggtcattctctgggacttcacgattcagaactggtccattaccattcatttacaaggaatgggggttagtataaagatacacacacagaataccctcactgggcctgaattttctaaagatttctagatgaatatgaagatcagtcaagttacacacttctctcaagagtcactctccgtctctttctttctttctttctttctttctttctttctttctttctttctttctttttttaagagatgggatctcactctgtttcccaggctggagtgcagcagtaatcatagctcactgcatcctgaaactcctggcctcaagcgatcctcctgctgcagcctcctgaggacctgttggtgtgtgtcaccatgcctggctaattttttaatttttttttgtagagacagggtcttgctgtgttgcccaggcattctcaaactcctgggctcaagtgatcctcctgcctcagcctcccaggtagctgggactgcaggtgtgaaccactacccctgctaattttttttggaggggtagaaatggggtcttgcaatgttacccaggctgatctagaactcctggtctcaagtgcttctcctgccttcacctcccagaatgctgggattacaggtgtgagccactgcgcccatctgagtgtccgtatgaagagaggtggcagtttcttcttggaatcaccatgctctgagacacacagtcttgcctttctctctccaactgtctcaataaacacaattgcccctttgtatgtcccgaatggaaataccatactagaattctattttacagattgtaattgttggggagacccaagtcaaaacatgttctttgaaatttaaatataactgtaaaaggaaccacaaagtctagggctttaaaggtgatcttttatgctttgattttatgtatttgtaaaatacaagttctatattgactctagggcctgtctcagattgtaaacccttagatagtaactgtgtctttttaactgttccttgtatccttccttgcccctctggtggtctataatacccctgttgtgatgattttgattaaagaaacatagtgtgaagatgggctgtcagggatgggtgtcagtttcacttcagggtagtgggtgccatctattttctgattacaggtgaacattactttagcattatttttttttgagacagagtcttgctctatcgcccaggctggagtgcagtggcatgatcttggcctactgcaacctctgccttctgggtttaagcgattctcctgcctcagcctcccgagtagctgggattacaggtgcccaccaccacacctggctaatttttgtatttttagtagagacaggatttctccatgttggccaggttggtctcgaactcctgacctcaggtgatctgcctgcctcagcctcccaaagtgctgggattataggtgtgagccactgcatccggcctattttagcattcttgttgtagatttctacatctgctgcccatatttcagctgtactcttattttgtttagtatggtgtacctgggattagggacagacaaatatgtatgctcagcctgatttggaaattacattgttgaaatacagcccatatggccattgtaaaatggttagtgctgcatataattgcctttccaatgatgtgctttgtcattacttccatcttccaagaagcactcctgtagcatgctgacagcaatagcatcattagaaaacatatggacatgcaaaggcattaaatcgtctttagtttaaggattagattacagtgttagaggataggtcaccaggcttgcaatcgatgactcttgcttagttcagcactgctagactggatgatagagatttgcaaaagtcctatttacttgtctgctgagtgtatttcatatcttccctgcaattgtgagaaggtcctttagctgtgtataagcctctatcacagtattgcagccagttggcttctcaggagtgtttttttcaactattcatgtcctgtgcagaattcttttctaggatgctccctcaacctctgtttttctgaatgtgagcccaaagcaggctaagccaggaattattttatttgggggtcatttagatataaaaagagactaagtggtggagtcaagaaagtaccaggtggctgccatgttgcccaaatatttcctcccttgtacagcatctatctccacatgggtctcaagtccacctcccttcttcctttcccctcttagaagcaatgggattattgcagcctagaggctcagtggtaggtcctagaggccgagggaccatgtgatagagcctggaaagagaccaccccctgaatcctgccctttgtagttggatgttttttccccccacaactagataggtttactatctggctgtaaatattctagggatgcaacagttgtgggacatggtatgatttgaattttcagggtcctttttgtagttgccagtgaatagtaagtgaaatcgcagaatggaacatcattcatcaaatttaatatttcttctttggagtttaacagaaataatgtggatttggggactttcagagtgataagggactttggagatcctcatgggcagtggttttgggtacctcagggtacgctgagtcatttgaggggagatcctgactttattaaatcagaactccacctttacctgtcttctatatttatacttatgtattaggattacattctctttgagaagaaaaaagtgtctggatttgtttattctttcattcaaaaaaaatttattgacagcttctgtgtgctaggcaggcagtactccaggcacaggaagtaccatagtaaattagaaaaaatagatatctattttaatggagtttatattctaacaaaggatggggggacatactgtaaataaacaaatatataatatgttgggaggtgacaggggattttataaagcagggtaaagcaagagtgagaacttagcacagcaggtcctcaaataacattgattcttttcattataatgttgatgagaaaaaaaattgattcctggccagggcaactgtgtggagtttgcaccatctcctcatgtatggtaaaattgctttcattatgcatcgtgtcacgtatttaactgaggactcacttgtatgtgtatgcttacgtgatgctttatccagggtgggttagataaggctcctctgaggaggtgatatttgagcagaaacttgaaggaagcgagggagcaagaaatacagataacccggaggagagctttcaaggaaaggggagaacaagtgtaaaggctttgaggaagaaggagtggcatggtatgtgagcaacacaggagatgttggcggctggaacaaagccattgaggaggggacagagagtggggaggggcctgcagtcactttaactgagtgacgccagaagcttagaaacagcagaaagcaactgtccaaagccctcatttcccaactgaaagtgtttttgaatttccccaaggtcacccagctgatgtataaacaagagcacatctggagctcacgttatattcttttaaagtagcttctcattgtaccttgtgccaccactccaggtcttaggagacatggggcatctttttggagacaagatttgtgtctcctttcctgttagtgggtatggctcctccaagagatgtgcttcaagactctacagaattccagtgcccagtcatcacaaagtgggaaacggctttgccagtgccagaatcaccaccatttggggaattattttaaccacaatggctcatgtttatcacaggcttactgcttgtgatgtttgttgtacccagagctttacatgcattaacacatctaaccctcacaacaactctgtataataggtcacattatcattattttagagatgaggaaattgaggtgcagagaagttaagtaatttctgtatggtcatgcagatagagttgtagagttgggatttgaatttagactatttgcttcagggcctgcactgagcctctgacaaagaggagggggatgagcttgtctctagataaactaattggaatatgctcccctcgcctccattttaagatggttctaggtagggcctagccttgggagtaataccaacttgtcacaacccacttctgtgactccaggtgttagtttgtgtagaggatttcacagccagtctggctcagtactggcaactttgctgattttaggtggattcctgattcagcaggtacctttggtctttctgagctgagtttgactggagcgtttttcaagacctgcatgagagtgtgttacggaatacaggccagtgttttcaagtcagcggacccagttttagctggtctgtcttttttagccccagtgaagtaaaagccccagacaccaccagtgcccataatccataggaatgtaaaatcatctttttagtactggtgcttttgaggaccagtacactatgtgcttgctttaaatttgtctaaaaatgtatgcatatgtagatatgtgtatatatgactatgaaatattttctaggtatggaaaagtataaagcataacatagccaacacccatgtacccaccaccaactttaaaaaaccttatgactttactgtaattttcttaaaattgtaggttatttttagtgagcaggaaccacagtcaaccgtaagttttagagtccaggaggctcaaacctggccacacattagaataccctggggataccctggggagctttaaaaaagtccttgtacctctgggagggtgcaggaagcccccacctctatcatcagaattttaaaaagctccccaaggcgaggattctatcatgcagtcagggtaagagacctgctgtttggagggttgtgtttggtttttcttcactgggttctcagatgcctggtaccaagccatgtgtggtactcctggactttatatttcattttcttaaagcattttttaatgtggttctactttcaagattctggagggtaatgtcctggggagttcctctccttagactcttccctcttcagcaccttatgaggcaagctgcggatatatttacatattcattacaaagcataagcatcaggaacttagagagtaggagtgaggcattagagaggggactaagaaattcagaagtattgggagctactgtctgttgaaagtgtttgagatgagtgaaagttatagcattaccttggaagtcagggggatgcagggttacatttagaaaacctggagtcacacataccttcacaggaaggctctgagctgtgggatggtagttgagggcctttttggtctacatcacaggtttatcagtgaaatatgtggtaagatgtacaaataagatgtgccccaccaccagaatgatcagttctgtgtggacacgtccgtgactgtaccctctttcagaagtgctatcaattatgtgttatgtgtggcctgattatcctctgtgggccttggctccatgcagcacctccatccccgtctgcccactcattcattcaacaaatagttgctgagtttctcttctctatgccaggttctgttctaggcacttgggataaaaacagtgaactaaacaaagcttctgccctcaaggaatgacattctggggatgtgggggagaggtgggtgagtgggtggtgttacattctggtgtcgcattgttttttgatgtgtctaacacagaaaaagatgtgtaactgtaatcctcctttagaaagctctaggggagccatttggcaggtagggaagtgttttgcctaatttggcttaaattatgattttttgattctgaggattttgattacaaatgccttcatgaatctacttcttcaagagaaattaagtgctgagacattaaagcttccagggaccttttgaattggttggattttattagcagcttaaaatgagcatgacatacagtaaggttcaagcttaggggagatgctgaagaaataaggatacttgattttctttccacttgaagtggaatccactaatccatctgtgctcataaatttgagagaaggagggcggaaaacgaaagtttatttctagggctctctactgggcaaggctatcaggttaccttcattgaaaagacttaatcagaagtgaaacttaaatctgttacagtcttccacagctgtccagggaattgggcactgatgaataccgtcagatggacccctgaatagagggaatgccttagaggtcatgtttggagttagtcaataaaatggatctcgagaagaaaatagaaagtttgagggaaaaaaattactggaaaagaaatcttaaagcttttgggttagatgttagatggatgacgaaaacagtgggtgatatgatttcctttctggattaccatcttcatcagatattgttgtcgactacagaaaaaatattcccagcacgtaaggactctttatacctgtgagctcttaaaaagaatcatctaaaatactaaaaaagcaagaatatgttgtttcactagcttttgattcctaaagtagattttgacttccgggtgtgggaaggtgggtggaaaatgagtttttgttaatattcaaaggcatgaaaacatttttaccagtttatgttttcctggtgcatttagaaatctgtggatccttggggatggtgtatgcaggcaaatagagaatccagtacttgtgaatctgcctgaatccacaggtttgggaataagggcagggacttgagggttcacagatgtgaaggttgtacacagaactcatgcagagagatacaagatctttttgttccccctttgattagaaagaataggacatgaaagtacttaattgtcaacttcgtcttcaccataagcccagtattgatgcaaaaatgataataataatgagaacaagcatttattgagtattgggtattctaattgcttaaatcaactcatgtaattctcacagagtggttctatgaggttggtgccgttttgattcctgttttaaaggagaggaaacaggcacatagagtttacacccaaggacgagtgtgtcagtggtggagcctatacattctggctccagaacccgacttgaaccactacataagggaactaaataaatgcttcttaagagttttattctgatgttgcttttactgggactttcactcttttttctacccaacccaccccacccctaccccactcgcctccactttatctttggatgtcttcagaatctataatatatcttaagcttgcaccttattacagatgagaaaatagagagctataaaattatgttatataattgttctgtatgacctagtgaatctttggtagaacagggatgtggaacccaggttttctaatatttaggtcactgctttttctcactgcactgtatggcttccattaaaaatattttaaactaactgaactaaaaatttataaacttaatttgtgtcactcatacttctgtggatgaactacattaaaataactaggtgctgtgagattttgctctagggaggagggtggtagacattttaggagctaacatttgcctctggggttatttgacctcctcctgaggatgtctttctaatctttggtaggcgtacttaaaagtgaggagaaagtatttgaggaaatacaagagccattcgcagactttagtatgatctgtgggtttatggaagggcttttttttttctttctttcttcatttaggccttttttactttaacctccagtggggacacaactaacttaaatcttaaaaacaaataaacaaacaaaaaccctaaatacaagccttctttcgctattgtttggcaaataagatttcacaagagggtagaaagaactgccttgattcttggtgttttagactttcctatagtctagttttttgtttttgtttgttttttcttttggtcctgtgattccttttgttgttacctgtttccttggctaatgctttgtttaaaaacaagtgctctggtattccaaaacaaatttccagcaggcttcccgattgtgttctcagataaaagaccccagggtagtgctttaacttgaattttggttgcctatgcatgcctgagagcaaaattcagtttactaggtggcttccaacccagattaatatggttatatctaaaacgagggaatatacatttgaaacaggaaatgtggattggatttaccctttcaaagagccctaatgtgaatgtaatgagtagagttttgtctggggttagatactgtgggctccagtttgtttttgagtttttagctgaatgaatgactttagtcctgtcattaaacctctggaaatttaaactttcaacaatgtaataatgataatgaaaatagggaaaggctcctagactgtgctgtggaaaaacacatgttcagattttactgaagacccagaatcccatgtggccacagataatttgatttcacagtttctatttctagatatacaggatggggttgccagcagaagttacatagtgataataacatatcagcttcctttttagggaagatattgtaattgtgagaaaaatattcagaaaagccttggccaaatattgtttgtagttggtaagagaatactcagttattaaagcttctgcgaaccttttccaaataattacactttttccctaaaggaatcctcccacctcagcctcctaagtagttgggaccacaggtgctcattaccacacctggatgggtggatggatggagatatatatatatttgtagagacggagtctccttatgttgcctaggctgtgttacattttttgtcacacatgttgggtatggagaatttggagtaggtagtttcagatttgcacatcacaagttcttgccttgtgcagtggtttctaaaccgagttgcatatctatactccatggtaacttggtaaacatactgattcctggaccctgtgtctgatctactaaacattaatccctgctctgtggctctggaacattagtgttttgttttctttttggggtttgtgacagggggacaaggtctcgttctgtcacccaggctggaatgtagtgggacagtcatgactcactgcagtctcaaactcctgggctcaagcagttctcctgccttagcctcccaaaaagctgggactaccaccaccacgcccagcaatttttttttttttttttttttttttgcaggggtagagacagggtttcaccatgttgcccaggctggtcttgaactcctgggctcaaggaatctagctgcctgggcctctcacagtgctgggattatgggtgtgagacactgtgcctggcctggaacattagggttttttgtttgtttgtttgtttgtttttaacatcaagttccagtatagaagtttcagaaacactatttcttaaaatatttttgagtgttttcctggggcagtggtaatggtgatggtttacaataatttatttctatgctatgtaacttttctgaaaagaaaacattcctgtgtatttggttttaaaaccttatttactgtaaaatagaacacatcctggaaaaagtgtagtgtacagctcaatgaatgatccaatgaatgatcacaaagtgaatacccaggtaaccagtactcaggtaaagaaatagaacattgccccctccccacaaaaaatgatttttattagattcctcaaattttcttttctattcctcctcaaatcccaagaaattagagatataagtaaaggttgatgaaacaatataataaggtgtaagtgaaaaaagcattgtcttttggtaggtggtgtttcttaattactcttttcagtaagtttttggtgatgttaagtttgtgttgtttatctatgttttgattcagccttaagccagttcttgacagtgactgtctattaatgctcacagctgatattaagattacgttctaagatctatcttttctgcaatctgtttcactgaaaatattctcatgatagttttgaaaatgcgtaaggacagattatcttctgactctaataaacaagtgagtcttgtcattactgtccaggtaacttaggaaacctgtctcagtagccaggtatctttatctggtacatgataaaatgtggtttcttagttttttttaaaaaaagttccttcctcctctctatccacccagaataatctctcctccattccaacccaatcagaacatttaaagccctgatggtttttcttttttccactgaagaatcattcaattcttagtgagagaaggtctagctgtattaaatagcaagcttgcccattttctttggaaagggatgctcatggtaaaaggacctcaagcaaaccctgcacttaagctgtgtgcaagtggagggagagagctgtctgcagccacctgccagcagctacacatctgtgctctgctagcaagcatgtgggctctgtggatgtgagagctgctccctttcccctctctgcctcatgctcccccatcttagtgatcgccactatcaactaaacaggtgacaagactccaatcaccctgctctgaatggctctccatcttcccaaaagtataccagaggcctgttttgtttcagtacattgattaaataaatattcctgtgtgcacaaaggaactgaaatctgttatggcactctgcagttatctgtccattaatagtggagaaactactgccagttttctcccctcggtgcccccgccccccaccccctttcttgtcactaccacgcagattctcaaaggtgccagtaacagataaattatctgacctctgctttcaggcttgtgtgaagcgggaggagtggtgtcatgctctttggtgaggcatgccgttggggcagtgcccaagtgtatggataataggagagcccgaatgatttagattagaagatgctttcttgctttggggttgtgggacctttgtctctccccttcaattcttagcagaagcggactcagaaaggtctttcaaattagcttgcctctcttttataggaaaagggtgcttctggccctgaagtagttctgtgtgtctactgtcagatgtggaagccacaaagtgcctgtgaaacttggtcccttgcgtttatttacaagtttctttcaaatggcagtggcaggaaggatctttaccatttgggcagatagccctagtggttgatgggagggcttggtggaagggcaggctttgtgaaagatccaagtgtggaatggtaggaattctagccatggtggtgctgactggtttcctttcttttttggcggggcaggggctggggtggagtgttggttaaaagaacacctagataaaaaacatgacggatttcgaaagtgttatttgggctgcgcacggtggctcatacctgtaatcccaatactttgggaggctgaggctggaggatcccttgagtccaggggtttgagaccagcctgggaaaaacagtgagaccctgttctataaaaaatttaaaaattagctggatgtggtggcttacaatggtagtcctgtctactcgggaggctgaggcagtaggatcacctgagcccaggagattgaagctgcagtaagctgggattgcccactgtactccaacccgggtgccagagtggggctctgtctcaaagaagaaaagaaaagaaaaagacagggaagggaaagggaaggagaagaaagaatgacaatggaacataggaaattagggttgtagagaagactctatgaacattattgtggtgtgaaggaatggcatgcagagataagtgtgatggaagggaggtgttgaaatgtttacagctcctaacatctaccaccaaggagggggcacccctttgacagaaacgagagggtgttcctgagtagttgtgacattaaaaaaaattgcagggaaccttgtagctgcatggatggcagagacacataagtagggaaaaatgttggaataggtaaagtgaaatctcttagtgtgtgtgtcttccaactgactgtgggtaattagttggaaatgacattaacctgagcttaattgtaattttgcatagtaacaacataccagctgttcactgtattctttcctggaggtgcgatttaattattattatttttttttgctatcttttaagctccaattttctgttatgttttacttaaaccccgcctggttgccgtgtccacagtccccacagtttagcagtaatgtcatttttgttgctttcatgcccactgtgtgctgagggcttgggatgctcttgattttgctaatgacttggatttataaagggccacattggaaggtcactgagaagcatgggtgattggaaaccttgtgttttgggctcttccacaaggttttagtttattatataaatcatatgcataattctaggcctatcagaggtgctcaaagtatcaagtgaacaagctgaaagagaagttaattactgaacagtgattgttctgatataaccaattattggatcattaaatgtttattaccttttatatgctcctttcccccataagggcagtttcttttttaagtcattaaaacagaaatgggatcttaaaaaaattctgcttaaaaaatttccacgagactgaagtattaaaaaggtcttgtgtgatctgacagctaaatagcctgtttttctttggtctgttgaattagtaattaatgaaatgtattgcctgagcagagaaaataagattagttttgtttaggaagaaaacaaaagcaaaacattaacccccaaatgcaggttaatattaaagtgcagtataagaaatagaaataaaacagtcttcttgaatgataagatgcctaatggtaacatttgtttcattcattcattcgtcactttcttgagcaccaacattatgtttagaaggaatgggtttatgtaaatacagaggaggcaaggtgccctgtccccaaagacacatgggttagcagagcagttaaaccagacactttaggcggccaggcacagtggctcacacctgtaatcccagcactttgggaggctaaggtgggcggatccctgaggttgggagttgaaaaccagcctggccaacatggagaaaccctgtctctattaaaaatacaaaattagccaggcgtggtggcacatgcttgtaatcccagctacttgggaggccgaggcaggagaaacacttgaacccaggaggcggaggttgcggtgaactgagatcacgccattgcactccaacctggacaacaagagtgaaacgccgtctcaaaaaaaccccaaaaaaacaaacaaaaaaaaacaataaaaaaactcagacactttagtagctactgttgcaatgtagaaagtggtaggataataggtacaggggcatttctttggggaggagtggttatgaagacaggttacttctggaggctgaggcatcctgtggattaagagtaggggagagcatggttatgaagatgaatcttgctttttgaggtcacggtgtcctgtggattgagtagaagccccattacttgggttcacagcccagctttgccactacctagctgtgtgaccatttatctcagtttccttgtgtataaaatggaataatagtaatgcaaccctcacaggtttgaggattaaatgagttattatatgtgaagtgcatataacagtttacagcacataatgaacattataatcttaggttgtggttatgtcatttttgtgggataatgtgatagaacttcttaggggagattgcatttgattgaatgatgaggagcggaaagatgtttcaggcatttcttgtattgtcccatgtagccacatacctaatttataatgcctgcagtaatgtgtcggtaatgtgtgcttatgtagtgccattgtcaaaagattacaaagggcatttacagacgtttattctaagaacagtcccctgaaacgagatggtttatgcatattcttctgaagtgtgagagggtgcagagcaagcccatcctgttcttccattgaggtgtgcttggagcctgtgtttgttgtgggtaatttagactcacagagagaggaaacttttaaatcttttaaattatatcttaaattcttaagttatatttgcaaacaaatgtggtaaatagattttaaaaatgttttctgtagcttctagcaatagtggaacttgtttattcctgaggtaccagatcataggcagttgaatttagaggaagtttataataatgaacatttgtcgtaactgtgaggttgccactctgtattagttttcacactgctaaaaagaaattcctgaaactgggtaattttataaagaaaagaggtttaattggctcatcattccacaggctgtacaggaagcatggctggggaggcctcaggaaacttacatggtgaaagttgaaggggaagcaggcgtgtcttcatatggctagagcaggagaaagggagagggggagatgccacacttttaaacaagcagatctcatgagaactctttcacgagaacagcagcaaatggagaaatctgtcccccaggatccagtcacctcctaccaggccccacttccaacattaggggttacaattcaacatgagatttgggagggatacagacccaaactatatcttattatcctcattttacagtgaggaaaccgaggcactgagatgttcaggagtgttgctgaaatcaaaaagaagtgttgacccaggatctaaggtctttattgcatttgcgtaaaccatttcatttgatttgtgtgttttacaataaccctttgagaaaggtcagtcagctgctacgtgcattttgggaagtatcgtttatgagaagttggtggggcatcacagtgagcttagcatggactgaaaattttggggtggctgttgtatacccttttgctacttcaagcaagacacttttgggcctcaagatctataaaataacagagtttggaggaaacattgagtctgtaaactatgaaattcttgtgtagcttggagtgagacccatgtgggaatctttggcagccaccgtttaccaccttaacttttctgagcatgttttattattggtaatatggagctgtggtactccctttcttcagggctgttttgaacataatgcttataaaatacctgacagaccttgctagctctcagccaacggaggtgggattcttgttaattgtttcaaactaggggtcatacaggtagctgagcctgggtgagaagtccagcttcttaactcctctggggctggttctcttcagcacccaagccatattgctggggataaggaagacattttaatgagatgagccccaacttctcattagaagctgcagtcctgattctttctctagatcctatcaggttgccagttgatccagtaagtaatgtagtaaatgtaatggatccagtaaagagtttggggttttcatggagtaatttcctaaaatcaccgcagtcagtagcctgtgagccacatgagggcaggggacttgctctctgtggtgttcaccttgtataatgcaaggtgatgggacagctggcacatagttcggagtctggcagtatttattttgtgaaggaaggaaggaatgaacaacctcagtgagctgtagaaaatggtatgagaaagggaacaggatttttaaaatttcagttttgtgggacagaggaaattgaggcactgaatcaggcaggttatgcccagtctctgtggtcaccaggccttaaaattgggcataatttatacccttgaagatgttgcatggcaataccttctggtgggtggatcacctgaggtcaggagttcgagaccagcctggccaacatggaggggaaaccctgtctctactaaaatacaaaaattagccaggcgtagtggtgcacacctataatcccatctactctggaggctgagacaggagaatggcttgaactctggaggcggaggttgcagtgagccgagatcgtgccacttcactccagcctaggtgacagagcaagactctgtctcaaaacaaaaaccaaaaaacatatttctattgtgaaacaaaattttatccatgtcaggaatttcctctgaactagagtatgttcattcctcttttgtgatttgagtctgtgggagtcggaacttgtcaggaagacttagtgtagctgtgcttctaaggatgtgctattctcacaggcagccgtgctaaccatcttgctgtaaactagccacgagtaaacgtctggttgtgaatcacagcgtgacctttcagggaaaacaaaacaagcaaaccaccaaacacatgaatcagattttctttagtatcaggattgtaaagtctggtatttaacagtttgtcaggcccacttggagcagttgagacaacttcctttctctgtttttgtttgttcaagatgtggaagtgtatatccttctttagcaacatattaggataaaaactttaaagttttcttccactgagttaaactatattagttttcctaactgtcatggactttaaacaattaaagattcctggttaccactcaagacctactgaatcagtctcttggagtgggacccagaaatctattctgaagagcaccctaagtgattctatggttaatcagatttggaagccactgagatacagaatgataatattgtattttctatccacccatttattcttttttttttccttctctgtggtccgaatatccatttgttcttactcatttatccacgtcttgagtagattagaattgattacctatagggcattggtcattttaagaactaggcgtagaaacaagaggtagaacacaatgcctgccccatggggttcacaggtggtctcagaagtttttaactttgggttgagtgttaaaggattcacatacttcccaaaagccaggagcagaagattttgtgtacacacttttttttttttgttttaagctttcatcagattctccaaggggtcagtgacccataaaaggttaagaaccaaggtcttgtgcttgcacagctgttctggaaaaagtagaagagggcagtgtttctgttgccacttaagatgtttttgaccttttgagaggcaacagcggtttgaggactgtacctgttttctgtcctacttaaaatatttaaaaagaagaaaaaatagtttaacatctgggtcagggtcagaacaagaccaagggatatggaaaatagttatttcgtgaactgcatcacatttaatgttaaagagctgctgacagccaaacagcctggtggttagcgtgatggaggaacttcttaagctggatagcataggcaaggttcattccagttttcttacagtatataattagccaaattatggataacaattttcaccccatggatatacataaagactaattgtcttatttttgttccattttagccccagcatgtccattgaattgcttaattccaaaataactttgccagccgtacagctgatacattcttctttatcttctaaaatccccaaataacactgttcatagcaaaacagagttggatattaagaaagaacatctttaactgctgtggaaagtgtttactttgtaaaacactagaaccttgtatgtataatgttcttatccctaaggataactttataattgaatttcaattaaggatgttctcttccttttcctcctcctcttctctctaagttgtactcattgaattcatgtttcaatggggaacaaaaatttttcaaatattgttgttctggtaatgctgcattttaggatctggagagggcagtcagtgggattaaatgttatcaaataggttaaattatttggccatttactttggtatagttcctctggagctcaggaggatgttagaggtctttgttgtcagtgaaatcttgtaaatgtatttttaggctgttcaaatgtctggatcacctattttgaacttttgcatataccaccttacattacttatttttataaagtggacattttatctttataaggttttgccttgctggacagtgattatgtgttctaggtctttatagctttgccattacccggcatactgagcacataacagacactcaataaatatttgattaattggatatgttgattgggtacccaagaaaccagaagatgaaataagtctggagttagaacttgatacatgcttagaaaggtaggaacgtaaaagtggattatgaggtctatctcttaggctgacgtgctctcctttctccttccccatccctctccaccccctctcctcccttctctcttccatcctgcctctcctctccctccccctctcccctctcccctctcccctctgccttctcccctctcccctcttccctctctgttttctttctctttcctttccctttctctttccttaattttcttttctttctgttcatatataggtagtagagccagctcacgtttgctagttctttaaaaatcttaagtatttagaattccacagttacaagaattttatggtagagccacaacactaagttttcatttggaaaatgttaaatgtagtgaaccttgagagaggtttttattagttattgcttttatttatttttaaaataagtttcattgtgtatttgtaagatatataagattataggatgcatagagatagtaaaaaggttactatatatagtgaagcaaattaacatattcatcaccttacataggcaagagcagctaaaatctactcatttagcattaatcccaaatacagtacaattttattacctttagtcctcatgttgtacattaaatctctagacctgttcatcctacatctcctccatttccttcctacccctagtaaccactgttttgttctctgtctctgaatatttgaaaaaaatttttaagattccatatataagtgagatcatgcaatatttttttttctgtgtctggtttatttcacttagtacagtgtccttcaggctcatccacatttgtggcaaatggtaagattgagtttttttaagggctcaataatattcatacacacacacacccacccacacacacacaccccccacagtttatccatttgcctgtcgacagatgcttaggttgtctccatatcttatgaataatccttcagtgaacatgggagtgcagatatctttataagggggagatttcatttcttttgggtaaatgcccagaagagagattgctgggtcatatggaagttctatttttaatttctttagaaacctccatactatttttcacaatggctgtatcaaactacattcccaccaaccgtatacaagagttccttttctccactctttccaacatttgttatctttttactttttgatgtaagagctgtcctaatgggtgtgtagtggtatctcatgaaatggcattgatttgcatttccctgatgagtaatgatgttgagcaccttttcatatgtctattggcagttttatgttttctttggaaaaatgtctattcaggtcttttacccatttcaaaatcagattatttgtttttctactattgagttttgtgagttctttatacactttgcatattaactccttatcagatctagtttgcaaatattgtcttccaatttgtaggctgccatttcattggttatttcttttgctgtgcagaagccttttagtttgctgcagccccatatgtttagttttgcttttgtggtctgagcttttgttatgttatccaaaaaaatcattgccaagacaaagtccaggagtttttcccctgtattctcttctaggagttttattgtttctcgttagttagtgcttttaagaaggaaggaggcctcaccagacttgattattattttttttttttgagacggagtctcgctctgtggcccaggtgggagtgcagtggcgcaatctcggctcactgcaagctccgcctcccgggttcacgccattctcctgcctcagcctcccgagtagctgggactacaggcgcccgccatcacgcccggctaatttttttgtatttttagtagagacagggtttcaccgtgttagccaggatggtctcgatctcctgacctcgtgatccgcccgcctcggcctcccaaagtgctgggattacaagcgtgagccaccgcgcccggcccagacttgattattaaaagacatctgctactcaaatagatgccacccttaatctgtcctaatcaagtaaaatcttgttagttatatttgggtagaggaaatattgtaggctaatgaacagtggctgtcaacagttatcttgaaaatctagacttgtagccttgaaggagagggacccgaactgtgaagagatttgtcactaaccatgctatattggatgtaaacctgggagtggttacaggaggtggcttagggtaatatgtgctggcatctttaagtatttcgggaagagggatttagatccaagtggtcactcctactcccattggagacgcaatttggcattgtgtataaaagaagagtttttctaatagtgctgtgttagggtcctgaattccagctgctgccattcaaacaggctcacttaacactcacctggattattctaatgggaattcaaactgggtattggtgacctttgagggctctccctcccaaagagactatgagtgtgtgatttttcagggcaaaatgttctaagtaaatcaagtcatggttcaaagtctagatccgctccttgtaattttttttttttctttttaaagaactcagtcttgggtgctgtttacttcatatttaagcccatggtccccatgtgtattgaactggcacaaactaaacttgtctgctcctctaggtctcttctcatagtctgagttcttaaaattaaggtcagttaaaagaagcaccttggcattttccttattggagtttgctgtgtgtttgcaaatcaaaatgggaattgattcagtcatttgggctatacaggttttcatctcaagtcacttaagtgaaatccataaggaaagatgttcatgctttacctaccatagggctcactcacctcttttcttaaatacaaaacaaaaagcacctgccagttttaagggactgaaaaggtgttttatgatggctgaaaatacatctgagaataataatatagttatacctagactggtgatacatcattacagtatctgcggggaaaagtagagggtggaagtctgtatgtggggtcagtcttaacaaggaaagctgacatgaatgctctagccctgcagtaccagagggcacctggattaatgttctgggccctaattcagcgtcctgtctctcagacacttggcactgatttgctcatctcagagctgaagtcttaaggactaagaggagagaggaacacatcattttctctgccagaggaggtacttaaactgggaaaggaggaggagaccttaacaaatcaagccttggcaaggaaatctgtcatgaatcagcaatgccttggaaagcctctttcgctgtattttacaaagctaaacacttgtcgctactgacatttctctattgcttaccttgaggatcagctttaggtagcactatgaatggaatgaatccttttttgtgtgtgcccattttgacattaggtaattaatttacaactagctcaattagagtccagcccatacagtgtgtacatggccttttaaagagcctttgttttgacgctaattgaactggttgtagcagagacagccaaacaatttgcattcatctttggcagaacacaagggctctcccttggtatggacagccccattttttattccttctaccaagtctggcactaaagtgatgtgtgcttattttatttttctaatttaaaaaaactttgaagaggacaaaagccacataggtttattgtagaaaaattggaagacatagataagcaaggaagaaaataaagatcatacattatcttttcttcttaagacggagtctcaatctgtcgcccaggctggagtgcagtagagcaatctcggcttactgccgcctccacctcctggattcaagcgattctcctgctgcagcctcctgagtacgtagctaggattacaggtgtgtgccaccacacgtggctaatttttgtattttttgtagagatggggtttcaacatgttggccaggctggtctcgaactcctgacctcaagtgatccgcgcccccccccccccttggcctcccaaagtgctaggattacaggtgtgagtccccacacctggcctggagcacacattagcttaataccaagagaaaaccatttacaacctagtatttttctttctataccttttctgtatatgagggaatgcatgcacctgtgtatgtaactgttttcatgtgttgtttttacaaaatgggaacacagcatacaaactgttttgtagtatgcttttttttcctacttaataagatggaagtgccttgtcattttataaaatgttgtcctacaacatttttttttgagacggagtctcgttctgtcgcccaggctggagtacagtggcgcgatctcggctcactccaagttccgcctcccaggttcacgccattctcctgcctcagcctcctgagtagctgggactacaggcgcctgccaccacgtccggctaattttttgtatttttagtagagacggggtttcaccgtgttagccaggatggtctcgatctcctgacctcgtgatccacctgcctcggcctcccaaagtgctgggattacaggtgtgagccaccgcgcccggcctgtcctataacattttaaatgtctgcataatagtcaattgtgtggatgtaccaaaacatatttaaccaatctgttattattggacacttgagccctttccaggttttcgatgttataactagccttgtgatatatattcatgctactaaatctttgtgaagtcttaattatttgcaaccaataaatttctagatattgaattacttggacaggggcatgcatgttttaacattttttatgcatactgccaaattgcaacaatttccactttcagtaatgacagctttatgtttattcttgatattcaggagtacagtatagagagtattgactcagaagtggattaaatcctgatcagtgattttgctattgcccctgaaatttacgtcagccttataatcttctgttcccagtatcaggtgaaagaggccagtttatatcatatagtacaatataggtttacttatcttgactaatatgtgttatttagttttgaaaaattgtagaataaaagcaggtagctgctgctgtaagacaaaagtgcctttgtttttcgtaaggcaggattctgaaacagtgttttcactatgaataaggaccaacctaaataaatagatgaaaatcaaagcgatagtagatggttttgctaagtatatgaaaaaaatatttggatcttcttgaggcagtgaaacccaagactggaggagcaagatgaactgtggcatcttgtatcaggggtggccttggagaggctgttatacctcgtgtatgtggtctatcattgactgaacatttgttatgctgctcatgattgtatttgcagcacctgaaagtgcagttggacaaatagatgctcattgttgactgaatgaataaatgaatagaatagatacacaggagagtgagatttcagaaaaagacctttcaggtcatctaagaccctccccctaattttattttactttattttttgagacaggttcttgctctgtcacccagactggaatccagtggtgcattcacaactcactgcagcttcgaactcttaggctgaaatgatcctcctgcttcagcctcccaagtagctgggactacaggtgcatgccaccgtgcctggctaattttatttttttgtagagacaaggtcttgctttgctgcccaggctggtctcaaactcctggcctcaatcagtcctcctgcctcagcctcccaagtgctgggactacaggcgtgagccactgtgcttagcccatccagttttctaattaaagacatagaagttcagaaagatgaagtgacatctttctcaagactaagttaatgatcacagcagaagttgtagttctctgtatcaatgtatttctgagattctcatagtactagaattgtatgtttttcccttgatatggtactttgtatgattaaatttcaaaatcaatagtaaaattttaatttcaaatgcagtataagcacaatttccctaactcctctttttttcctctgtttggaaatagcctcagtttttgttaaaattcaacacagtcttaaacttgcatttcttttttccttactttctttctttctataatattttcacctatcctatttcattcacagtggaggttttaatttacttcaagcagtattgccatctggatgtcaaaagacattgaattgacttcttatctgtagatcccaataaaggtctcacctgcctagaaacaaaagatttagtcaggaattgaggaggagcaaagcaaaggcttcaccagaggcccaggtgctacctatctgcccacttgttctttgattgacagtggggcacagaggtgccttgtgtttctctaggaagtagcttttgcatacagtgtttgtttggaacttttcaatttgctagtgctgaataatgtctgcagtaaaagttggtttagggtaaacccggagaaaggaattaaagagaagttttaacatttctattgtttttcttctgtgactttagcctttcccccttcttagtgaattattatagagttttattaaaatgtaagttctggaaattagacaccatggtatttagaccagcatgggatactgtactcttaggttccataatatttcatagtacatctctttattgtatgttaaatgatagcgaagtataataaaatgcacctagagagtacttatctattttatgtcctgtaacattcagtacttgatgcaaatgtagcagatctcgattcaaacaggagcaaaactggttataactcaagagaaaggggataggctcatcttgatggaaagttccctgttggtggcataagttcagcaaaaccatagaatttgaggctctaagggacctttgtaacatctactccaatcttttattttgcagatggggaaagaattagccactggttcagtgtcactcagcaggttaaagaaagacctgtgggcagaacctagaacttaacgcctgctctgctgtgtcttttcattttctgatcacaattgaagcatgtggtctaccctgtctttaaaagagcataccatttgatgtttgttagcttgaaacctgttgtgcccaagggcacctaaaggcttccgtcttgctcccttttcctggatgcccaggtcattctgtgcctctgagggtgggtttggatatggctgaaatgaaagctgtgttgtggcagtgcttagagaattgtctctgatgataggactcttttaagaaagcagtgaaaaagcagtaaggagactgttacttcataaaacaattggctctggacttggagaagacccaggtggcggatggttacatcccttggcagcagctgtctttgctatatctcttacagtcttagagatctgggagtctttggctcttaattttaacctagattcactgtatgatcttggtcaaacgcctcacctcttgggcctcagttaccttgtagtaaattcaaggggagttaaagtggatgatttctatggcaacttccaggccttgaattattatttttataaaagtttttccacatgatcaagtaaccaaacatgtattgctgacagtccattttattactgttttgattggttttcatgagaatttggaaaatgtctgcagactttactgtgatcaggctgctagcaattatttacagagcacccatcaagtgttcagggctataaaagaaatagtgtctagcttcagggagacagaaagacttcttgatctccccagccggggatggagggcattctcttccactggatttaagctctgtgagtgcaggggctttgtctctcttaagtagtgcacagttcagtaaacattggttgcattaatgaaagaatgaatccagttgtcagtcttgcttatatttactgaagatatcccactgagatttattggtttcttcaacccgtaaatgctgctaacttgaatacatttcccagaaagtattccttaccttccatagaaaaatgcggccaggatgctctgaggctatagggaaaaaccataaatattccactcctttcttgaaattcaatttaatattagcatattgaatgccctgagattacctgccttcaaatattttggtttaacccagcatttttgaaattcatttgacctcagaatattgttcattccactctcccatgacacacttgttaatatcccccagaactttgatttgtaaaataaaaaggttgatatagggagtaataatatggaataaatagaagcagcaacattagttaagaataattaattgaacacaatggagcatatacattaagtgctgttcctagcagctctgtgtgaaactgtggtagacttgtagattttttttcttttaaaaatgactatctatgtctcattacagatacaaggttgggtggtagagagattgaaggaagttgcaagtgacctaatagctaatttacagttacggaagttgaatggtagcattttaacttgtgtcaagggctgccctgtcaggtactgcaggggaataacgatgaaagggagtctgtgtctgctccttctggagctggctgtccagtggaggagacagacatgtaaacagattatagcaataaagtactcaaatgtgtaatgaacagaaataggacacaggaaggaatggtattttcccctggtttagaacagggttgctgttcatacaataagcccaaaccacattaactggaacccctctagatcctccagacaaaattctactcatacatcaagattcaaacaactcggcctcttcatgctttcgctgatccagaattaattgcatcatctatattgcctgcagagccttgcttacacctgtgtcataggccttatcataatctgctttgtatgtgaattacttgagggcaggatagagttgtctttgtccctgtatctctggggcctgcagttacagcatggactgcatattcgctgctttgtttagacttggagcaagttattggactgtgaaagctactcactttaagtaaattcagtaaataaaattatgttttatggaagacagattggacaggtggtggtattattagcattttctctcaatgcttaaatatgatttacatttcaagatttcagttacattttttaaggaattcaacaattctgcatcatgaagtattctttcacacaaatgttccatagtcattagtttttacagaacccttttcttatattctgcatttcatctggaatactataagcacaagttcagtttggcattctgttctccactagtgattgagtttgaagcccaaggtcaggatattgattgatgacatttccctttaaagtatttgtatccatttgcaatttggggacagagtgattcccagtatggtgcaggaaataactaaactggaagtcagcctgactcagttttgtagttaattttctttgtgaccttgggcaagtcacttaaccttccaataactgagggagttggcccagaactagcacagtcttctaatgcagacattccacgattctctagggaggattcacttccatagaggtttaaaagtggatacatttttaggttaaatggctttgttcatttagtttttttctccttaacccattttggagcaataagactgtcatggagtaaaaccaaattacctggaactctcaaaaggctgcagttcttatcctattttttttatttttaagggaagggaaaaaaatggcaacaaacaaatttatatccatgagtcaggacaaatccatcccagttttctaacatacacagtgtacataaacatattcaatgaagcactgcagattcttaaccgaaaatggaatatttggtttgacttaccatcctaaatgtgggaagaactgtactttgatatatactttttgagtatttttagcaaaaattgatataagcagttgtcttggttggcaaggacttgtgtataggaacctggctcccagctcagtgacgagtgtattctgtaactttgaataagtcactgaacctttctagatgtcagtgtcctcagctgttagatttgatactgttctgattactaacagatctgtgattagacatttccatgcatttatttcaggcctcttcctgttctcttccttgagagattaacaaatatacccaccccttccctcacacagtctcaggcaattattgatttgtgagggaaaaggggtattttaaaacactttaaatgatacattcaagaaaattatctcgtattggttatcaattgatatataacaacattaccacaaacttagtgccttaaaataatacacatttattatcccacagtttctgtgagtcaggaggagtctgggcacttcttagttgggtcctttgcaaggctgcaatcaagatgttgtcctgggctggggtctcacttacacgcttgactatggaagcataagctactgagcccactgtgattgttggtggaacttatttccttgcagctggaggactagagggacttaatgtttttgctggctaggggctgccctttgctccttgaggccacccacatatccttgtaatgtgtgcttccctaacatggctgctggccccctcagaagcagcaagggagagaacaaggcagtgctgcagtcttttggaatgtaatcacataatcatgtatacataatcatgtatgtccatcatctttgctctactctggttaaaagcaagtcacaggtccctcccacgctcaaggtgagatgatcacacaagggcattgacaaccaggaggcaagggtcatgggggccgtctgaagcatctgtcagccacaccatatttcaggttttttttttttctgtatcttcctttggatctgtgaataagtatctcacttcatactaaagcctcaataaacactgattgacagaaagtctttgtgctcatttaaaacttctcagctccacagagtatttgtaccatgcccttgttttatggagtccccagatactgatgagggcagggtttgagtttgagggctgttcattcttctgcccgccaaccccccaccccgcccccagcacagaactgccagtgttaggtgctcattaagtgtttgtcaaaggattataactgttgttccaattgcagcagtaagtaaatttgaagaagctccctgatattgagtgaattgtattctccaccccccaaattcgtatgttgaagctctaacctccaatgtgatggtagtcccagctaccagagaggctgaggtgagaagattgcttgaagccctggagatgaggctgcagtgagccttgattgtgccactgcactcaacctgggcaacagagtgagaccctgtctgtaaataaatatgtgtgtacagacatacataaggttcacaattcaatttaaaaaagagaaagtgaccatctacaagccaggaagagagcccccaccagaaccctatcatgctggcaccctgatcttggatttccagcctccagaactgtgagaaaatcaggttcgcctgtttaagtcacccagtctttggtatttcgttatggtggcctgagctaagacaggccctgtgttctctgtgtagcaagaggcaggaagctaagcacaaaggttgccagatagcagggactggctggctgttagtgagccagggccagtggcatttaattgcagtcattcccattctttgctgagctttggtcataactatttgtagaggacccctagactttttttttttcttccaggacaaaagtgatccaaaacatactgtcttcagtttttgagcattggactaccaaacaggaacatttaaggaaaacaaaatgttgctgttgtaaagccttgatggtgggaagttatgtagtgaattctcaatttcttcttcctgcatcttgtcttaaaaaaaaaaaaaaacttttaaagtttttgtttgttcatcattcattcattaataagtcaagatgtagagggctcagtagccttcccctagttttctacatttctgactttggtaaacttcctttacttctgcaatttccctaattgtaatattaacatatatctaaaaagaatacaatggttatgtaaacctcctagcacttaataggcactcaagacaatatgacttaactgtataagaatgactaatgtgctatgtttatttatttggcttcattcattttgccagcaatggtgtagtatatatgtagtatatattaaaaatctcttgagtaagagaggtttggaatgggaaaaggaaccaagaaaatctcaccatctttcttctgcttggcagcaagtcttgaattctgttttatttttcttaagagacggggtcttgctctgtgcccagactggagtgcagtggtgctattatagctcactgcagcctcaaactcctgggctcaagtgatcctcctgcctcagctacctgagtagcggagactactggcacctaccaccacacccagttaattttttttttttttttggtagagatgaggtcttgcagtgttgccctggctggtgtcaaacttctgacctcaagtgatcctcctgccttggcctccaaaaatactgagattacaggcatgagccactgtgcctggcagagtcttgaattcttcaacagggcttttgaatattttaaagccacataaaatttcctttttaaaattgcaatgaaaattgtcaagtaaagtgggtcattttttgacctggtgcttaattgtacttagaagcaaatgcatatctgtaagtaaggggaggactcagaagtgatttaaagggaggattgtaaaagagtttgggaagtccatccctttcattttacaggttaggaggctgagggcattgtgcaatgatgtatagtcaggtagagagaggaaacaggaatcataaatcttaccttttgtacaaagtcaatgttttcagtaattttgttgaaaacaaacattaaacaaatttggacctgtaaaatccattgaactggtggaggtcagcctgacctagcaggacatgtggcatctctgttttgtgatgctgtatctgctttgggagtcccagtgcccaatcccctcagtgttgaaaacttagctcctgagtttaaggtggtttctgtggggttatggggcagggggagagggtttggaggaggggaggagcggaaaaagagacttccagtctggggctcctgctgtgttaccttaggggatttagggcctataaaaaacacatttacatctctgaatggcaacagataaataccaacgagcgttaattgaaaaggaggagacccaatggactagaggtcaggactctacagtgatgactggtggcctgggggtgtcagctgaaacggtctggattttttttttttttttttctccttcttcccctacctccttcctgggcttagaaatgctggaaggaagaaggagggaccattagttgaactaagaggtatgttgtttatactgttgttgtggttgtccctgggtggtctgaaattttggaggagggggtagggaaaggccccctaaaccttttttaaactagtataatacaacctgactgctacctgcagtttcccaattacccaattataacacaaatttgcacatttttttaaaaaagcaggctgctactgtttctccttatacaaggattttagtcactgtacatcttgtgtctttaaataatgtattaggaacattttcaagtctgtaagtgcttttttaatgagagtgtgaagattttaatgggactagattgcttttcatgacatttcagagtgacttaattgtaacaatgttgagaggctgtattttaaagtttgctaagtatgtctgtgtggattatagtcagacacttaaaaggacggatggttggatagtggaatcagatagcttttccttactactttctccaaatattagctctttgcaaatatggttataccaaaccaggcacaggtcaggattctcttaaaccttttaattttcagataggaacagaggctaataacagaccaatgtgggtaattttagagacaatttccttaaaacttagttggactgcaatattggtcctaaggcctctcctctctccttttgtagacccaggaggccaggctgtctttgtgtatacttcctgttagtccctgaactctcttccctgtttgctttaaaaacatagtgaccttgaccgggtgcggtggctcacgcctgtaatcccagcatcttgggagggcgaggcaggcggatcacgagatcaggagatcgagaccatcctggctaacacggtgaaaccccgtctctactaaaaaaatacaaaaaattagccgcgcgtagtggcgggcgcctgtagtcccagctgctcgggaagctgaggcaggagaatggcgtgaacccgggaggcggagcttgcagtgagccgagatggcgccactgcactccagcctgggcgatagagcgagactctgtctcaaacaaaacaaaacaaaaaacaaaaacaaagcatagtgaccttgtgcctcatttttttttcaggtatttgagttagcgtttctaaagcattatgactctccagataacagtttaccgttttaatgattggaatttcagactcaatttttttcttatctccaaaacaagaaggttattcagaggtcttttcctatgcaaacattattaggattctagaacctgtggcagacttctcaaaattagatcaaatggtcagacactttcactatctttttttttttttttaatggtcttgctctgtcacctaggctggagtgcagtgccatgagcattgctcactgtagcatcaacttcccagggttgagtgatcctcccatctcagcctccttcctgagtagctgggactacaggcatgcaccagcacacctagctgatttttaaatttttttctagagatgaggtctcactatattgcctaggctggtcttgaactcctgggctcaaacaatcctcctgcctcagcttcccctaagtgctgggattacaggcgtgagccaccacgcccagtctcctcagtgccactcttaatagaagcttgtattagtttccaaggctgccataacaaagtatcacaaactgagtggcttaaaacaacagaaatagtctcatagttttggaggctaggaaatgtgaaattaaggtgttggcaggaccatgtttcctcttaagcctataggggaatctttctttgcctcttcctagcttctggtagtttattgacagtctttggcattctttggcttgcagctgcataatttcaatatttgcctttgttgtctcttagtgttctccttgtgtctttacatggccatcttctggtaaggacatctgccctaatccaccctaatccagtatgccctcgttttaacattggtgtctgaaagaaccttatttctaaataaggtcacattgtgacatactgagggttagggctttaacgtatatttctgaggggacacaattaaacccataacagagttctactttgaaaagtgcctaggagattctgatgcagcctgcatgggttcccaaagcatgattcctgacctatctgtacataattcatcaagagcactaacaaacttacaagacatatatgtataatggtatataagtatgagtgatatacagaagaaaaataaacccaaaactcatgtactcatcaccctgcttaagaagtaaaacattaccagtacctttaaaggctctggaaagcctggggtgtttgtttaaaacataggttctcctctgaggggttaggtcagggaggtttggagcaacaatgtgtattagaattcagtaactttaaaaaaaaaaaaaactccacgtgcattttaaagttggtctttaaaattttactttggagtgggatgggattttttttttctattagcgaatagaaaacgtgcaagaaaagatgtagtaacttttttcatagtgtagtagaacagtctttggctcctcttctttttgtgaggtttcttgagaaatctcacctgtacttggtataattttccaaattaatttagatctctgacccagagagacttagagtgatgcacagtcatgtagggggaggatgtgtatgtgtgaagggacctgttattgattatacgtcttacattcttgcctttcttgtgggattttgtgaagattaatatctgccagataggtttaagtttgcaaaatgccttgagttccttgggggaaactgttacataaatgtaaataaattatgcagcacctgaatttggttgttcatcattttttatagtgtgttttaattaagaacttagtgctatttaagttggatggctggggagagggtttaatcactccaagatggttaagtaagtaggtaggagcaacatttaggctggaacccatggaggaataaatgaacaagactggagaccagtcattttccatggcatttgctgagcggagctgtggattaatgtctcttcttgtacgtgtgtacatggtgctgttagaaaatcagccagtttttcactacactttgtctcggacctgtagataccttggacctctctggttttcctgagtaagctggaaaccctaacaacagccaaaacaaaacaaaaacggagtttgtcttacagtctaggtacttggggagcaagaggcatccagcaaactgcattggcttttggtacactgtgtttctgtagtccaatgagctgggttccaaactacctccttttgcctgttacatacagctttgtgttccagtggatgatactgttccttaactcttaaagagtggacatacgaaacagttgccaacaacccgtggtccagttgtgcctcctttgtttgctgctttgtcagagtctcactgtatgcttttttttttggcctttggcgctgtgagcagagtcacctcatcctcctttccgtggccaactcaaagacttacaacctttctccctcattcctatgtatctacagaacactcactagttgctaactagtggatacatgtgaattatgttttgatgccatagggctgtctagtggaggatacaaacattaaaaaaaaaagctaaatccagcaaatagctataattagatgagggttatagagaataaccacagactctttcagagcatataaggaggcgaatctaacccagtctcggattctggcaaattgcttctgaagagtgactctcagcaaaatctggaaggatcactgggaagaaattagcaaggaaggaggaagaaaagagaacagtgccttctaagaaatataccatgaagtcatttttttcctattcctttctctgcccttttccttccccacacagtcttatgcagcagcacaattttagccatccaaactgggccagttgttttgttacactgtggatggttggagattgagagctatgggaatgggtaggagttaaaaactgaatataaattaggtgacaagagatggcaaaatcatttattgggatgattaacttattaaattgggctattcccatgctgtttttctaaaattgtgctctgatggccattttggaagcctggtactacccacagactggagtatgtcctaagtaggttaagagcttgggaaagatgcttgctgagggagggccttctttgtactctttctatcaataagaaataataaagagttaaagcatcgttacattttagatatactttctcaaactgctgacatcagaattgccaggagcctgttaaaaaggcactttctgtagccttcctatcccaggccttctgaattagaatcttagcagtaggattcctggccactgtaaagtactctattgaaggcgtggattaccagtgggttattcagaggagaactttcatcattttagccccgtgggtccctgcctgatttcctgccatctctcactaccaggaccagctatgtaatttgtgaggccccttatttaaaaagaaatattaggaatttcgagacagtgatggtagagcattaaaccaagtatggggccctttctggatgtaggtccctctgggattgcacgggttgcaagcccatgaagatgttcttgttcaccattcctgtttgcctttttaaaatgctcctgcagtaatgaactgcttattgctccctgtgcatgatactgttttttgcctttgtcccttgggtctcactatgtggcatgctgtgtttcatctcttttctgtcacctgggcttacctcagtttttgcacatactgcgttagaatcctgtgcaagtcgcccgtgctatgctgtgtgctttgagggcccggatctgctcttcctcatctttatattccctgcccttagctgaggctctgccttggtcttctgttaagtgtgctgaaagggatacttttttaacctgaatcttttcttaaaacctaattaggttataggccattgggaatgcagatttggttcagagtgaggagttggaggctgtgttgccctagtagtgtcgtgaggactgcctgggcgtgactggtctgagacagtgtgaggaacggggtgtgaaacaaacttatgacatctctggcaagtagtgcatactctgctgttgacacctttgatagctgctaccctctgataaccagtgtttttttttctggatctctcattgaactctgagtttctgggaacagcagatttttctgagccacaggttcagatgtgttagcagaacctgaggaaatgtttcttgcaccaggaaggtggccattttactccgtggctaatatttggaactagtcatttctggattgtttgaactagcgtgttctggggaattccccaaagctggacgcacttgttaaatgaggttatggctctgtggggtgagaaatagacccgcctactatacttaaaaggactgactgtgtttctgccttcaggtaaccagaggtagttatgaatttgggtgaaacctcttcatctcatgatagactagcaactagaggttcagagaagttacacagaatattcaaggttgattcagatagtgactgaattgggactagaatccatggtttctattctgtggattttgagtaagatcactaatcaacatgtgaaatcttccttgtgtcattcaattagaatttaagtgtcaaatggatggtaaaatcatttcttagcttatgtagatcataaagattagcaaatcaaggcagaaaaagacccccacacatatttgttgccaggtctgcactaatttctggataaaggttagtatatatttggtctacagggtgtgatttgagtgtaagttttttctttagtttttagattattgttcaaagtccccactgacagaatgcagggagacagccttgattagattaggccagattagattaaatcgaatggttaaggcctttggagcctccagcttgtaggagacaccataatggccttcatagcgtccttaaatcctattaggtaagttaatcttattgaagatttcaggtctgcataaagcagtattgctcttatactctctatggtgggctctgcttgttaaggtgagcaggcattttaactttccgggaataagttggttttattggtttggggcaagttaatctaaataacttgaaagtagacacctgtgcctgatagagaggccattccatgtagcaaaataggctgtctcctggcttcccctttgcttggtggctgttagtacctgtgacagggattttttttctttgccctgatttggggaaagagagtcaggtgagatgtgtaataataatgtacggagacagtagtatggttatgacactgaggcactactagatattgagaataaagcactttggaacttaggagctggaagcattcttagctgtcattttttgagtgtttatagttttattataggtgctagttggctcttgcctgtttctacaggtgcagtgaccatttttctgaagcaaaatattcttgttgtcacaggcttttcctcaatttgtgaatttatggacctgcaaagttttacaaacacatgaattatgtcaaattttgtaatgtcttttgaaaaaaagggggaaaagtgtaagaaatttagaccatgtaggtctgaaagtatgcttactacatcgatagtgggggctggaggaactgtgaaaaaagtaatagtaaatttccttttttagatctttgccaaaggtagttttgttagatataaacaacttcaagacccacaagtgactactacacactggattggccttcagagatactgggattttctttccaagtatctttaaaaatgaggttcgtagtgctttagctaggaggctgagtgcccactattaagatcctgtgagttaattggtttggttcacaaactaactcatattgcagtgtatctggctgttttgtggctgggagaaggttcctgcattgaagggactgaagtgacactctgaccttgggacttccagtgctgttgtggagtggggacttccttcttcatgtgggcttgctggctcttcatttattgtcccacctgggctctgcctgttactcttctcaggccaagaagtgagttaggttccttatttaacttttctaatggggcagctctgcatctgtgtcctgtccccaaagactaaagagaaatttcaggtgtgggccagattatggagcctgaagaacagttttatgattgattaatggttttgatttgcttttaggaagaaaagtgcaactagcccattggatgaagatagtatctctctccagcactcctgtatcaagtgtacagtgttctcttcctgtatagcacttgtattttcaagagctagggtcattgagagaacacttctcactcatgagtttcagagcgtagcagagtacacacacctgaagcaagaaatgtaattttctctaagtgtactaagaattactttaattctctgtatgtgcatgcatgtgcccacataatggtggtgggtttggttttttttttttttcatgctccttgaggagaaataacccgttttttgcttttattgattcacgattacctacttttcagggttacctttgttaggaagcagctgctggaagaatgtgtgctcattttgtacttgtgtcctttacttctatgtcctctctgacctgaggctcaccctgcctgccacctcctctgcatcagcccagctttgttcttctgggcctgttgtttccactctatgaagagacctccttacttctctctgtctctacttagtatccatttctgctgaggcagatccagatgggcagaggttggggagggaatttgaatgaggggaaaaattggatcagttaggggaaatttataaaacttctgtattctgtgctaatagttctcagatgctttggaatcataagacgggatgttggtctggcgacctttgagagctgctcttaaccagccagtggacagctatgcttgctttttcttcctgtcaccatctctgcttttcttgcccaatttgccaggaagagtccaccaattcttcataagcccactttttattctctcttttgaagtcatcttgattcacttcctacacctgcagcccccagtcttgcttgatctagctcctaatcttctgcttccctttgggacagaggagaagctgctctcctcgccatgctttgctgacatctccaaggggaaggagagcacaggccctttcatatcctgccccagaccttcacagggagcagtaataatgcctaaaccttattgagtacttaacatgtgcccagcactgtgacaaacacttcacacagattatctcttaaaatattcaggccagcccagtaaagtttatgtactgtcattgtctgtcttcaatttgcagatgaggaagttgatgctcagggaggttcaataacatgccattatgtacacagctgaaatgagtgatgcaatcaagattcaaactaggcagcccagttccagggctcttgtccaactactcagggaaaggttttcgaggtcactgccaggatagctggacttgtgacggttttcctgtttgagatatctacccttttacatcaacctaagcacttactgtctttatattttcaatgaactaagtggggtgttctgggtggtctttgatgatggcaactgtgtgttttaaagaaccagaaagaaaaatgtttagaggtgggcttctttagctgtagtccctcttgactgtgtggtcaaataatagggctcctgacaaggaaataaggctataagtgctcttgctttgtaaagattagttaattggtagaggttgtgtttctgtggttaatttgtgctcctgtcttagcaatacatgagtatccacaggcagcaagtgtgtcgcccagcagccccataaaacaaggcactcttcagcaccagcatcagttgatgcacctgaataacaatagggaagcttgttgaccatttggcacttcacagcctagtaattagaaactgtaaaacaataatacagacatgaagcaaatcctccagttaatgaaaaaaaaatctacaatcttgcattgtggctgagtgcaaaatcacaaccggccgcttatacagcaaagcaaacacttcaggattttggcagctgttttgtggatataaaaagctctaggctctgtattaatttggggcctgtcatattttttaaaaactgaaaacaattacctgactttctagttttttgttgttgttgttgttgttgtttttaatttactgcagtggttctcaaattatggtccccagtccagaagtgtcagcgtcatctgggaacggttagaattgcagattggtggggcccaccccagacctactgaaccagaaattctggcagtgcggggcacagtaatttgtttttacaagtcctccaggtgattctgatggactttaaagtttgagaaacactgagggtgtgggaagggtaatttgggggaagggaagtggagtcccctcttggccccacccagagatgagcttctctgtctagtggtgggatagttggcttgagatgtgatattgagaatatatgaaggctccctactgggtcaggaagttgggggagtgtctcaggggagggccgtgccttcctggggacctgtttaggagaagggtcctgggcagtagcttgttactagcctttcgggaacaatttcaatgtttcagtcaccctctgggctgttgtactattgcagtcagccctgctaggcccacaagttgtatggggcagaggagaagaggcatggggacagaaaccttatatcccaggcaaagccttagcaatgctgctgatgtcatatgctcatcgttgtcaagaattgaaaattaagatagtgatgaggtggtggcaggacaaatttcttcttttcactgtatgtcccctttctcttctggatctcatttccctgcctccagctatcttggcagatgggattatttaataattttcttggggcctgttggcaaatggcccctctgccccttccccagtgtgtggtgaccacaacagtgacatagcttcatttcacagccattaggaatcttgacgcagctgacccctagatctcctggaaaggcctcttgggaaatataagcttgccaccagagtgaagtgaattctcgagtggtattaccacagaggctcaggttcctgatgctccttggagtgctaggttaacagtctctctgttggggaaaaacttgatacaaatagaagatttgctaattttgctcacatttcaaaattgtttaatttgcttactttttttttctctttcagactattgggttttatctatcattccttttattttacaaaaaagaacatagggcatgttggccagataatgtatcctgttttttgatttaatcacccaacatagcatgggaataaaaagctgaatgagatgtagccttgctcctccctgacattgaagagactggcttctgggagaggaaaatgaccaagaaaagaaccacccagatcttgggttcagtttattctctctgtattttcaagtggcagaacttgcttgaatatgtgaatttgatgttggatcacaagcccaacatgtggcttctgtgggcatatgtagttattttggattttattttattttaaagggtctgtgtcctgttggcttttaggaggtgatagttgctgattctcctttcatgtgacattcagggctcatggagaagtcaaaggctcacactggtgttcaccttcctggacttcaggaaagatagtccttttgccagatgaatgggaggatctaagtctgttagatttccatgagtcgtgcagcctttctggatcgggacaggaagactgacccactgtccttcccaggctgcctgccgttcatcttgctttaattaaatacacagctgatgatgtcagcttggctcccggctccttcagctttcccctcagaacaaaacatccgggcagacagttgtgacaattaagtctcaagacccaagcttagtttgttctgaggtagttaagataaatctgcctaagcatctccaaatgcagataaaacctagtgctgattagaggtgaccctctaataaacctgatttgattaggcagaaccagcgaggtgcaggcaaatatttgagactctggccaagctgatattccattgacctttcacttaggggaaaaaacctgtttgatttttttcctatcccagagtacttgaaaattattacctatggcagctaaagcactagggcgaaataaacaggtgagacctgtggacttgcccttaagagtcgcagtcagctaccacctgggttgtgcttgcttcctggcagatcagtggagaatggattttgccggaggtcctggcctggaatgataattaaaaaggatgtttcagaacacacccaggtgcgttctgataaagcctgagcagatgtgggtggtgaaggattttttttttaaagtcaaactttgtttataaaggtaacttctaacaatttattatagaaaagtcaaactagaattgcattagtttgtttatatcaagacctcattagaaattaaggagaaatttccttaattgctccatctctggctcctgtaacagtgggcatacttctcttcttagcatttatcacattgttctgtaattgttggtttaccttcccttttgtcttaaaaagcagggaaattgtataattattcttgatgttgctcaaatgcttggcacctgggccaggtacagggattggcaaagtttggtccacaggccaaaccaggccactacctgtttttatgcggtcatgagctaagaacagtttttgcctttttaaatgattgaaaacaaatcaaaggatatatatttcatgccacgtgaaaattatgtggaatttgaatttcagtgttcataaataaagttttattggaatacagccatgctcattcatttacgttattgcctttggcatcattttgcactacaacagcagaattgagtagttgcagcagaaaccatatggcctgaatagcctaaaatatttgctatctggcacttcacagaagtagtttgttgatccctttcctattatatagcaggcatatagtgtaaatgcttattgtttgaattatttcaaatataaatctgagtttacaaatagagttattctgatcctaaaagtgttcagtgaaagttagatgaatgactgaccaatctatttctcttgttattcatttgtaaccttaggtttaagttttagaggtagtggttcgtttattagagctagacaattatatactatttctcttctgagaaactttataaagagttaatccttattacttttctaggttctgaacctactatatgggatgcagagacaccaagaggcacagagaggttaaactgactaagacacacagtaaagaaatggcatgactcttcatgtcttcatctctttctttgtttgctaaagccattctttgtgatgaaagagaagtcaaatctggagatattcatgagcaaactactgtctgatactatataatgcattatttcttatagacatcagtatctttgtaggctctttggttcattaccagggaaattcatttaaaaaaataataaatatgtggtttaaaaagtaaatactgcagagaatgatagcaattaccaaatgtaaacaatgtggcctttgagaaccactatgaaattgtttagtgaattaaattattatgcttttgctattcacatatccacttccattgactgttaaggaatatgcttcaaggaggacagatgagatataggtaaagtttatttttaagatacttaggtaaaacaaaataaaccagcaactggcagatgtttggtgaccttgaaatctggcttttgttttgagacagtgtctttaaaatgaccagtgccacaaatgtaaacaggggagttggagggcattggagtattcaggaagaaagtgagaaatcagtaatttgtagaacatgactaactggaactattgtttggtctgctggggtttgagggagtagaggaatttgtgaagaaggaaagaaggttaggagatgcatagagcagagaaacaagggtctaagctttcctaggaatctcaggtcagacccttgttaaattttgtccgtatattcattgtttgctgtggaatcttttaggagagtgtaatttttttttctgtttttctcttattaaataatttaaagggatgacattcagggctttgggaagcaattttttttttttttttcaaaacgccgctatacctactaattggatatccatcaggggatggatacttacaacagctctgcatgatagggataatattcctattttatggatgggaaagctgaggcttagttgtttttttttttttttttttttgagatggcatcttgctgtggctgaggcttagtttaattggctttcccgaagttttacagttagcagccagagccaagtttcaaacccaaatctagctgactccaggggccttctgttgtttctactatcccacttcctcagtggttgcatcccagagatttcatcgtttggtgcataaatccagcctaaagccatacttcaccattttgtgtgaataaatctcttcctcattttatgactcagctacctgctttctctttctaacctgttattttgtacatctgatttgttagcttcccatgttcccttagcttccctgcccttagttgttaacccttttgatcaatatctagttgattttgctacttaataacagactttagagggacttcagaggataaaaactagaacctccaccctactgaaaaattacatttggtttgccgttggtagtatgtgccccatccttctgccctggcactccaggggaatcaaaaaggaagagctgagaaacagcattccaggcttagaggctccacattctttgggtttgttggaagacttcttggcagcattgaaagatgcctgtgttttcatactgattttccatcctgggccacctgctttctcccttcctgctgttttccttttgtacctatgtggttggtgcttctggggctttttatagcagctttcatcatttatactactgagttttgcaggcgcttttcttttcaatttttgatgtttgacagtatagacttttatttatttatttttaatatgttcacttctgaacctttttagacttcatggtgacagcctccaggagaggaaaaacaaaacaagggaaattctaggaagaggcagaaggtagttactattgatttctctggatgcagatcctaactgttggcaaatttaaaacttacttattttgagtggaggtggttctgtgttagtgagaagttgatctggaaaagatgctgatttggacatggctgttgtaaaactaatgatgaagcaaaacaaaagaaggaatagtgcattttggccaggcatggtggcctgtaatcccagcactttgggaggctgaggtgggcagatcacgaggtcaggagatcaagaccttcctggctaacacagtgaaaacccgtctctactaaaaatacaaaaagaagttagctgggtgtggtggcgggcacctatagtcccagctacttgggaggcttaggcagggaatggcatgaacccgggaggcggagcttgcggtgagctgagatcgcgccactgcacttcagcctgggcgacagaggaatagtgcgttttcactttttaaccttagttgcacagggtatgttgaaagctactgttggcttcaccatgtcattgggaagtgggaacgctgacaatcaaagcagctaaacaagaagcaactcaggaattatgacattggcggcaagtcttttgcccctcttcagaggtaacactactagatctggagagagttctgtacattcagggaatcttcctgatctctaaaaaatttgagaggactagagaggagtaaagactggaacctggatagattgatttgtgagggacaaagattcagagaagacattttcttgaaggtgatgaacctgctttaccaaaatgttgtaaaaattctaaagaaaagttaattggatcaagttgacaataaatgttagaagggaaaaatcttaaagggtaaaatttgaaagtagaaagtttgtcctgtccacagtgtttgccatttcatagaccaaggtggttgggggaggtggggcaaaattactgtagtttccagtgatcattgccttctctcggtcctataaatgcaggcactatttagcactgaaaccatctggtgttggtggttgtttcttatgtcgtatgacctgcctctataaatacattgtgtataagcttaactgggacagtaattggtgtgatccttttctttttctgatctctaaggtctgaggcccatgaccaagggaaagagaagtgctttttaaaaaaacggacacttttgttgttttggtctcatggtttcactgaggtagtgttccacagtgtaagacaggttaggattgtatgttccagaattatgaacaagagtatccttgggaatgataaaaaccatgctgcagtgttgcatgtgtatttgtgtgttccatgtggaagaccttctgggctgtgtctgtctttgctatttatttatcacctgaaatggtgctgctcaaccactctgtgacagtgttattttaacttgaaatagcatgagggttaggagaaaatacctcatgaatgtgaagggggattctcctgggcgtatgtaattgcaatgatttgaaatgctttcacaggtttgtaggagagggtaatttttcttctttatttgctccttttatcttgttctaaagccagtattacctcctctcccaccgcccatgtatacttcttattcccttctccttccccctccctttctcccactctccatgtaaagaaactctttcctaataagaatcataggtattcagagctttttttttttttttaattaacagttgatttgactttttagtactgtgtaggagatgggaaaagtcagggccatttgatagtaattgcttcctggaagagccgaccaacttattataagggtgaggagtgtttggaggcattattttctggttccaggtgtgttttgagtattgctggtggtgctcagcactcttgacatttggggctggattactgcatgttgcaggagtatcttgtgtattgtaggatgtttagcagcatccctggactctacacaccagataccagtagcacccctcaagtgtgacaaccaaaaatgtctccataggttgccaagtgagggacaggatcactctggttgagaatttctgccttagaaagaggaaaatggattccctggaagcagaggttagccattaaccttatagggctggagccttcatttaaatgctttggtatattgaaagcaccactcaagtatcagtggtgagggcacatttagcttgttgaaattcctgtgtaattcataaatatcatattagctcttggcttcaatttcctaacactagaaatgtagatttttccccttattttcaaaatgaggaggattgtagtaaaatatagtaatctctgaggtcgctcccaacccttacattttatgattttagttataacagacatcttatggaattacacaatataagagttgaaaatgtatttgtgatcatttagccagccctcttctgttagttctatcccgtgtgatttccacaaatagatcagaccagaagaaaatagttgctttttacaagtggatgttattaaatgctcatatttagaatatttatcagaacagacttatattacagtgtttacttttctaactgattgagattcaggtgacttaactgcctaagcttcaactgtctgttgtttggaattaggcttttaaaagttggtctttatattaatattcctatgcctaagctggtactcttattgtcaaatagctttatgctctgttacattaatgagggaaactttgactttccagagtgccttggctgatatattggtgttaaattggtaagctttctatcccaactgctttatttatgctttaaacataaatgaaagcagagaatttttttttttggcctgagaggtagttaagagggaaatctaataccttttatgggtttatatgcttcatatgtgatgtgcccaaccagaaataataagatacaccccagatgtgaaggtaccagctaatataattatgctggagatcattttcaccttttgagggctgaattacattgaattcatttcttcaactctaacaggatttggtatagttacttaaatttgaattgggagctgagatgaagtcccaacacttgtgcttttactggaaggattgggttgtgtataccttttgtatttctgaagcttgataaactataaagccttgagtattcaggttcatggcaaggtttagatggatggggaggtatactctagtagaatctaacagcttagtatgctttctgtgggctcttgcctggaaacccaatctgaaggtatagtgatcagacacaatgctattcttaagccttcttggaaataacaggtgtcttagcctgtggtaaaaaggtaattttgcatgtattaaatattcaaccaagggcatgatctgtgcttattttggcaaacaaatagatcccaaaatgaatcaaacaaattgtaatgcagaacaaatttaaatacttgaggatttgttttagacatttaaactcatattttatcctctgtgtcttcatagtaccctcagaaagaaaagaatctttggaaatgtcagtgaaagggcagtataatctcacactgcagttgtggttccggactcagtctgtgtgcctgtctttcctttcactcctagccacgtgacaacacaaagagggtacttaaagtgtttatttcaccctggaagatttttatagagagcactttttaatgaagcacagcacatggcatcattatcatttctaacacagagaactcattttcaattttgctatcaaagaaaaatgacaaatagagaatgcaagaaaaaccagatggactaactgtattaggagcttagtatgcatattttgtgtcacatattagcattcattaagtcaaaagggaaaaaaatgagttttgcctacatgcattaaaccaataaggctggcaaagttccaagctagctcttgtgaattaattgttttataactgttttaattaaaattgttcagtatatgattaacctaaaagttttaatttccacaaaactgttgaacaaatgagacattaatattttacgttaaccatggcaatattgctgtggttttcagagctctgcttgttcaagcaaagcatggcaagtggtaggtggaaagtaccctgtgtctcatgccactactaagaaaacctgcaaatcagaagcaaattctatacacaagcatttatgtaggcatcgccccaaaccccctgttcagacagtctagttagagctgggcacctgtcataaattgtcaggttgaagaggttaacgatataacatggcaagaatacatttattgtctttttcttccacctggcttcatagtagtgttggtgtaccgtgtgagatccttagattagaaggggttggccagtagggactatgaaatgattgttgttaaattctaggggtttaatttaggatataggtacaaatgttagttctggaatcaaagggaagaaagagaagatttggatgacgcatcacctttacttgaggttctttaggttggcatcaggctaactttggtaaaaccacatcccattttgcaaatggtaaaacagggttggtaaaatttcactgtgtatagctgtggctcctgaaatacacagatttgcatttctgtcactcctccctctccccactttccacatgtacccccatcctaatgtacttcactttgttaaaagatggggatgtctttcctctctcctcccctaagcctttcactttgctctgtggatttgggtcatggtgctgtataaattcaaggtaatgatggtatttgaaccccatagaaggatattttaagagataagattaatactgctcagcataaatgatgataaaactcaggctgtcctaaatgtctaggtagtgatgcattttttaaggcactagactgagcttaccttttaggttgtatgacacttgatataagctgtccttacaggtttaaagctgtaggagtctggaatgcaaaactgaaccacagaagtatattggccttgcacttacatagtcaggatcatacggcattgtgatctatccagatttccagctgcagtcctgatgtggtctcttcattactttgtccagctgtttcttcccagacggtgctctgtgttagccttcccttctgtataatcattctcttccctaaatttttctgtttaacttgttaagcaccagattctgaataaattattcatataatcagtatttttgaagtagttaataatcagagtataataataaattttatgattgtacaggttgccatatttgccagaaatcagctttacacaagtgatttttgagataaatgctttattgggcatgttgctatctgttcatttcttcaggctctcttgatttctattattgtgtgaagttaggccattagaaatgcgcatacctggaccatattatttaggctcttcagagaactgccatcacggagttagagtgctatgtccttggtaaatggaaagtaagagccctcaatttaataatacagtattttatagtcaaataatacatctggcttttgtaaaaccttaaaagtaatctggtatcttaatgtttcattatacatatgcatatatgtgtgtgtatactcacatgcatatatacagacatacatatgtgtacatatatttacacatatacgtacacacagtcatacacatataaaaagcttctctaagaatttggagcgaggaaaaaatgtctgtcttctgaccaacatgtatacattcttctaactctcatgtgtttgtttagtgaatgaatgaatactatgtaattaggtaagagaactattgccttaccctggaaattcgaatcgtaattcagtaaacaattttaggtacccatcctaagtacttgttgatcaaatactattactcttttgcttggtgagtattatttttcatctacttttaacaggttcttctttggttaaaaactgacttctaaaataaaacaaacagaaaacctacttacttctaagccgtgatatgtctgtattggaaaataggcactggcattgcaccatgttccccatgataaggaaacaataagaggaatcatgcgtatggttcctgtcctgtaaagtctaatgggtggctcacacctgtaatcccaacactttgagaggtgaaggcaggaggattgcttgagctcaggagttccagaccagcctaggcaacatagcaagactcccatcttgacaaaaaataaaaaattacctgggtgtggtggtgtacacctatagtcatagctagtcgggaggctgaggtgggaggatcgcttgagcccagcatattgaggctgcagtgagtcatgatcatgcccctgcactccagcctgggcgagagagtgagactctatccccaaaaacaaaacaaaacaaaatacagtacatgtctggcaagaaggagaagtacctagctcagtccattttctactgaaaatgggtaatatataaagaaaaggaatttatttcttacagttgttggaggctgagaaatccaaggttgaggggccacatctggtgatggccttctcactggtggggactctacaaagtcctgaggtggcacagggcatcatgtgcaagggggctgaacatctagttcagatctctcttctgataaagccgctatccctactcccacaataacccattaatccaccagggcagagcccccatgacccagtcacctcttaaagactgtatctctccatgttgctacattgaggattaagtttcaatgtgagttttggagcagatgaacattcaaaccatagcagtgccaaaatcaagcttttgttttgttgtgtttttttttttttttttttttgagatggagtcttgctctgtcgcccaggctggagtgcagtgagatgttgtcttggctcattgcagcctatgcctcctgggttcaaacgattctcctgcctcagcctcctgcgtagttgggattacaggtgcacgccaccacacctggctcatttttgtatttttagtagagatggggtttcgccatattggccaggctggtctcaaactcctgatctcaggtgatctgcctgccttggcctcccaaagtgctaggattacaggtgtgagccactgcacccagcccaaaatcaagattttgacagtggggctgtaatagtagtttggaatatacttcatttattctagttcttttctctattttattacctttctgaatgtgctctctgctcccctggggcccattcccaatccagtagcggcaattaccattgggataaacctcctacctctgaggcccacagttttcctgaccatctctctacagcctcacttccacctctacctctccataaaacaatgtgtatacttctgttcatcagctaaatcactatacctatcttacttgtttttctgatgcaacaagcagccttccaaaaataccaccaagtctaataatccttttgctgtttagtacatcttttgtttgaggcttactgtcacatgacagatgatgacaggcaacaaatgactgtttaaatggtcaacagatgtgcccatccaggtgactctcctaatagttgacacacagtgggtggagggattgggttgttccagatattccctgttgttgggctagcttgctcttggtgattatagtttgacttattttgcttttattcagtttttgtggttctgttttgctacttggttttgatacatgtaggtagtgtgggttccattttggtatgtgaaatttcatatcatgaagaaagttatgattataatgtagcgttagtaattcccagtggtcattcccaaaaaatattttctgagaatgccaggtgtatataaaagttatttttgaaagtacacatgtagtgtgccacaccctctatcaaaacaggcccacattactgaaagaaggagggaaactacccatccactattactttacagtacttaaaatatgcagacaaatacattttagcacgtggtgatctttgtgaggatatcctgtcaatcaagagagtaaatatcttttctctttcccatgaacctagcaaccaatttgcttatagttccttcaaagctgttgttaagattattttgtggctggttatgtcacttggctagaaaaatggtactggaattaagtcagctttagccctatgctgcccatctttcttaacttatggtcagccatatgtttagaccagatgaggtaggaggtatgattggatacaagtacattcctggaaaagataaccaaaatcatgttctactaaaagtgaattactgtgtttttttccttcacataagaacagcatcttcatacctatggcaagaacctgtcatttttttttctgatcacatatgtaaaaatcatttgttggtagtagcaattaacataaaagtcaggttagtgatgtggttggggtgagggagatttgaccattgagagacacacaagggggcttttgaggtactgtaatgttctctttattaaccatacctgtggttgcaatggtgttcattttataattcttctgaaaaacagacatgttttctacattctgctgtatgtgtaatatattttgctatatacgtatgttttactggagaagaatttcaaaaatacctaaatagcacaaagtagaaaatgttatcagtaatcctaacactaagaaataatcgcaatttttttggacatgtatcttcccagtgttttggggacaaataaaaataataatgtatatctactcccatgagttaagattttaagaatgcatacatgtatgtatgtatgtgtatgtacaatatatatgtgtgtgtatatatatataagtatatacaaacctgactttttgatttattatattgtaatattttgacatgaggtttcaggattctatagagttaattttaatagccatatagagtaccattgtttggctatatcatattatttgcccaatcctgtattctctaacatttgcttgtttctaatatttatgtgttataaataacatgtatttatcttgtaggtatttaaaatttaaataggctaaatgggacccttctttatgtagtatgtagatatttcataaaaggtacattttgttgggaaagataactctggcttcaaatgctttttgaaagatgatttttttcccctcaaagaaaattgaaaacaatttcactttttttttccttttatgaagcatgtgtgtgtcatttgttgtaagaaggatatggccctgacatcttcatactcgattgttctctgtgaagttattttatttattcacttattgaactcatttattgaacaccatttgtatgccaggtgctttgttccagatctgaggatatagagatggagacctggtttctgctttcacagcctggcgacataatggatagcagggtttgggatgttgtctgtccatagactcttgagtttatggatccaaatgtttttgcttagattactttgctgtgatttttattattagacaggtgatttaggagcttatgtaccagagaggctgttgctttcctccctccccagcccttccacccccagactgtatgttcttctttaaggttgagtcttggaattcagaacttggtgagcaagacctgactagaacagaaatggaaatgaccttttcatgcacagcatgagcatgacagagaatgggctgtgtgttaactcctctctgatattgctgaggtcctttccagccctaaaattctgtgatttttctgatacttgggcctttgaagatcctaatacccaatcctttctcaaacattaaatttgtagcagaggggaaaaattaaattcctcctttttgagacaccagctgaactttgcagtataaatagactcaagagtgaaagaaaggagaaaagtgcattcacccatcccaggaaatcagatggggattgagagtgtgtctgttcatcttctgtaaacaaaaccattagtaacatggttgttttttacttgatccctcaaaaaaaaaaaaaaaaaaaaaaaaaaaaaaaaaaaagcagctgggtaccgtggcacgtgctgtgtaatcccagcactttgagaggctgaggctggaggatggcttgaacccaggagttggttaccaatctgggtaacataatcagaccctatctctacaaaaagattaaaaaattagccaagtgtggctttccaactacttgggaagctgaagtgggaggatcgcctgagcctgggaactcaaggctgcagtgagctatgattgtactagcactgtactccagcctgggtgactgatcgagaccctgtctcaaaaaaaaagcatcgttttagggtttctatttgaatagacatttctgtggcttgagtttcgagttaggaatgttttggcatagaaaaacctgttggcccagaaacatctggcatcattcacaatcaggccaaagtaaaggaaaactaattttttaggtagaatgttggcacctggaagaatggaggctgtaagttcttttgctggcaaagtataaaaagaaatgtttagtggacaggtgtgtgagttaaactctagagtataactaagcagtgtggctgcccattttttacttgatttgcttgtgcttctaccaccttcttaatgtgtccctggaatgcctacatgtaaaaggattctgatggagaagaaacttctagaccttaagtgactgtcctggttccagcactcatttagttgcataaccttgggcaaatctctcaagaaatctgttccgtcttctgtagaatggggtaataaacacttactcagcctgtttcacaacattgttggaaagattaagaaagcatatatgaaagtatgtactataaggtgatacttaggtattataaaaaaagtgaacagggatcagcacaaaatgttttggctgctgctgctgctggtgtgtgtgtgtgtgtgtgtgtgtgtgtgtgtgtgtgtctgtgtgtgtgtgttttgtgtctctgtgcctttgtctgtgtttctctaccaccttagatttggcagccctagtatctaagtgtgaaagtttgggatggatctcagggtttttttggtaatgatgactgactggtatggctattgaataaaatattgaagatgctattggtcctttaggacaattagttttgtctctctcctttaaggtcatttggatgaagcagcagtttgtgtagaggatactagtttttaagatatttttgtcctattttattttattttattttattttattttcactgttattccacaaaaatctttgagctggcttacaaaaatgtgtacaatgcaacagaattaaaataagtagaaaaggaattggggcactgggaaatgggtagggaaaatacaataaagccatgttaaggcttctgggcagaaacatgcaaggcagggtctgaggcagtaggttgagggggggtcccatattcagcttcccagagagtagaacaaagaggggaacgtaacttttctttttcttttttttttttggaaatggagtttcattcttgttgcttaggctgaagtgcagtggcacgatctcagctcactgcaacctccgcctcccaggttcaagcaattctcctgcctcagcctcctgagtagctgagatcacaggcatgcaccaccatgcctggctaattttgtatttttagtagagacggggtttctccatgttggtcagtccgatctcgaactcccgacctcaggtgatccacccgcctcagcctcccaaagtgttgggattatagatgtgagccactgtgccctgctggaactaacttttcttgagaaactttgtcaatggagaagatgtgtccatgaactctatcttggatatacttatcaatacacacaacggtgatttgtgaacagttgcttttataccgtcaatgcaaattaataacactgagacaaagcatgatttcaggaaagagtaactataaggggtcaagatcatgtgtctcacctagatagctcaaaggactggcttgagccaaggacaatttttagaacatgtcgaggagaggataagctacctgtcctcaggcagtctaccacaaatactctttatctcagctgggagctgacatctctccctgaaaggtttccagtgatattgtggcacaatttgttggccagaatcctagagacccagggatggagatgccagtgctgtcttgagagttcagtgtcttccctgttggcatcttctctttcttggttctggcatatctggttcaaggattagacacatgaattgatttagttctttgctggagagggcagcaaaatgccagttgtgatttttgggcttggctatgttgggaaccactgggaatttgtggactgccaataactcattttgtactagcttttgggtgaccattcagtggctgttatttcaattcatagttcagagtgactgtatttagacccatcatgtttctagagttttttcctagattcaaatcatggtaaatgctttcattagataatttagcttatgccctttttcctacttttatgtttccctgttgttactagccctagatacttaaaaaaattttttttggaaaggactgtgtgtttttagatatggggattgtattctgtgctttagtggggcacagaaggagactgtctggttaaggcaagagattgtggtgctaaaaaaggaaatttggcaggcctgttcctggtacttttagtaagtaaagaaagagaatgacaggctggctggggattgtattaaagggagccctgatcctcatatgaccttattccctgaacctagaaagatggtctgcctatgtggcagttattctatggcgctaaagacagttttgttctgctttctgccatgtatatttaggggcctaacggagagatagaaacctgttaaggaataatcatggatgttcaggcctattgcttccttcacttatccagaagccagcctcaccaatgtccatgggcaagtttgtgttcacacaagttgcttgtaacaagagggaagattctcattaagaagttggccctaaaatcaggatagaatcaggctatatttgtgtttctgtcaatagtctgaattccttattggtagaaaggtcttataattatggggtaactttgccaactaatagtactggggtttgatgtgggttacttacatcagaagtcacatcaactttttgacattagtttctattccaccatgtgctccagggaaaaggagattgatgtggactattaagccaaaaatgagaatctgttattgaaacccagaagtctgaaataagggtttagtgattgttttgtttagacacaaacttttcttcatagatgctttaacttcctaagtgagtttatatatttttctaaatatgtaatcttttaaaaatattgcaaatatttaatttatgtatttgccatttaacaggtaaaacagcaccaggaagtcttgctcctgttttgcaaaggcacatttagagagtgacagaggtttcccactgtgtctgggacaagcctcccagtgtgtctgggacaagcctgaaaagagtgccattttgtctccctgaccatttcactgattctgtacttgttgtttatgaaacttcattatgtaacagacaaaaaagcaatttcatgagcaattcctggaataggcaagtggacaaaaatttctcaggtaccttctctggaggctgtttgtcttccattctggctgcctctcttgagaactggagtggcatagtggttaagaccaggggctctggagactgcctggatctgggtgctggtctgactcttgagctgtgggaccttaacttctctgtgcttactgtccttacctgtgagatggagatgattggagtctccaccatgtcaatgtatcaacacttctaaattatttagagcagtgcctgagacattgtaaacacttaatatatgttggttgttattgtaattttaataataatagctattaaattattattctatggctgtcatgcctgagagttcatcacaggggcatgggtgggtgggtagggaataagggctgagaatctaatcagttatttttaatttattgggcaaaaatgaatcaaataaccgtggcaggcataatgaaattgaggtattcagtgtgtggtgaggatgaactgttttatcacagttcctctggtgtggcctgtgtgctttgattgcaggtcagatggctagggaaaagagtagtcaagctgaatgctctgtggtgaggctgtgagagggacaagaaacgtgggtcaggacagaaggcgtactgcaggaacagattccgaagtgtgtgcacagcatcctataatttgggctcctgtgtattttctttagttggttgcatttgttaatatgttagtctggtgtctttaaccctgtgactgacagttgacaatggtgtagctctttaaaagaggtgaaactggtctgaccacagtttacccttgatagtgctttcactttggcaacaagacagagggagaaagtccctgcttctctgctctgggaatcttaccaaatcaataaggagtctctggtagcactaacctcttttaaatagcctaagtgtgagatcctgacctttttttctgtatgtggcctacttccttgatgagaagctggcttttatattagaacttttttagacgtacatgaaacttgaatcttgctatttgtttccattgttgcttttaaaaaataattttacaaatttattctaataatatactaacgtattttgtctccaggactagtgaaactttttaagatttttaacagattcatctagacacctaaatctctctaggacttgatccttctccacccagcagaatactgtactgtgctgtgatcatttctcagggtggttttggctgagggtttttttttttttttttttttgagatggagtcttgctctgtatcccaggctggagtgcagtggtgtggtctcatctctgcaacctctgcctcccgggttcaagacattcacctgccttagcctcccaagaaactgggattacaggtgtgcgccaccacacctggctaatttttgtatttttagtggagacggggtttctctatgctggccaggttggtctcgaactcctgacctcaggtggtcctcctgtcttggcctcccacagtgctgggattacaggtgtgagccactgtgtccggccttggctgaggtttgactctttgcacccacagtcccatgatgtgtgtacttgtatgtatatatattcacatctgaggactgacatcatttcgcagaccgggaaactaagtgtgaggagtacattttaaaataatttttacattatatattggcagatcatccatgtgcttgtagaaggtattatattggtaagctgcaggtagacaggaagactgaaagagaaggtagaacctgcttggatcccagtctgtgcatacctaaggagttgagttggcaattcctgaaccaaaggttctggtgttcagaaatatctccagttattcagaaggatggcatgacattctaaaaataagaaattatttgtagtcacatcagtgtgtaatataccttacagaatattagaagggagatgaagcatttggggattcaaaggaactagttgtagacccttaggtatggccctgagactacctagggtggcttttgtagcaatctaaacctgtatcctgggatgttagcatctctgaacaaaccttttctctcccctccattgagatcactttctttaaagtctttatgcatttagagagttgctgaggcaaggccatgtcctggtttgctctttttaaaatgcagatgtttctagaaatgactataaactgagtcctgagccacctcttgtaacttttcaggtcttggtctgggggaagataaagaaatggaggtcttatgcttcacaatttggtttaagtcaactatggcaaggtatcttgacttaaataagtgtgacttaagtaagtctgacaatttaaatattagaatggtaagacatttttgtgcctctatagccatatgtccatcttggggaggaaaaactgaaaataaacgatgattacttttcagtattctgtggaaatcttacttctctttttagttaatttttcagtggataggctccctacctgccagccctaaattcttatttattcctgaaactctggtttttttcttttttcttttttttttttaaagtattctgaaactgttttctgaccatgcttcatatattgaagtagatttttttcacagaagggtaaaggaagtgcattatgtttcatatgtagatgcttttcaagaacacacagcttctcatcattcattttaacagtggacaattttggtgcctgtttatggagattccttgggaattatcagctgatagaaaatttctgaagagagatagaaaatctaatctatttggatgtcttgttaaatggagctttttgagtataagggtttctgaagaaatataggctgtcagagctgatagagtttagagagtctctgtgtaccattctttataaataaagacagccaaaagcccagagaagtgaggtgcttgatgttaagatttagttagtggccccctactggtctctgagctgcccatcactctaccttgactaatagtgataactgatgtttctggcaacaaatccaaggtacaagttttccagggtcttcaaaggaaagctacattatattaaagttcatgctgaatatcttttattgtgttctgatagtttgaaaattggttatttttgtactgttgtaaaactatagtgcttaactggaaaccccagcattaacccagcctttgccagcgtttcccttctataggatgagaaagttgttgaagagtgaggaaaaaagatggtatcttgtccttaacaaaaggtctacgtggatgaaaggagaaactgacacttattgttagggaaatggtaatgcttacatgatgatctaatctgggtttgagtttcgtttttgaagtcaccagtttttattttggtgtttttcagatattcttatagccttcctggggagatttattttttggagacatcgctcacattgtttactcctctaggttaaatgtactaggccatctgttgttaattttgtagttgtattaaattccatcctttggctggattttaagcaccaaaagcaaacttagacagaagcaggagcatttgcaaattacatagctttgagcctaaatggtggtttttataagtgcagttttcaaatgggctgagattctattttgagttttgggatcagtaatttaaacacagggacctctacgagttctctggaaaagcccattttgagaccctgaacagttgttatgccaaagcaagctcttggggtaaggttggcagtgatgctgctgataaattacttttaagatgcttggggctgaaggacaatgattttgtaatagtgttttaagttctcaggctgacctatgaaatctggaagtgctcatctgaaaggccagtattctttctgacaggcacaggaaaaactcgtcccctgcttgatcctcatgcaagcatttcttggaggaagccaggcctgtgggtcttgggggccagaacagagacactgagagcaacactactggcattttgaatttctgctgaggctgcaaaaacatttcaagggaaatctgaagttatcccttcactgtctacagcctcttgaattgacttctgggtgttacagatgggaccagcgtgtgtaaaagcagaatttatattctatttggatatcagaatcaagtttctctttttaaaataattttatggtaagtcgtggtttctctgatatgatttctgttgtgagcggaacaaaaatcatggcgaaatggtgttattacttaaccaaattgcctcgtgtacagacaggctgaactggtgctttgcctagagttggcctggagttttcagaaactcaattgtggcctttataaggctgtgcctggggttgtatttccaatctctctcaacttttgttcttgtggaagggaggaagtagagctgtgacagatatattgccagatagcacacaatagcacacaaaacgagaaagacacggcgtgagccattcatggagacagatttacgctctgtgctgccctcaaaccatagatccatctatttcagagaaacaacttgcccactgtattatatttcagacagggacatggcttagaagagagatgctgactccttctgtttagcttttgccgataatgctgcacgttttgctgtagaattacttttgtggggatgggaaagtatgtttggcaaaggaaggcctgtctctagattggaagtggaagaagggagatatcaggagagtaattggccatgctgtcgccatagtgaagtatatgtgtatatttttgctgggttttgtttccagccaactatattatcaggtgttggattttttaaacttacttcacaataagaaaaacaaagctagagagattgtgactggccaaggccagaatgtttggcattcgtagtttctctttagttctctctgtaggaccatttcctggagttacagaagaattgaccagtgtgtcagtgtctttcatgtacattaatgggcgatagtattggtagtggttaatataatagcatgggttctggaaccagtctgccaggatttacattcaggctcaacaatgccttagctacatgcctcagttatcttacctataaaatggggattccaggtcttaccttataaggcagctctgagaattgtttagttaatattgaggcagttataactaagtgttcagtaaacttagctattgcattttaaaatttgtgttgattttatggaaataaatgatgatgtgtgatacctggtagattgttcggcagacatttcaaatgtaaaaaaataactctgtctgcattgaaatctttctagattgatagttttaaataatgaaaaaaatacttctgggaatgatctacatttggaagaaatcaggaaagagaagactgtgtgtacttttgcatttctatgttttgggcttgtaagatatgtgattgtatatttcatgtcagtaataatttattttggggagtagaagcaaatgtcagttacatacatcatctatggaatagatttttagttttatttattttaactggatgaaatggttgagtgttgccttacttggttgaatttagacatttgagaaaatttttttttaacttttgtgacacacaaggacctttgaatgaaatcagtccccttttcttcctttaaaaaaacttataagaattaccatttcttgactaaacagttgttttcttttaacattatatacttgtctctacatagatactacattttttagttagatgtgttttggaagagcattgactttttttcctgttacattggaaaaatttaatggcacgtgtatgttattcttatcatgaagtgggtttaggcatgctgccttatactaaatagaaatcctatagtagttgtttttcagaagtaatccattgattcaagtcattcattgattcatttatgaatacttaagtatggttacataggtagggattgtcagaattggcttttgagcattttgtttagcagttataatccaggtggcaaatatactgtctgattcaattacttgcatgaaatcactttaaacagctacttaagatgagttgtccctaggcctgtctttatctacttattgtgcatgtgtgctagcatacacgcattatcattgttgttttttattgtgttaaaaaaatattacaaagtgtaccatcttaaccattttaaagtgtagatacttcagtagtgttaagtatagtcatttcattgtgaaacagagctccagaaatttttcatcttgtgaatatgaaactctataccccttaaacaacaactcccctcccttgttccctccagcccctggtaagcaccattctcatttctctttctatgaatctgagtattttattttattttttattttttgagacgggctctctgtgttgctcaggctggagtgcagtggtatggtttcggctcactgcagcatccatcccccaggttcaagtgattctcctgcctcaccctcctgagtagctgggattacgggctcgcgccaccatacccagctaatttttgtatttttagtagagacagggtttcaccatattggccaggctggccttgaactcctgacctcaagtaatccgccagcctcagcctcccaaagtgctgggattacaggcatgaaccaccacacccagctgaatttgagtattttagatacctcatctaaatggaattacatagtatttgtctttttgtgactgacttatttcacttagcacaatgtcttcaaagttcatgtaccatatgacagaattttctttcttaagactgaatactgttccattgaatgtatataccacatttgtttatctccttatcctgtgatggacatttgagttgttttcacctcttggctattgtgaattagtgcttctatgaacacgagtgtgcaaatttctcttcaagatcctgctatcacttcttctgcatatgtacctggaagtgtgggattgctggatcatatggcagttttatttttaatttttgaggaacctctgtactgctttctataggagtcataccattttgcagtgtcaccaacagtgcacatgttccccagtcttttaaacagccccttccagactgacagagtggctacatacagaacagggcagctttgaagattagggtggcctgttccaagcttcttcagactcctcgggactggctaattatttttgttaaggtcatactgctggaccagggcctataggttggcactgacttacgcatagaatgttggcctgggtgttgatagacttaggctgcaattgctatgagtgatcttaggcaagttacctccactctgttccctgccattgtcatctgtagatgaggtggttatgcttctctctatttcttaatttgttccaaaatcttattgtttgttgtagaatccaggcatctaaaaaatatactgtgtgtagcttcgtgtaattatttgatagactggatttctttttgcaccagatagttcggtttttttgttaaatgtctcctttttcttttcttactctttaactgccccaaatactaagtgacgaggatggagaccttggcaattgagtgctatcagtgagtctgaatgcctgggttcaaatcctccatttactagatgtgtgaccttggagaatgtaacaaactgttgtttcacagtttctccatctgtgaaatggaaataataatacgtttgtgagacttaggtgagttaatgcctgtaaagtgctttgcatgtgtctagcccatagtaagcactcattaaactcttaattatcatataatatgctaattatgatggtggtaaatgagtgaggtcatcttccattttggtcatactccacatttgggtagctttagactttctgaagatactatttcctgtaatgtttctttgtaggtggggaggatatacctattacacagttagaaaaactgaacagtagagattatgctttatatggctgggattaaaacttcagtgtcgtgtttagagcctagtacttcctggcctggcatgttgtcctacacttaatgactgtggggcctgagtgggttctaatgttagaatctggtaagaactcttcctgacctctttgcccatttataaacagccttccagggtgacctgagtaagatcattttctagctgtgtaatcctggtggtatgaaaacactggatgtctatagttttttagaactgtgacttagtactaatactagcctcttcaatactcatactcttaaggcttaatatttgtctctttattgatttacatatttgaaacctagacagtcttttcaaaggtgagtagatattttatatgtctgccttctggtcggtagcagcagttgtgcagttactcagctgttggcagttctgttacttaatacagaggcagagagcgaaagacttattcagaaacaaaacctctgcttgaaaagttctcaaggccagccatggtggttcggcctgcagtcccaagctggtgtggcctgcagtcccagcactttgggaggctgaggtgggaggatcacttgatcccaagagtttgaggctgtagtgagccattgatatggctccgttgtctggagaaacacccagggtctctggtctcgtgctgagaaaatcagcaacatagatacacatggagtggtttaaggagcggaaagtttaataggcaagaaagaagaaaacagctccaccgtacagagggaagagggctcagaacggaaaacccccattgctggggggaatgccgtaggttatattgggaggctggatgaggcggtatctgatttgtatagggcccaggggattggtttgaccaggcttgtcattcacatagcccatgaaaaactggccctcctatcctagtcttttaatatgcaaacgcagctacctggctggttgccatgatgtcctgcccacatagtctctacctggctggtcgccatgatgtcctgcacacgtggcaacaaaaagtggcaggaaccgccatactgggtggacctggcttttagttgcctgcatttgcatatcaatgcttgcaggtctggtttttcagtctgctttctgttagaaaagaaatgttttgggggctgctttttcagtaaaagaaaaagcctcaccgaggactcttttaccctctctatctgcttaaaataattcttaataactcctgtaataccatgattgtgccactgcactccagcctgtgtgacagagcaaaaactatgaccctgtgtctaaaaaacccccaaaaacccaaaaccaaaaaacgagactgggcgcaatggctcacacctgtaatcccagcactttgggaggctgaggcgggtggatcacttgaggccaggagttcaagatcagcctggcctgttacatagtgaaaccctgtctctactaaaaaaaaaaccaaaaaacaaaaattggtctggcatggtagtacacgcctataatcccagccacttgggaggctgaggtaggagaatcacttgaacctgggaggtggaggttgcagtgagccgagattgtgccactgcacttcagcctgggcagtagagttaatgagactccgtgtcaaaaaacaaaaaacaaaacaaatgttctcaagtcatgttcaagagataatggcggacataatggaacctccctaaatctgattttctccagctataaaatgaagggcccagatcaggggatgcttaagggctttgcaagttctaagactcagccatcttgagattggaaacagccctgtaggttcttagggcatgatgaagacctttgaggagaagtattttaacagctttgtgtcttggggaggaagagtcatggggaggtgattaggtgggcattaaaggagcaactggagaaaggagagactaggaggctgttttgataatccacatgtgaggtagactgccccttcctgagtgcctgaggggcacttgcaccttgggacagggtcaaggttttctctgagatagcagctcccacaggcctaggagccttctttcatgagcttgctgccctggttcatgagggagggattgatggatctctgccccgttctgtttttttgctagcactgtcttcacaccctgttgccgtttatgttttttgatgaatgattaattagaaaaataatcatttgtaaattgtgagtgaaccagacatttggccctgactgtagggaaatggcgcctctgagccgggtgtagcttgcagccagtacatcagagctccagtattcccagaccagtgatgaatttacatgaagttccttttcagcatgttaatgactgttacagctgagtaactagcgaaaaataatagcaaatgggaagagtaaatatttaatgcttttatatcttttagcttactgtggaatatgtattttgatttaggaaggacatgagagtcttagagacattagagacaatgttagtgtgtctgagcctcattccttgtttccttttctttctttgcacttaattaaattaaaaggataaagtgagttgttgtgagatggattttactaggggagtggtttttctgtaagttttaggtcacaagatgcgtctttcctggcagttaaaatctgtatgttcagactacctcattgattacgtgcctggtgtgtacagggactcatattgtttctaaaattcagctttcatcattttactctcctgcttaaaaactttagtgactccacaccgcttctgggctgaaagatatactcagtagcctggcttttaagggagggcctctgtgctgtgagtccagcctcttttcaggctctctccctaaggcagctccatgtggctacattgctcaagccacagtggttgactccctgttcctgtaacttgctggaggcttcctcacctttgcacctctgctcagatcattttggggcatgaaatgatcttgtctttttctctatctaaagcctgcttttcctccaaggctcagttctagacgtttctgtgactactctgactggataggagcctgttcattttggaatatagagaaaattgaaagtaggtcacagttctctattccttccagtttgccacctctctaccacagacaattaataatgaaccctacttttccccacttcctgtttggccaccatctagtcttagacaaactaagctatttgtccaggtaaacaagtagttgtggactacagaaatttctgaagattagaattgaagttagtagggaaacaggcctcaaggatagtgccatattttctgagagcagatgattttcagacaaaaggttttaccaacagcattcatataaagtactgctttagtctgagtttgcaatggtagaagtagagtatctaaagaaaggatccatgccctttttttttttttttttaaatagagacaatgtctcactatgttgctcaggctggtctggaattcctgagctcaagtgatcctcctaaagtgctagaattacaggcatgagccaccacacatggccaatccatgcctttttactctgttgtagagactgtcttggagtgttgagttcagacccagataaaacaataatctttagaggaaatgaccaagatgaccagaggtaggtctgaaaacatgaaggccgtgtgggtaagagagaacaagggagtccatgccttctgttttcaaatatttaggaggctactgtcaggaaggagggatattagacttcatgtatggaaccatggagtgagaacaaagattgctgggtgtaggttataccaaagataaattttatgccaatataagaaataattttctcatagtgctgtgataaaatgaatttccccaggagatagtttcccaagtaggaagggatatgaacaacaggagctgatatttgaatcgtgaatatacgtggccttatagtaaaaggaccacagatactcgaatgtcagacctttaggaacaagtcattttctactgtaggattttggagggttcataatagaaagtaacacatctccttgtgtctaaaaataggaataaatcctaatatgaaccaaaaaatatattaggtacagttttctgagttgatattgaaatgatgaaaaagaaagagatctgggactgggggttcttaacacactgggtttagggacctcaagaatattgtttaagaatgacgagagatttgcaatttccaaggagtcataagcagtttcaaaaagttgaatgtttttgaggaacttaaaattctgttgttttcaaaatactatagaaaagtaatattacaaaattgtcttgacataagtaatttgggtatgctgtataaaggcttctaagaattaagaaacatggcccgggttgcaaattttaatgcatgactacctttttttctatagaatatagcttttgtcagattctcagcagtggctctgatccagaaaacattaagaaccactggtcatgagtggtgattttcagcttttttggtcttaacccacttaggtgggacagaagctccttatctcacctataccatccagcatcaagataagcacacgttaatatgaaccatatacatattttgttttataaaagtatcccataagctttaaaaatgtaattttgtcatacttaccttggtatagtagattgtaagttatttagagactataaagtcacagatgaatgtttacaagtactctttttggagttgggcttattctatctatgtcttctttagcagtggggatttggattattcttaaccataacacatacaagtctcattattggaaaattacaggacagaaacaaatgctgtaaatatgcaccactgcgcatcatgagattaaacagacaattttcaaaaagtcaaatttctaatgataaaattaaagtaagtaatttatatttaaaaagcaggaatagcagcaatgcaaactgtgattgacttaagaccacagtgaggttacagtgataataaatcattcttctggagaattgtgagaattttctaactgttggtgtgtgtaagtgcaaggtaggcactttgcataattgtatagtagctgacattcttgatatgccagtttcaagtcctttatatactttgctaacttgctgatattaatttattaatacaggtttttaggactcccctctcttatctaaggtaactagcttattaaagctcatattaaagaaaacaagtatctgtggaaatgttcttgtgggtaccagtgattctagagccttacgttaagaaacactagtctaatggatcaatgtataggtaaatgatattagacattttgagtaggattaagatccaggagactatctgaataatgacctttctctctctttctttttaaaatatggtcatcctaacgcgtatgataacccagatactctttctttttaaatacccttttatttaccaaccctcttaaacctggccctgaagttaagatcaacagctatgtgtgaataatttttttccttctcctttgctttgcttttcctatcaaattgaaataccctgccactttcttccctctctgaaaacacaaaagaggattaagccatataatggactatttatgtgtcaaattaaacgttttactctgaggctgtttctgagttatgcgagcagtaaaaatatgtattaagctgccaagccttttaaaaaatgcatgttatttagctgatagcctgtaacagtctgatggacccataatggtgttttgagtaaatacgcatttgaacaatttatgaaacttatgtttacatgtgtattaaacagcctgggtagggagtgaccaaaagttattaccagttgacagctgttgtctggtgaccaatttgaaatgaattggtggattcccttcagtgcggagtaaacaggtttcccagtcaggggagcatgctgaataattatcagtgtgtggggcctcagccctggaggcctgtgtgttggttgaatgaggtgctggaataaaatgtctcaactctacagtgaagttgcaccttagattcacatttatgatctagtttattttgtacttggaaatttataattatgttcacagagtacaggctgtgcataacaatatattctgcccttgggaagagggttcatgtttgtttatttcctttttttcttttttaactgacatataatcgtacatatttatggggtacatagtgatgttcaatacatacaatgtatagtgatcagatcagggtaattagcattccatcatctcaaacatttatcatttctttttgttgggtgcatttagtattttccttctagctatttgacaatacgtaatatattattgttaactatagtcatcttccagtgctatagaacactataatagaacttactcctatttagctgtagttttgtatcctttaacagagctctccctatcttccccacacccccttgtttatttctttgacattatccatctagggaaatgatcttgaaatttttatgatgtgtccatatcaacaatacatattttatatttgttcacttcaaaattatatgcatatttacatgtgtaaattttattccaaaattaggagtttaaaggattgagataaaaattaattacatatagataatttgattttctttttgtacctgaatgaatcctctttggcactgtctgggatgtgcagattttgccttggagattaaggcgagtgtcttgaaacctttgtgtaatgaaaagggcattgtggattatagtcattcataaacctgggcaaatcattcagctaccttgaggtctagtttcctcatttgtagaatatggatccctgcctggggggtttcataaagactactgatagtaaatgtcaggtgtctaccttgaccacaaaatcacttcctcagagaggctttccctgacctcttttctccatgatagctcctcttttcttcctgatcactctctaactccttaccttttaattaattaattaattaatttttttttttttttttttttttttgagacggagtctctctctgtcgcctaggctggagtgcagtggcgcgatcttggcttaatgcaacttccacctcctgggttcaagcgattcttctgcctcagctttccgagtagctgggactacaggtgcgtgccaccatgcccagctaatttttgtagagacagggtttcaccgtattggccaggctggtcttgaactcctgacctcgtgatctgcctgccttggcctcctgaagtgctgggattacaggcgtgagccaccgcacccggccttttatttatttatttatttatttatttatttatttatttatttatttatttatttgagacagagtctctctctgtcggccaggctggagtgtagtggcatgatcttgactcactgcaacctctatctcccaggctcaagtaattctcctgcctcagcctcccgagtagctaggattacaggcatgtgccaccatgcccggcttaattttgtatttttttttttttttcagtagagatggggtttcaccatgtcggtcggccaggctggtcttgaactcctgacctcaggtaatctgcctgccttggcctcccaaagtgctgggattataggcgtgagccactgcgcccggccaactccttacttctatttaaaacaactttttaccatctgaatgaatattatttaagtttctactggattgtaagctttgtaaggggagatatttttaaaattttacttttttggtctgttactgctgtatccataactcctagaatagcatgtgcatggcacatagtaggtactcagtaaatattagtcatgatttgaatatttcataacttagtagttgactaataaatagaggctgttactgttttcatggagtatcctacatataatatagttggtgttctaggatagaagacataattctctatgtatgaattgctctcactgtcacaggatccttagggtgtcacttttccagctggaaacctctgtggcctatggtgcctttgcccaagttttgctccggcctgctgggcttgttccacccactcagctgggcaggctgtgctcaggttttgctgccggcctgaatcccatgcctgccaagtgtgagcaggcgcagagcggcaaggggtgtgtgagcaagtgcagggtccggccactggcacagccaggcatgctggctgtggggtgggcagctccatatgaggctgtggctggaccaggtgtactgcaagcagcttccactgtgggcactggggaatgcggtggcacctggaagcttggagactccaggaaccacagaaccccaaacagggtgtcacagtcctggcttgtagagccactaggtttgggcttcctgaagggctgcaactcttctctctttctcgtcacctgcaatgtggctattgggggttgtgttacacccctttcagtcccgcaattcagcgggtgctgagttttgtcctgcatccaggaagaatgagatacgtggacaaccagagggtgagcaaggcggagaggggcttcatttaagtgacagaagagctcttaggagatcagaagtgggtagctcccttccacagcaggtcatcctgacgagtttccagctgtcagcagagaggagacccatagtgggtaagtgctttccatagtcaggttgtcctgacaagttgaggagacccaaagtgggtatctccttcctgcagctggtagtcctgacatctgcctgagtctacctgagtccgagggtttttatgggctcggaagggaggaagtatgtgctgattggtccatgggtggccatgagtgggcctggagaaagcaccgtaagttcttattccaagccacggactccagctggaactggcagcctggcccctaggcttcaggccatccctggcttgaagttggggtttcacaggggacctacccctttccgcccaggaacctgtctgcctcccaccgtcaacaagctgtccattgtgtctaggctgtttgtgcagagaggggtgtctgcagacccatgccaagctaccctcagcacccacccccatcctccacttccctcctgcacctgtttgcagccaaagtccagagggggccgaggtggcagagggctggtgtgtcaacatcacctgagctactgtacacctgactgggtcgcggcagtgcccagtctcagccacaactttgctctgcaccagagcaggtgccgggagtggggagaggccagggagtgggagcatgtacttccaagcctatgggagttgggcccccgagaacacagggatgcctgggtccagagccacagctgggcagctgcagctgtgcccaggagtgcagggctcccaccctgctaactcggtatggggtggggctcctgtcttttcctggctgtgcctcccctgctgcagcatgggccgctgctgccatcatcagtgggacccaaggcaggaagtgttttttcctgtagggaggatagatttttttttgtctcttacaggtagcatctggcaggcatgtagaagttagacatgaagcctccacccatggatctgagccaagtagactgacctgtgtaagcttcagatgcctcagtcttggtctccttagctccctgtttttgtcaactgtgccatccagctgagcaccttagagcttgaagctgagagcttcagcggggccagtgcctacaagggctgtgtgtatatgctttagaggtgggagaattgtgctgccagtgggcgtttggcccactaaggagaacacctgtgacctctgcaatcttccctacccctggcattccaagtgccattccaagtctgtagagataatagaacaaacgtaattttttgtgtggttggcaacgaagactggaggagaataaccacacctttggaagacttcggtggtcctttgaaatgaggagtttttatagaaacacttatcattttaaagacctaccatttttaaggtcactcttctgctagggctgtgaaatacagacatatgaaatgttttccagtgttgctctggtacttacgtgtgtgatgattttattggagaaatggatgaatatgaggttggagagtctttacatgtatgaactatcaaatatacagttcagtagcctgaaaacattaacaaatagcttttatttattgtatccttatgtctttcaatttggttcttatctgttgtctcttcagttgatgcaaatttgtgctcaacttttcctgaggggaaatggagagatactttcttggattagcttatgatcttgaacttgactattttaaagagtcatggtatataccaatctggattgtgtttaggatggggcttgggggatggtttctttgttctcttttggcccacgtcttctaacaacccatttgtttagggggttttatgctgcttagagtgagctgagaatgtgctcaagcacataattttagcctgtttttcaggtttacatgaaaaatgtaacaggcttctgaaacccctctaggttccagctttcaagaggctggtcaggaatgcactgaccgagagacttccctcaaaattaatttataaacacgctagaactttcctcaccttaattttgagaaaaagatctctctcatggcattttcaagtgttatggtagatggaaataatgaggaaactgtggcaccttgaacagagtgagaggtttagagttgtatagaccttagtacaaattttgactctgtcattaattacctgttctgtcatgagtgagttacttaacattccctgagcctcagtttcagcatctgtacagtgaggattctatttatttcatactgttgtggagacttgagcaacagagtgtgaaaacatctgtcagcgcctggtgtattttggacattctgtaaatcttagcagcccatttccccattctgggggtaaagccacaggacttttttggcaaatagttgagatacttggtgccaaaaggaaatttaactcatgccatgacaagtttttttgtataaggatgggattctggaaacatgataattttttctcttggccatatggattagcaaaggctttagaaaactacaaaaaagactaatttgttgcctctggatgtgtgtgttattttgggctgttaatatacttgactgcttgtttcaaggactggaaccttttcttttacctttaagattcctgcattttcatgtgctcattcagctgggatttgtgtttcatagaactggtagtattggaggtagaggagatactgtgatatcatatctctctctctgtctgtctctctctctctctcccactgaagaagagaagacaaaatttagagaatttgagacttgctcaaagttgtgtagctagttagcgataaagctggaattgcaccagatttgatttccatgacattgctttagcctggtggttctcaaagcatggttattggaccagcagcatcccttgggaatttgttagatatgcaaattcatgagatccccattcccttatcagaaattttaatacgctgtgtagggtgattctaatgcctgctaaaacttgggaaccactactgtggtctttacactattgggcagggagatgggagactacaggtagatttgctgaatttcatgggcaacactaggttttcattttaccttattgttctgccatttagatgtctcctcttaaaacatttttacttgcagtgatggcttccttagactcgtgtgtgattgttgctggggcagttaggtggaactaataggtgttgcttgttgattccctgctaccaagtactagttttgaaatttgagtattcattaaaaacaaatagggatttctgtgtctcactcctggaaattctgactcagtgggggtaaggattaggaatgtttaatttttgaaagccctgcaggtaattttttttctactttttaaaaattataatttttattttctttactgttcttttaagacatcctgttatagcatctgcaggtgattttgatgcccagccatgtttggggaaaaaagtttgggttctgagtgaaaatagaaaacgtaatgacatggaaaggaagtcaggggataagaaaagctctatggccagccatggtggctcacacctgtaatcccagcactttgggaggctgagatgggcagatggcttgggctcacgagtttgagaccagcctaggcaacatggcaaaaccatgttcctattcaggaacaaagaatagatcacaaattaaactctgtgggttttcataagtggaaagttggctttcgttgttctgtatttgggtgcttagtggacaggagttatctaaaagaagtaattatagttgtaatgcggaccctcaaagttgaaagtagattgaaatccattattttacaaggtggccttactatttatagtttgactgtaggtatggcagtgagagataaaattactttttctagctttgcaaaacgccaaacgtctttgaaattaagagtaaaaggggtttaaaatatgtactgctttataaagcaggaaaaccccactggaacattttgggtgtttacagaaatgggtattccatgggagagaacgtggtaacctatgttttgtcatcatttgtttaatcactgaaaatatattaacaggccaggcatggtagctcatgcctgtaatcccagcgctttggcaggctgaggtgggaggattgcttgagcccaggagtttgagatcagcttgggaaacacagtgagactccatttctacaaaaaaagaaaaaagaaaaaaaagtcacatgtggtggcacacccctgtggtcccagctactttggaggctaaggtgggaggatagctcgagccccagagatcaaggccgccgtgaactgtgatcgcaccactgcactccaggctgagcaacagatcaagactcttgtataaaaaagaaaaaaaatttttttaaaaatataaatatagattaacaaagtaacagggaatataatattttcaggttggtcatatagaggaaatactatattgtgttattcagcttaataaaatataaaacaaaaaaattattaactgtttgaaaaattgtagtcagatatttgattaggggtaggtcctgatttggatgaatttgaatcacattcgactaaatattgtgctttttaatactcactttaaaaacaaaattaattgggcaaatgttcatatccattttaaaaaactatcctcttaaaactagattgatagtagacattaataggcttgatgttgtttataatattttgctatattttaagagcatgcttttgtatattttctgttttagtgaagcattttaaaaatgcccccctcccacaactgcaggaataaatctaacagattttgaccaaaattactctaattttgaatttcttgaaactgggtatggaaactagacattaaaaaaaatctttatttttaagcacggtttcttggtcagtagcttctgtattacgggagaacacaagaaggggccttcttgacactcaagaaatgctctttttccatctacaaataggaagacaccctttgtggtatttttgttttgtgggccctgaatgaaaacgtattatgatcagttttaaaaattgctgcccctttaatatctgaatatattcgtggctagtgaagcacatgcatctgtcagatcatgggtgagaattcacttttctttttgcgatttctccagccacaaggacaaatttagttttgcagagcagtttgacacctctagaagcctgcggttagcctcggtgcacctctagcagctgcataggctcaagaggacctctgttcttccctttttggtttggttaccttacccctcctcagggaaaggccaagagactcagcacttcctccccaagtgagtttccttagtaacgtcagccttctctaatgctggccaagggtgtctttgctgggctgttttccctccaaaatagactcactggggtatagaattttttttttacgtgaagggtatagaattattttcagaatagcagcagggtaattaggctcattgttgacatgtcattgaagtctccatgtgacaaaattgctcctccctctttgagcactctgaatactcttaccctcttatctcgatctgctctttagaaataccagcagataatctgggagaaggccaccatagccatgcacagagtggggagaatgaggagatctttgctgaatgtcttttagttgtttgagttggagataaatgcagaatgacctccattttgccctaagaacctgaccttcttgtcactttgtgtaacattaattttctaatgtgttctggtcaatttgtaaaaagattttttttctagtgtctcagctgttggtttgacttttgtattttcattggtaaaatatgtatgtctttgctgtgagcagagagaaacagattaataaaaaccactgaaccagcattgcatatgtaattaattaacaccaccaggaaagctggttcatggttgtgtgtaaacttatttccaaacatctaaaaaacgtttagagttatcttattcagttgtctcacttctaagggataggttaggaagctgtaacgtatgtgtatgcacagaaactgttggacaatgattctcaaactttacttttcattaaaatcgtctggagggcttattaaaatgtagattgctagacctcatccatagtttctgattcagtatgcctgggtggggccttaaaatttgcatttctcatgtggccccaggcattgctgatgctactagtccaaggaccttactctgagaatcagttttaggatgtagatcttatgttcctctttgccaagggcaaatgaactgaattgtataggcttccttttcttttacaagaagcattgcctcttctaagtagacatccaccaaatatttatgtactgtatccatggtgccatgcactgagctaggtgcactggggataaataaaatgatctctgccttggggaactcacagttgagagaggattaaattaagaaacccaccaatcgtgattcaatatgagaagtgctgtggtgatgtcaggggtaggctttctagatttgctatgaggtgcagtctgagctttttctcagactgtcttagctttatacctacagaaataagtgaaagaaaatgaatcttctgcagcttaggattttgttagtgctcagatcagtttcctctcgtccttgactttgggcatcccaagctctgtattcagacactcctgaactggcattgtgagctctccaccccagcttttgtggaagagtccttcctccatttttaaattacaatttcagacactgtccactgtggcagcaggatttgtaacaagaccaagttaagtgatcttggctgaactgatttatgagacagcttcaaaaattcatgaggtaccatgggaactttctgtagtggatcagcatgccgcttttccttcacttcttcaagtagatcagacattttgtgataacacggcagtttatagtggagccttctagattatggctctgctgattaagacactaagacagacctgaagacaaagagaagggagaacaggatgttacttttagaaactcctgttatcctaagcttgagcagggactttgggtaaaatacatctatgtataactcaatttatacatagaactctctagggcaagtttttctccagtggtgatctgatatggagtgtcttggccattaataatggtcccataattttaagcacaataaaatgttaggtgtgtatatgcgaaaaattgagtgacatagtagttgtctctcctctctttgtgaaaaccggtagacaggaacgaaggatgtggccaaaaccagtgacaggttatggtgctttccctattttattgattgctcatttctagtctctaaccttatttgctacttattgatctagtagaaaagcaaataattttccctagatagtattttgttgagctgggctttgatgacttgtctaccaaagggtttttaaaaagtacttacctgctgagtggcagcctgtctaccatttaatgttattatctgtgagcctgggggttccttcttagtaggatcactgatgtcataggctgcctctttattctgcctactttcctgcaagataccacacatgcccgtggtctgctttaatggcctcacagtgcacacagccttagacttaacacaagaaacatatgagtgatcccattggagataatgtgttgccgagtcaatttgggtcagcatctgccaacatgtcaaattttcacactaggttgtattttgagatttttattcatgcttttgggttcaaatttactcacaaataagttttgaacttttaagtgctaaaactgctgagttcttgactatctgcacttggggaggggaaggttaaagataaggggtgggtatgtatgggaaggaaacagtagcacagatcatctaacataggaggtaagatagatttcccaatgtcatatataactttgactatatattttttcctatgtttacattctcctgtttatgattatactcttttggttcatattaaattggtgtttatctcctaggaatatatatggcgaggtgtgtcataggaagcaatagaaaaagaatttggagactggtcacttataattcttgaataatataactatgtagagttaaaagcaaagattgatcctgtcattcatgggattgatgggcatttttgctggtatcttattattgttcatttctgagtaggtaatatattaatatgatcccaaaagcaaaattgtattaagaagtatatagaggaatgtctcactctcatccctggacctatgtgccccattcttcaggcttttataactactttattagtctctattacatcttttgtaatttcttaaatagtgtgtgtactctcctatttgtgtatgctctcgctttttctgccctttgttataccatatttagcatactataagcactgttctgcatcttgctgttttgtagttaccaatatatcttggagatcattccatctcactacagagagagcttccgtattcctttttatagctgcttaatatttcattgtatagctgtaccataatttacttaacctgtctgacactttggttatttacaatcttttgctcttacaagtgatgctgcagtgataatgttttttttttttttttttttttcccgagacagaatctcactcttgcccaggctggggtgcagtggcacaatctcggctcactgcaacctctgcctctcaggttcaagcaattcttctgcctcagcctcctgaatagctggaattacaggtgcccgccgccacacctggctaatttttgtatatttagtaaagacggggtttcgccatgttgtccaggcttgtctcagactcctgacctcaagtgatctgcccgcctcggcctcccaaagtgctgggattacaggcatacagtgaataatcttgatcatatggcatttcatcctgggtgtgtgttcagttgtaggataaattcccagaagtgaaattgttacagtgaatgtgcatttgtaattttgatagtcactgctaaatccctctgtagaggtcgtactaatttatattcccatctgtttaagagtagagatttccccgcagtcttgtcaacagggtggtggtgttaaacttttgaatttttgccaatctgataggagaaaattggtatctcaaagtggtttcaatttgcatttcttattatgagtaatgttgagcattatttactatgtccaagatctgatagtatttccttttgtgtcatcaacagtctggttatatttctttcctgttttttctatttgattattgctatttttttttaatttttaaaataagctattttggaatacttatagacttaccaaaaagttgcaaagattacggggattttttttttcttttcttatgccctcattagctcgttaattgggttagatggtttgaggaaggacaggtctcctggaattctgtggcttgtcataggtttgtcagcccaaataaggatgcacatccaattcacgactcctggctgcctctggggattttccatatggagtgacagacttgggaaattctgctgagcttctgactagcctccattatgaggcatataattcagagcccatcttccattattcttcttttactagtatcaattattaactagaaaggttattgaagtgaaaaccttgcctcaagtttgtatttcttgagatttacttccaataataaatgtggttttcaagtgactgaatctttcatagaccaagtttcgagcacattaaatatttggtggttttgcgtcctctctgcctcacatgctaattgagaggatgagtagctataatttttctggagcttcaggctgtcattctgtcctgttaattggttcttggagtaaggagctaaaatgtggaggcagaaatgctttcccagatagaaacatgccttgaagctttgtgtcctgtaagggtccacatagcctggaagttaagaatactggctctggaataaaaccttgtggattcagattcctgctttgccactgctagatgtatcacctcggacaagttacctaacctctttgtacctcactctctccctgtttataaaatagggattagaacagtacctgcctcatctagtagttgtgaagattaaatgtgatgagacatgtaaagtgcttggtacaggcctagaacattgtaagtgctcaataaatactggccgaaaagtcgtacagggcagtggtttcagaggccatgcaataaaatagtgggttatgttgcatttgacttttgttgattaacctttcttcttcctctattctttaccttgtgaggcacttaacctactaactgaaatgccattcattcagccagtatttgagtgctcagcaagtgccagactctaaacaagatgatgtgtaagatgctgcaaggagccctcgtgccttgcagcctgagcacaagtgcctataaacgcaaggctggttgtcgtcattgccatccccagtatactttgagaatacaaaagaatgtgaggtcactctcctttgactggggtgacgaggacatgcattgtgaaagggggaactgttagaactgggagccattcgtaagtgaaataaggataagagggatattatcagcattgatgctaattagcatttctgtagcattttgcagtttgggaaacattttatgtattttattttatctcagtctcataaaagagcttgaggtattattatctccagtttacgactgaagagatggggagtcaaataggttatctgattctcccaatgccatacagctccttggtggtggagttggggtttgagtccaggtctcctgactctgaatctccacgtgcttccctctggtctcttgagtgaaataacccgtactagcaagaaagagaagagtatgtcggcaaaagagaaacctggaatagttgccaattgtccctaggttcagatcacatacttctagggcatcagagctagaaggaacatgagatcagtgcatcctctttatttgactaatgaaaacattgatgtgcttgtgagggacttcgagaggtcaatgtggtgctggaagcagctcaatggagagggtagacagttccccttggatgctcatgtgtggtcttctggggattgattagttgctggtaaggaaggagctcattttggggaaagtaggtacatagattcatagagggaaaacctttattcagaagcaggcagtttttctgcaatatcttcctgggaaacacaaataaaagggctgtagtttagtattcagatgtggttctggttgtgcaaggataaggagaaaaggcagaggcagggtgagaaggaaggaaaatgaatgactgatttgaaaggtcagtgagaagtctgtgaaaggtacatacttagggtctgtagggcagtcatttgaaatccaggatacttagtatatatataggaggacttcgtagtagttctctgactggaagaggactgggctgccttgtgtgtgtgagctttcatcatgggggcagtggttactacatgctatttctaagaattgcacttgtggggtgatttctactttgggtaggaggttattctaggtagagctagtgtggatcagcaacatcagcaccacctgggatcttgttagaaatgcagatttggggactcctaccctagacttactgaatcagaatctccagtgggtgcagttcaagaatgtgtattttaacaagatctccaagtcattggtctgcatgttcaatgtttggaagcattgctctagtgcagaggctctccaagatcctcctttgggttctcggcttatgtgattaatgtgccattcaccaaacatttattgaatttcacttatgtaggcacagcacaaagccaactctcacatggatcctgcttgcattctagttgaggagacaggattgtttacaagtaactattaggttggtgcaaaataattgaagtttttgccattactttcaatggcaatttcagtggcaaaaaccatggttacttttgtaccaacagtataaaaacagtgttaaaggctagtacaggaggcacagagaatgcctgtgaaagtggagggtggacgttttcataggtgtgtgcgggagcaggtggcatgcatggtagggggaatcattacttctgtgcaggactcctgagtaattttaatctgtggtttgctgctgtgcaaacccagaggcctgtctacaacttgtttaacctcccccagcccttgactgggtttactttattggcctgataagtagtataaaaattggcagagctattaagatgactcatggaaggatatcctcagcatctccttttggatctcctcacacctgcactgcttcttcttaaatgcctgaatatccaccactttgtaaaagaaaaaaattgatttgtcactgaatttccatgcctcagcctgagagaaatgtaaatgttgtactggcctttagtactctgccttcaagcctagatttagagctgatcattatacttttagagtaggctaggtatgaaaatagcagcaggttgaagagtcagaggaagctgtttgctctcatctgctggtttggtcagggtggaagtacgaatattaatacagtccacttaaacaataaaatagctcccagggaagaggaactataaacttcagtaaatatcagagatgttaaatgctaaaaataaaagctctctgcagttgtttggctctttaaagagattgtttattggtcaagagtgctagtctgtttggtcatgttttgctagctttttaaaatgcatgtatgtaaatgaattagaatataagttaattaagcagggcagtgtttctagaatgtgaaaatagtaacctggctagttaatttaattaagtccttggtaattttcttttagaaacaagtttcatcttgggaggtcacaacgtcctggctgctgtgcttctgagctttaccttgactccatcctctcctctctgtcatccttttctctggctctgtcacttgcatttgccccctgacttgtcaccctgacttcatttcctctctcccagctgtttacagtgctatcacagtggtctttcagaaatcccaaactctgctgttgaactgggttctaaaaaccttcagagacttcatgttgtccataggatacactgttttctgaactccttagtgtgccatattaggctctctacagtctggctctaaaatacaattttttttttttttgagacggagtctcactctgtcgcccaggctggagtgcggtggtgcgatctctgctcactgcaagctccgcctcccaagttcacaccattctcctgcctcagcctcccgagtagctgggattacaggcgcctgccaccacgcccggctaatttttttgtatttttagtagagacgggatttcatcgtgctaaccaggatggtcttgatcttctgacctcgtgatctgcccatctcggcctcccaaagtacaggcatgagccacggcacccggcctctaaaataccattatagcctaattttcaggcttactttttcttgtggtccaggccacaggactatctgctattctcaatacaaataaaatataaccagtagccaccctgcagtagtagggacaattcaggtgcctcgacaagcattgtctgattacactattcaatacaggatcaaagagttttgtcatttgcccaaggtcatgtaccttgtgttagagctgagattcatattcagtattttgatattctgactcagtttcctgctttcatgtctctgtgctttccttgtatgttttctttctttttttctttttgaggcagggtcttgttctgtcacccaggctagagtgcagtggcacaatcacaactcactgcagcctcaacctcccaggctcaagtgatcctctcacctcagcctccccagtagctgggactacaggtgcacaccaccatgcccggctaatttttgtactttttgtagagacggggtttcaccgtgttgcccatgctagtctcaaactcgtcagctcaagctctctgcctgcctcggcctcccacagtgttgggattacaggcgtgagccattgtgcctggcctccttatgtcttctatgcctagactgtctcctaccctttttctttgcagacttggaaatgtataggtgttaggtattcctaacaatgtgcgtgcataggtcatcgggcctatctcaatttagcctgatagtgtaaatactagtactactactacctagtgctagtactaagagctgatcccagatcttaatttttcttcatttctcctccaaataataggcggtttataagtattatggaatgaatgcatggatggatgaaaggatgactggatagatggatggtcagtcccagtggttgggtccgtttgtgatttgaccaagttcaaggctgtagaattgctatgtggaaagaatgcatattatttcagctatatcaaatagcacctagggacggcctgactgacagggaacaaattgtcagccctcatttggatccaagtggaaattaatctgaagaatttggaatgggcctattcgtgggaaattgcttatttttataagagtttattttctgatttgtggctatattcgttggctagggccactgtaacaaagaccaggtgacttaaacaatagaaatgtattttctctcagctctggaggctagaaggctgagatcaaggtgttgagaggtttggtttcttctgaggccaatctctttgtcttgcagatggctaccttgctgtgtccttacatggtcttccctctaggtgcacatatccgtgttcagatttcctcttcctttaaagacagccgccatactggattagagcccaccataaagacctcattttaattaattacctctttaaagaccttctctccaaatacggtttcattctgaggtactgggggttaggacttcaacctacaaattttgaggatacctcattcacctctacccaacccatcccctctgccttttcctcttgttgtctttcttctggcagttttgtttcactcaagggcagtcaggaagagaagtaaagatagaggaaaaggaaatttattttgggtgcagttcaggaggtgtagctggggttggggatgggcagtggctgaagctattggtggaaatgagattttgatattgcctatagattagtattgtcctggaacattctgtgctggtttcctggacagccgatagctggctgtgtgtgttggagggcccagggaatatctgttctgttagtaagtgagggggaaattgataatcctgcagccggcctggagaagtaaggactctatctttgtctgtcagctcttcctcccagaagtagctcagagacttgctgagcacacctagggtagaggccaggatagttgagttttggacgctctgccttggctaacaccttgcctggcatctagcagatgcttatgaaatgtttgtcaaattgaattacttaatttacttgactcaaatattttgttcttctccaaaccttttatgaggagttttttctccacctttgtttgttaattcccaaacttctctccagttctcagttgtggcttatgtcttttctttcctttctctttgtaattatcaggtaatttattaaatggagacaagcttaactagacattaaataattgcaggtgtgcagctgaactgagccgctgtcctttaactaggaaatcacagctgcttgtgttgtattgtgtgatgagattacacttcacctcatttggttacacgatatcttgcttattgtaaggtaaaagaatgttgaagcttctgctctaagcagtacacaaaggctggtatgttcccaggaaaccaacgtaaaaagtacttggaggtcaggtctggagcctttgcaacctctgatgcttctcttttcttggaatttttcatttcctttgcctttttctgtatagagaacacctgaattactccttaacttgagacctgtttcacattttaaaattttcttttggtcaccttaactgtaaaagcaagatttttctgtttccttctaagagattagcagtgggtccattggttagctctttttttgctttcattatcagacctcatctgcatactttttatacaaatttgccccattggtaagaattgtagcttttatgaatgttaattttagtcataggttaaattgtgatgtcaccagtctgttttctttggctagtttcatagtttgtgactattgctagaggtagacactagttatatagcaagtacctagcttattacagaactcagagtatgctgctaataaaggattgcttgattgcttgaagggtatgcaggtgtaagaaatattcatctttcaattggtgtcaaaatttttatttaaaaaaaaagtcatgctgccacttcccagctttgtaactttgggcatgccactgaaatatcttaatcattagatttatcatctaggtagttgtgagggttaaagaaattcaacaaatatttgaatgaactatcttttgtgcctttctggatgctagggatatatttgtgaacaaagcagaataaattcctatccttgcgggattaacatatatgaatctggttttgactgtcaactggatggagtccaattggtgggagaacatgatacctaccatttatgaaaaactctttaaactgaaatatgtgcctaataacactaactttctttattagggacattttaaccccatttgggctttgcagagtaggtcttagagaaagcccttctccatacttgttcgttcagtcgtgtatcatgtacagccatccattttatggttttggctgttgtaaataaaatggctagagcctgtgcatctggagttgtggtgactcttagtcttgggatgcgtgcctcttcctctcggtcgttgctttataggctgtctctgaggttccagaaggggctcagagaatgagctccaactgacatgtttgagcctttgagtctcttcatgaaagctcagtttgttcaagtaaaatctgaatggctcagagaggacactgtggtgtttagcttaccaagcccagtgtgatatcactggtttgttaatatctacagaaacacacacaggaaaaatattctagagcatcatattgctcacctcctctaaattcttttttcatggatgatcgaaagaaaaacctttttgagtctctctcttcttttttgtgaatgactaatagaaagaagacgacactggtaactttcagaagcattgtgatagcattctgatggtgggattatgatgttcagacatgggagggtattagcaaccaaacatcatttcctttaggggactggaggtagtggtcatctgtgagtctagagctgtcttcgagggaagtgagcagtggctcttccaaggacacagagatgtcaggcacctctctcatgcatgcaagtgctacatattatgtccacagtatctggagtatttaaaccaggaataacacgtagtctttattattggaagaaataaattaggtcagagttagtatgccatcgtgtgatgccagtttgtattctttattttctgtacttgcttctagagagggagtaaatactatgagataatgaagaaagacatgtttttgtgacttttctgatttaggacactttatgttgtggaggttttttgaaggatttggaatttggttgcttattgagaacctcttgagaaaatcagattatctctgatacacaaccagtcctacattgagttttttccatttattgctgtagagacatgaacatttatttttattgaagctgagagaggggtgttacatggttgtttatcagctctgccaaaagtagctcagacatccctgatgactcagctgatgcccttgctgcctgattgggtgcttgtgtactaagtacttgtttccttgttgagggctaggaatatgtcacaaagccccattgctgtggggattgttgcagtgagcagacttagcggaactgcacaaggctggctagaggccaggtttagactaccttggaagaattggcttaagggcagaggagaggtttagaaaactcctttcttcctctttggtggcattaatctttgcgaaaccaggctcagactccttttgcacctttcccaggaatggggtagcatagatcttcttcctatgtgaatcacagaaagggactttgtgtgggtgctgtgtgttcattgtaaaccactggtgctgctatctaggtggagttaaagttgataccagcagagtaagttagcctgagcaggaggatggagttctgcagtacagccggaaattttcacttcatagtgtttctactgtaacttctcaccctgtgttgaaaaaggcacacctggccattcgcatagtttggatacgttttaacccataagagtgctgtccttaaagatgatgaaaagagacattttagctccttggaaataagcacatttctgaaaccacccgtctgagtgcacacttgtgcagataaacaggtacttttgtttatgctctgactcaagtggaaagggcaaaataagagattttccttctcctgagtcttttcactgtgaggattttgtcctttaaataaaataaaccggaactgtaacctttattatgggaggagtgtggaggagttaggaatgaggcaaaatgccctccctgtttctcagataactcttgctaccgtctgagcagtgtttatttaacagatttaatgcattgcctcaatagcatcacacgaaacatgtcaccccccctttttagtttcttcccttcaaaaattttcttaaaaatgccagaaccttaccaagtcacttaaataaatcagtccaagtatgaaatgatctctgaagtgacttaacacaaatgattctgactttactacttgggagactcttttttgatggccagccctctaaattgtaggaagatcattttctagctccctattgtcaaaaaacaaagcaaaatcaaattaaataagtcccttaattcccataagtaattttaaaattatctcttgtatatactttacttgtgtgcagcttgcaactgaatatcattgtgagagctatagtttgtcagggtttagatcttaattagctcatgagattgcatccttttgaagctgtataccacaggttgttggctagttttccaaaagcaattaaaatgcccactgttataattaagcctgttactagttgtatgttctagttataaaatatatttggcaattaaggaaactgagattgaggcttttggcttggctctttgagatgcagtagactggcttccaccttgatctgttaggatgactggtgcggatgcctggatgatgggacatgtcttagtccttgagtacctatctttatgagtaagagcaaccacaggtttttacaagaaagctaaagttagagaatgtgactcgtgtcctcacatatgccgattatgtcctacttggtatacaggagtcaaaacctaaacttctaagttgcagtctcttagctgagaagtcctttttaaagaagcattcccttatctttaagaagatggctcgactctgactgtgaacatttaatctgttaaactaacacctccattgcgctgtttaaatttctgtctggttgttgaaaagaaggtgtgggagaaatgttgcaggtacatgtggttaatgtctgtttctgaactgtatttcatttaggagttgttaagctgtgtgcccaccatctcagagacagatttgtctgaactggcctgtggaggaagatctcattgtcagggctggtctcaatggcagatacagttctcagtggtgtgctttgcgtgtcgtgtcttttattcttcctttcctcctgctcacccttaggaatgtttcctttttgtgccttaacaccagaacggtatggtggctgagaccatgggacaaatgcgtcacttagtgggcagatagaaatcagtatttaaagtatgattgaggtttttgtgtttattttgaaattcatttagtacacagggaagaaaacagcacttggcttatgtggttctatcccattgctttgcctgtttgtgcccccgtgcaattaacatgaaaatgatagtttaagaatgagctcattaacatttagaactgggtaggaacagggcttcataggatgttaaaatcagagaaaaagagaaaagagcaggtgctttgtaaatactatgtggttttgagaaatagtagaaagttgggtcttattttaaatttccttttttccagagtccctttaaagttgtgattaatgatatacattattttctttattgggcaaaatattagaattattagagatacatttttcttgggaaaaccactgtggttctctggacatttctatgttaactgtgtcatatattagtatagaataaattcacaggcttgtgggtctgaggacatttgcttgtttcctttaaatcaatttatacaagcacttcctatgcttccttcctaacaaattttccataatttatttctggcctcgtaaaaatagagggaaaataaccaatcaaattattagctcgattccttacatgagttcttcaatttttcctaggtaccaaacaaaataaaaccagtctttgtaacaaagattattggttctgaggaaatgactatccacaaagtgtacatttgtgtgtaatatgtggtatgcattatgtgtggtattttacagttaaaatacaacataattaccataaaataatgtatatgaaatgagttgtaacaataagataagattgacttttaaaaataaacaaccaagaataaacacagcagaattcctaatcagccttactcataggtcaaatttagctttgatgtcctttcctccataagccatatttaggcatcaattcagtataatactccttctttgtgctcccatatcgcacttcatccttccctcatcatggcacttactgtgctgtgttgcttgtttggctaattccttcatttggctataaactattaggatatgagcagacatggtgcctttttcactttgtcctctgaattctttttttaaaaattgaagtaaaattgacatgtaataaaccttggatatttagtatacaatgtgttaagttttagcttagtgttgtccatgaaaccatctcacagtgaggatcatgaacacatttcccaaagtttcttcacgctcctttggaatacttacttctacttctcttctttccttgtcttgagacaaccattgacctggtttctatcattgtagattaattgacacttccaacaattacgtgtaaatgaatctcatatagtatgtactgttttcttttccttggcttctttcacttagcataattaagattcatctatgttgtagtgtatattgataatttcctttttattgctgagtagtattccattgtatggatacaccaaagtttgtttatctatttttaaattgctgagcatttgagtaataccagctttttgcagttataaataaagctgctatgaatactagaatacaagtcttcgtatgggtatctacttttgtttctcttgggtgattatgtagggtggaatggctgggtaaatgggcaggtgtatgtttaactttacatgaaactgccacagttttctcaagtgttagtaccattttacattcccactagcagtgtatgacagttctagttccttcacatttgtgccaacacttgatatagttgatattggtaagattttagccattctaataggcatgtagtaaaatctcgttgtggtttacattttcctttccctactgactagatgttgagcatcttttcatgcttttgctgtccatatatcttcttttgaaaaccatctgttcaaatcttttgcccatgaaaaaaaccttagttgtttgttttcttattgagtttcaagagcttttgtttgtttttattgacacatgattatatgtatttacaggggacagtgtgatgtttcaatatatgtgtacattatgtaaaaattaaatcagggtatttagcatatctaccacctcatacatttatcgtttctttgtgacaacattgaaaattctctgattttgaatactacaatatacaacccatctttggtatcaaattttgaaatatacaatccaatatcattaactatagttaccctatagtgcaagagaacaccagaaattattcctcctatctgtaatcttgtacctgttgaccaatctctcttatgttcccctgctttcccttcccagcctcagtaactactattctgctttcaagagtttttttttttttttttgagagggagtgtcgctcttcttgcccaggctggagtgcagtggtgcaatctcagttcactgaaatctctgcctcccaggttaaagagatcctcctgtctcagcctcctgactagctgggattacaggtatgtgccaccatgcctggctcattattgtatttttagtagagatggggtttcatcacgttgtgtaagctggtctcgaactcctgacctcaggtgatccacatgcctcgccctccgaaagtgctgggattacaagtgtgaaccactgtgcccggccttaagagttctttacgtgttcttaattgaggtgttttattaaatgtatgatttgcagataatattcttccagcctgtggtttgtattttcattgacttaacggtgtcttttgaataatagaggttttaaattttgatgaagtcccaataccagtttgttcttttatggagtatgcttttggtctcataactaagaaatctttgccaatttagggttacaaagtttcttctagaagttttgtcatgttaagttttacatttaggtctatgattcattttgaattaatttttgtatatggattgaattttttttttttgagatggggttttgctctgttaccaagtctggagtgtgcagtggtatgatcacagctcactgcagccttgacctcctgggttcaagtgatcctcccacatcatcccctcaagctgtagctgggactacaggcatgcaccaacacacccagctaattgtgcatgtgtgtgtatatgtgtgtgtgtgtgtgtgtgtgtgtgtgtgtgtgtgtgtgtagagaccaagtctccctatgttgcctgggctggtctcaaactcctaggctcaatcgatcctcctgcctcagcctcccgaagtattgagattacaggtatgagccactacacccagtgtaaattttttttccatataggtatctaattatgtcagcatcatttgttgaaaagactgtccttttccattgaattgcctttctgcctttgtcaaaaattagttgtctatatatgtgtgatctatgtaaaaattccttattctgttccattggtcagtgtgtctgtcccttcccaaataccccacagttttgattactgaagctttatattaaatcctaaaattgaacagtgtgagactttcaactttgctgtttttcatccttcttttaactcttctactggttcctttacctttccatagaaattttagaatcagcttttctgtatccacaaaaatgtccttctgggatcctgattgaaattaaattaaatttgtataccagtttggggagaattgtttattgtgttgagtcttctaattcacagtcattctccatttattttggtctttctgtaaattttttagcagtattcttgtagtcagtattcagcatactttatatatatatatattatgtttactctttttatgtaactttaattcaaaaggtacagagactctcccttagtgctgttcttaagacatgtttatatgacatctttccattagtatctttggtcgtgttcctgcagtatcctcagttgtgctcaccactgcttaactcacctttgcagccaagtttcattttgagtcaaatctaccagaggaggtcatttaccacctgagaaatccctcacttagttttaacagaaataaataactttaaaacaattgatacagctccttctttggcttgtataattttcttcaggcataagtaaaaaaaaaaaaaaaaaaaggaaaaagtgatttcaaacatgttcagagtaactgtaatccagctgtggttgaaagaagaattttgagtggttaaagagctgactgaccatgttggtggctcttgaaacactatcagcttttcttaaccagaaggcaatcaaggacatacttgaggtcgggaacagatatttcataggccactggagtgctgcagtggaaggattccctccagatccttggttcacagacagggaaggtgaagcctgaggagacttggttacttggtttccttggaggatcatatgctcagtgagctcttcctgaaaaccagccctgttcccatcagaaactgcagagacatagtacttcccattcagcaggttacatggagtcagcgtaggcagtcaaaatggagagatgaaggattggtgttgggtaatgagagcaagggatggtcatagaactcagagatgataatgtgaccaacaggatcattattcaaatttcccaagaggcacaaatgtagatgatgattgctttcataagctagtggagttaatttctgtcagacactattctaagtgattttgtatatgaactcatttaattttctcaacaaccttgtaaggtataggtaccgtaattatttcattttgtgaatgagcagaaattaagcacagaggtgccagagatcttttctcataggtgatgaaggtaggagaggaacccaggcagtctggctatagagcacagagtcttaaccactacactgtctggctgatggcaaagagcatgtctattaagaaagcctatggggaaatggtcgccaaatccttctctaattcttggggaccctgagtttcagggttttttttggttttagaaataagggaaactcctgtcaaatgataagattgacatttttcatttttgaagttctaaatgtaaagctctttgaaatgtataggttttcagatactctgtgtgtctgtgtgtgtgtgtttgtgtgtgtgtgtctgtgtgtgtgtgtgtgtataagttcagctcctttaaaagccccatctctgtcacaatcacatttttttttcacaccgcattccaccctactaatactcagagcttagattagggaggtgactaggatactgttaattaaaactatatgacctgattagacaaattaagagaaattttcgatagggaaaagaagcaggacaaggactgaacttctgagagatagtgaaaaatcaaggtgtttttcttattctcagtcacttcacattttacttctgacactagatgtgtggtggattttccccacacaccaagcagttctccagaagacatcaattaattagctgaacttattcaatttaattttgaccctatataccaggcattctgatactgtctacctggagatagtatcagatctcacaatctcagggctcagtcccacacaactgcccccgacttcagacaccaattgcaagttccaggtgatgtgtacttctgaccaaccagctattaatcggggttctcatgaccccctcctcaggtttgattaatttgctggagtgactcagagaacccgggggggaaaaatttgcttatgtttgcccacttattattaagaatattacaaaggatacagatatgaacagccaaatggaagagatgcgtagggcaagataggagagaaggggagtgagtggacttctatgccttccgtggacttgtcacccttctggaaactgcacgtgtttagctcttgcgaagctcatttaaaccctgtccttttgggtttttatggaaaatttattacataggcaggatcgattacatccttagccattagtgactgattcaacttttagcctcctctcttatttgttttaaacgtttgtttccaaagtttttttctcccctttgaggaggacagattcaggcttacatcaaaatggaattaaatgtgcctttgatttggaatggggcaacaagagccgcctgcatggctgtgtatatttatttatatggggtcaggtaaaagcacttttaaaataagcaagtattagagatcagaggttatggagcagctgctggctctggctgacaaagcattcctggtggcatttgccactagctctctgggtgtgggcattagagagtgtgagagttggcctgatggcctttgtgtttgtggccctgtgtggaaactttatagcatttcagccgttctaatctgtgcaggcacagagccacagctgaccataactcttaggggaaatgaggacagaaaagttgaacagcactgtgtgctgtgtagagtatggagaccagaatgaagggtgcagaatgaaaggaaaaaaaattttttttgaagtatcctgcttcagggtttctattgtttgggaaactattcctatagaaatgacatttgtgctttgtgaagggggtggaggtagattttctggagtgtaattttctggagtgtttccttattgaagggggaaaacaaatgattggaaaggctcttcctctgtttctctcatgcatccctacacccccaatatatgcagtgtccttgtttttgttaaatacagaagctatacagagggcagttagagttcatccaccgttttactcattggatgggattattaagagataagaccatttattgcttagcatgagaatcttactgtcccggccagcaaaggaggccaaagatttcatctgaactttacctcttcaattcaagccaccaaagatttattgggagtctactatgtaccaggcataacatatggcatataaaggctaattttaacaattatattgccgtttatgttgttggtttggatagaaaccctgtcttccactaatccttacttttcctataatacaaagattatcattgatgaaacatattacagattattattttaagctatttagcaaatattagacattttcttagagaatgtttgagcatatcagaaattgtggtggatatgttagtttcctatttgctgcaataataaattaccacaaacatagtgacttaaaaacaacacaaacttttatcttacatttttgtaggctagaagtccaacatggatctcattgggctaaaatcgaggtgtcagggggctgtgttcctcgtggaggctctgggacaaattctatgacctcatctttttccagcatctagaggcttccctgaactcctaggtgtatggctcttcccttcatcttcaaagccagcaacagcagattgagcccttcttaaaatgccatctctttgtttctcttttccatagttacatcttcctcttccacttttaagaacccttgattacattgggcccaccctgacaatccaggataatccccttattttaagatctgctggttagcatccttaattccatctccaaccttaattcccctttgctatgtgtagtaacatattcacaggttccaggaattaaatggacatggacatctttggggagccattatttctacctgttacagtagggtggactttccccaaactttgctctttccccactcaaatgaaattgtatagtgccctctattaattctttgcaaaataaattgttacctatgaatgtgtcttgtgcgagtggtgggtggtttatcactgcttaaagcctcactcttcttcattgtgacaaaaccccagccacttagttttgtacaatcccagtgttcaaggaagctagagatcctcttagccagcccgcccgcaggggttttgcacacacattgttacatctcttcaaaatggctgtcccacctttgcttacatgaaatggcctgccttggcaaataaacctctttgaacagttctgtttttgttagatagttcctgctttaatttaggggaaaatatttctctttgtgggtttgtagaacctattggttcttgttttactctctggggtcatattgaataaatctaatttcttctttcacacttgaagcccttgagattttttttaaagacagttctcatatcccccaagtatcagacttaaaaatctcaatttcttcaactgggtctcacataaaactgtcttgagacttctctccatcctgttccttctcctgagtatgatacaacatgaagaaggggaggctgaaggaagatttaataggaggctttaaatgctggggggaattgtcatacagaaaaagctggtaaggtctttacatttaccatggaaacaagaaatcacaggctcatattgtggctaaggagatttaattagcaggaaacctgtcttaaccttatggatttggtgtcaggaaacctgtcttaaccttgtggatcatgcaatggactgcctgctatgggaagttgagggatcttttgccttagtgtaagacaagtcttcaagctcagaattcgtatattttgtgtaagagacgttgcttttagttaaatgttttgcttaaagtattcttgtcattgcttgtcatctatgcctgatgcctgaatttccctcttgtgttggttcattggatgtaaggcatcatcatgactgctgttaatcatagggggaaggaatatggttcagggctttatgaaggaagggaaacagtggcatagcacaggataattaatagcaagtggagtgacagtttgattccctggtagggaccctggcattgttgaaggaaaaaaaaatcactttattctttcatagagagaggcagctgtaattctggttggatggaatccaattaaaaggaactgacatgcaaattgatgatgagacagtgtgagcatagaagtagtccaagaagagttttgtaagaaatggcagagaagagtgtaagtaatttggcatggtaatgtgtgtaagaaaatggaaagctgatgggttggctacctgaacaattatgtctggaatctcagccagcagagaacaggagactggttggtttggtagagttgttaacaaaactttctggtgttttgagttttggtctacattttaggaattatagcctttcataatagaatgaatataaatcaacccttgagggttataggctttcaaattggtggtggttaaatataatattctcaagattctatgatgggagtcccagcctggctcttggaaagaagatctcattgtacaggtgtacttcacctgacctaatgatgtgttctcaaagatttgtgtgagaattggctcctaaatttaggatgaaataggagagcttgccatttctagtaatgctattatgaatcattttctaatgtaaaaaatccttttataaccacagtcatgcccaatttatcttttaagtaaattcataagtccacatattagatttgtttaaaccaaaggtatttttctttgaaatgaaataattgtaggggcacataacagttaagctttagagtaacagaggaaaaattgggtaagattttataagtcagtatattgctttttagggaggaaattctgcctaagaagtcagacagcttctgctgttattacgggaaaaggagaaggctgcccaacgtatttcagggagatttactaggatctcttgggaactgcagtagaaatcactacgaaatattttgaggatagaggaaacaggacaacagcgtttactaggttttattctgaagaaagccaaagaaggtggaatggagttcatcttgagaaagcggtagaagattgagaagctaagaaaagacttacacagcagcaaaaagaagaagagactggagtagtgggcagagttttcagttagcaagagagcaccatccaattgttatgctggtcagcagcaaggaacattaatgaaggagatgaagaatgaccagggtcagtttttgttcatccaggtttgagcagggtgttgcttatgatgctccatgcagttttgcctcccacaatctctctctgatctttgcctcctgatctgctcaagtactgcagcagcaatgcattctctactgaaggctgtcacgtttacttttcactgtgcctagaatgctcttaccctcaagcctccctccttcacttgattcaggttgctgctagaagctcccttatcagagagacctttagtgaccattctgtctgaaggaggcagacactcttcccttattccgcttttcttcatagcactcattatcacctcacacatggttgtttaatgtttccccaattttctctgctagaagtaagttctttgagagttcagcttcagtttcttttgcccatcagtgtattcccagtacctaatttatataaaaatttgtggaatggatttttagggtatctcttgcctatcacagtgagaagagctgagaatgaagaatacaggactcagtccttgtcctgtgttatgcaatgtattacatagttatagtaagtataacagcctgagcacagagtgctgtgagctttgagaaataagctagagatggtcatcacagaactggatcttgaatgataaagaggagttttgttctgtggtggagacaaggaatgatcttctaggctatcaaagcagggtgagtgaagttggagagatgtagaaatgagttttgtgtttggatgtcattgagtgattttgatttggctgctagagcacaggtacatgggaaagcatgacaaaggggcctgagaggtagggttggggaggacatgtgaaacatatgttgagatctgattggtaaagttattgataggcgtttggaccttgtcttttgggaagcagggaagtagcaatatccaaaagagagtgcttaaggatggattggaagagggaagattatagaggggatagagagcaaagcaggatgtgactttcccagccttgaaatgcatgagaaagtttgggatcctcacaatgaagggcaaaaaaaaaaaaaataaaaagcaattctgtttatggatgtatagcaatatattgtgtataggtggtggctattagaagactagtagttcttggaactgttcctttttttctcacaatagtagttaagctgtgtcattgggatacaaagggaaggagaaggctatttccattcttagaatagaaaaattggaaaatgccttggcaaatggaggtattcttattctacattttttttttttttttgagaccaagtctcgctttgtcacccaggctggagtgtagtggagccatgtgagctcactgcaacctccgccttctgggctcaaacgctaccacacccagctaatttttttatttttgttttttaagagctggaaatttgctatgttgcccaggctggtcttgaactcctgggctcgagtgatccgcctgccttgtccccgcaaagtgctgggattacaggtgtgcaccactgtgcctggccataccttacaggttaagcagctatgtggccttgtgcatttcatttaactgtgtttcatttgtcctttcatggagatagactttgttgatatcctttcatcgttgatgtgcagaacaaagtatgctgcttgggaaattataaacatactttcatttgaaatattgggtaatatcaggagtcctttgctttaatagaagtagatctggaattgcttttttttttttcttggaatatggtaacaccaaagcatctgagctactcacacccatttccagaggaaaacatgatcatttccaggagatggcctgcagttttaaagctttttgctgcttgttttctacatgtcaaaacacatcccatttcagcagttggtgagcgctaccatagaactgttcagaagcaagagggaggattgagtcatgttgtacgtgcagctgcatattaacctgcaggtcatagcagtccctgatccaaaggactgtctgacactttatccccgttcttactgccttcatcattcacagcagccagtgtaggactctcccactttagccttgatcatttggagtagcagaatcgtggtcttgtgtatatatagagtgttatataggccatgtgattctcggagacctttttaggaagtttgagcaaccttacatattggaattctttcctctttttgagaaggaggaaagaaatgtatgttttataaggattgctttgaaatagatccattttgcagggtttaactcaagcaaagaacagactagcttaatggttaatattaagttactggagtttgaatgcctaggtcccaattcaagcttcaccattattagctatatgaccattagccagttttctcatttgttagatgatgataattacaggaagatactgtatcttcccacagagtggtccagaggaatgaatgagtaaatacatgtaaatcacttagactaaggactggtattatggattctctgactgttagctgttttattcctgattttctcatagccactggcatttctaagaccttgcaagaaccactggtcaacttttctgcctgctatgtttaactagtagaagtcagaaagtgacttggtggcagagtgctagaaatgattcattgggtggactattgagcttcacaccccagtccactggcatcatgtaagaaacaactcattacactctaacggtagtttagtgaaatggatgagtagtcttagtctgcctcctcaggctgcaacagaaagtcaagccaagcagccaggaatgtctgggaatcacctggagagaggacagacatctgcagcacagtggaaggtgatagatgagtgggacccaggaataaactacagaagcagtgtggattgtgttgattctagcaagcaggagggggtctccatggtatttctgagtataagccaaggaaatgtgttaatgtggggggaaaaaaatcaccgaactgggagagagtcagactacctcgggtgtgacctttgccctgtcaccaacatattgtatgtcacatccccatggggcgagtcacattttctttctaactctgtttctttgtctgtaaaatgattaaatgatttcttgactctttcttttctagattctttttaacgatttcattagcttttaataactatgtgaggaaaggagagcaacctgctatagaccttggcctgtgtgagtctttaattttgttttttgttatttcaaagaagttcttgttcaaaagaccatgagacatttcatcattggactttttagggagttgtctctttaatctctcatatttccttttttccctacaaatgatatccacagtactgctgttgtcttgtgctctctggatcagcacttttccagagaaatgaaaacactgcacttttaacggcacagaaagcaaaattactgtagcatcaggattcaaggttacagaattggttaactttctggtttgttttgctgagctgaatgaaaaagatttgatcgaatgttactgcttagggataaatattaataaccacaaactctcttagtgatcattgtccccccttttgcagaaaatttcaaattatggtctaggacttagattgtgattgtcagctgaatatgggcgtgaaaaatgtggaataaccagataaaggacccttaattggttgtagaggaacaactttttggggatccatgtccagagagggaattggttctggattattgatttgtatcattactttgattaagtgtctagcagttgctgtagacctttataacattatataatagaaatggtattagaaaaaagtcatcaaaggtaggatttttttaaagatataagaaccgaagtttttaatcttcagtccttcatagagaagaatttattaggtttgagagttctcagtaccaagtaaattctaactgcagacttaaaacatatgaatacactcacatatagtcaccccatcctctggcctggttttgttctctattatagttgactttgctttaggggaaaggagggagagtattggtattaatttatttgaaaaattagcaggagtatatcaaacacttactgtatgccaggacttaccatgataaataagaggtggacccctgtccttatggagcccacttgaatcaaaaagtaaacatatgagcatgcaaatagatggctgtaagaatgtgatgggcatgccattttttctagcaggttgcctaccacatagtctatatgtgttagagatacacattaggtacacagaagagggtccatttgtggcatagagagagattagaggaatcttcatgaaggaagtgacatgatgatgatgttttgaatgacaggaaggagtatgcaaaaaaaggcagggttgacattccagacagaaagactagtatggaccaagacatgtggacatggaaatggtttgctccttttggggtcctgaaggtaataagtgcaatgaggctggagaactgggtttgtcttaaggggctatgggaaatgagggtcagagtgtaggctcttatgaaggctgtctggtcagacttgaggggaaggtatgctggtaaattgcactgagaatagttcctagctgtcccatatttcagcatctcctgaaatagatgtgtactgtgatgtacaagttccaggatacaatcagttcatgagtatccagttaatgtacctgcaggatttgggcagcaatatatgtagggtgttgtgtgaaaatattggatatgaacaattacaatcttggcttgcacaagaaatcattgtgatgcaggagggaagggtagaaaagttagattattttttttcccctctaatgcagtgcctctcaactttgttacaaattagaattacctggggatcttttttttaggatattgtttacatgcagtgaaatgcacagatcttaagtgtacacatcaatgaattttggcaaatatacatacccatgtagcacacttacccatcaagttatagaccatagtcagaacctgaaaaagttttttagtttccggtttgaatcaattcctgcccacccctcccatatgtaaccactgttctgattcgtgttaacatagtttagttttgcctgttcttgaatttcatgtgaatggaattatacaagtatgtgctctattgtgtttgccttcttctgttaacataatgtttttgagattgttctatattgttacatgtcagttttttttaattgctgaatagtaccctgttgtacagatataccacaatttgtttaatcattttcctgttggtagacatttaaattgtttcagatttttggctattatgaataaagctgtaatgatcagtcttgtacaagttttttttttttttggcagacataggtcatgatttttttttaacgtaagtgcctaattgtggaattttgttataggtatgtcagtgtatgtttaactttataagaaactgccaaacagttttccaaagtggttgtaccattttacattccctcctgcattgtatgagagttcttgttgttccatactgtcaaacatttggtatgataagtctttttaattctagccattctaatgggcataatatggtatttcagtatggttttaatttacatttctctgatgatttatgatgttgagcactgttttcttttgtgaagtgtgtggtcaagttttttttgaccattttcaatttggttatctttatgttattgatttatagggctctttatatactttggatacaagtcccttgccagatatacataatgtgagtacttctttcagtctgttacttgcctttttagttcctaatgacatctttggataagcagaattttttaattttgatgaagtatagtttatcttatttttccattatatattttgtgtcttttgtatcctcactaagaaatcttttcttaccctaggttatagaaatattcatctttgttttcttctagaagctttatttatcttttggtgtatgttccatcacaaatttttgagtgtgatatgaggtaagggtagaggttcattttctccatatgtttatctagtcgttccagcactatttgttgaaagaccttactttctccattgaatgtccctggcacctccgttgaaaatcagttgcttgagggccaggtgcagtagctcacacctgtaatcccagcactttggggggatgaggcgggtggatcacgaggtcaggagttcaagaccagcctggccaatatggtgaaaccccgtctctactaaaaatacaaaaagtagccaggtatggtggtgggcacctgtaatcccagctacatgggaggccgaggcaggagaatagcttgaacctgggaggcggaggttgcagtgagctgagatcgcgccactgcactccagcctgggagacagagtgagactccacctcaaaaataaaaataaaaaaaataaaaaatcagttgcttgtttatgtctatttctgtttaggtctatttctggactctgtgttctgcttcactgatttatttgtctgtcatcccagtatcacactgtcttgtttatctagctttatagtaagtcttgaaatgcagtagtgtgaatcctcccactttgttttcttttcaaggttgtttttactattgtaggcccttttcttttttatataaggtttagaatcaaattgtccagttcttaaaaagaaaggtagctagggtactttaccttacaaaatcccttgatacccagaccatacttcatcccagttaaatcagaatcatttagaaatgaacagaatctcgttcattccctagattcttctgagtgcagccaaaattgagaacctatgtactaatgggattttagtgtggtacactaaagaagatactgtcatggattgctgggatggaagccattccagtggaatgtatgcataggagctgatgtgggcccctacacgaaagaaattgttgatgtttatggaaccaggagagctgaatgaggaagagaaggagcaggagtgagaagccctgtggtcaaggtagtagagttccctctccctggggcacatggagccccattgctgaggcgctgccttgtgtggctcctattcctgattattcagggtattcccaccctaaacctgctgcagtgcagccaacaaaccaccaacttgaaatctagggaatactcttagtagagcgtgtaaatgtactattttaaagaatagctttcccctggattagggaaatgcttgtgaaatctgcatagtgatgaacagggtaggcacattctagaagtgcctgtgtgggttttttgctttttgagttttttctgtctttttaatgtaatgtctttagacaaacattgagtcatccattcttcccaagggtaggtagttcagtcagaagtgatgttttcccaaaaggctttaaagaaaaacgggacaaaaagttacgctcaagtaatatgttctttgggagcactcaaagtatgcaggctggtaggttgcttgcttgtggcttttttttttttttttttaatttaaacacacattttcctctttgaaaagagaggttggaactagtcagctgagtccctctttctgaaatacacgttccctaaacagctgtagagaattaatttcagtcaaagatagcagagctttaatctcagctttctgctcagtgttatggaaaatcctttctagaaaatagccagtgtctacctgctatgggatgttaaaaaattcaaacgaacattggattttttagtgttttcctagtagaaacagcatggaaaatcctttagtgagctagattttacagtgcacacagaaagcaagtatctatgatacatttataattttgtgtgtgtcacatgttggttgtactattttcttattcctaatagaattgaaatataccatgtccaattccaaaccttattttttttgtgtgtgaagggttgaagcattttagacaagaaagagctttgatactagcaactttaaactcatttataggatatatatacatatataatacatacatatgtatgctctttcaaggcagaggaagaaggtaggcagagtatgagaggagagttgcttttctttctcaacttatgattgtatttaacacatactcgcatgcacacacacattcttttaatagcattttttttttgtagtgagagaaaacttatctttaagaagtctctaatctattatgggattaagagttttaaatgtcccccaacacccccccccccatttttatacttttatttctacgatttatatgtcacgtgaacatcactttttggtggtgtgattatatcggaatacttttgtattttgcttaacattaaaaaagccatttcttacattgctatatcatgatagtaatttaatggcagcataatagtacctcaaattgtgccatactttatattcttctgttgtaagttttctattttgtgctgttaaacctcaaagaacttatttgtgcatagaatccctcttaatttcttcagtacatcctctgtgtagaatagtcacaaggtgcattttgttttttccttatctgtgtacagtttacactgtatatgatcctcagtgatatagggtgtatttaccttaagaatgatcattatttacatttctagggataaaaagctactggatttctttcataactgtattatttaaaaagttgttcttcccctttatttttgtgcacaaatttgagccacatttatgtttgtcttttaatgggttatgggttcaaatttttttcttaactggtatgtttttttttgttgttgttgttttaatttttttttttttttttttttttttagaaactaggtcttcctaagtaagttgtctggtttggtctcgaactcctaggctcaaagtgatactcccacctcagccgcctgtgtagctgggagtccaggtgtgtgccactgcacttggcaatatgtaactctttgtgatatttgtcatgagtattttttccaagttttttctttttttattttagtgccattgtgcctggcaatatgtaaccctttgtaatatttgtcgtaccttttccaagtttgttcttttttattttagtttttcattacaaagcagtttatgaagttttttatattttcttctgttgccttaagatgaacaaacttgtcatcccttctgagatctaacatcaattctgtccccacctgccccccaatatttcctgtggtttaattaaaagcaatttttaaaatccatctgagtttctgtcgatacatatgccctctccttacctgctgtgctatgaggaaaggtgggctaaatcaggagctcgtgttattcatatcttgggagaggaatagaaacagccagtactccaatctcagcttcctgtaatgtctacaagtcagtgtttgctcatctataaagctgggatgagaataacaaatgtacagagaatttttttaatgcacttaagccttctcttaagcactgttaagaacttcagttgaaagtgtttaaaataccaaatagctgtaacctttgattgttaatatgtgtgcaccatcatttcttggatttttctcaatagctagagaccacatgggatctttggtgttttccaaaatgaaccaccatgctattacctgcagacattaagggtctgattatacaaagaaactgagagttgaggatgtccatcagaaatacactgtttcaaagtcagatctgagtacttggtgaagactttggggactacttaatagtaatgattactagaaaaataaacactggcaatatagatagtggttaaaaaacatgggctttgggctgggcatagttgctcatgcctgtaatcctggcactttgggaggccaaggtgggaggatcacttgaacccgtttgagaccagcctgggcaacatgccgaaaccctgtctgtataaaaaatacaaaaattagccaggtgtggtggtatgcaccttaagttctagctatctggggaactgaggtagaaggatcgcttgagcctgggaggtcgaggctgcagtgagccatgatcatgacactgcactctagcctggaagacatagcccaaccctgtctcaaaaacaaaacaaaacaaataaacaaaaaacgtgggctttgacagagagacttgtttaacttaattaaacaagtgccacttaagtgatttggggtgagtaattttagctctctaaactcagtttcctccactgtaaaatggggataatattgatgagtggtttaattaagaaaatgtatgtgaaatattgagcatggtgcctgacccatagcaaatgctaagtaagtagtagctgttattacttttattaacaagtaacatttgtataacatttatgacctacagagccctttcacatgctgtttcttatttgtgaactgagtgttttatacagaatgggtttttaaatgttccataggctttttattcatggcttcaagaggttgttccctttttgggacctgtacagcttgtgtatactcagttggcatttgtcacgtatcttcatgccagtgtctttgtatctgaattctaaaactgcgtgaacacaaaggttatgtcttttgtcttattcatctgggttgtcactggaacagagtcaggagacattcctatttattatgtgcgtaatcgtaggcaagtcaatctctggcttgccaaagctgtcctttcctcatctgtaaaatgggtaacaagtttcttgtgaagattacgttaaataatgcattaggaagcactttgtatagaaaattacaaatagttttttgttttttgttttttttttccgccatgcctcactagcctagtatcacagtagatgctgtaaggttggaggttgttaggaaggctatagagccaagtcttaactttagtgtcacaatacctttgttaaacaatgaaattcagtctttgggggctagttgtcatgctgggtgctgtgccaggctaattaatactttggtaccttgcctttaaagtacttactgctgctgtctccctccctcccctttggtattcattatttatagtataaaacatttgctgcttgctgttgtaaaggtgggggatggggtgtagttacacataggtgctcagagcaggttcaatgatttaaccctacatgaggaagtaaacttaatctacataaaatatggatttgggggtgtgtgatctctgtggtcagtctggaggagtgtgcgtgaggtgtgtcagccactaagcaaacaatggagtgctggctctgtggactcttggctgagtcagcattgtttcccatggaatttctttttctcttagcccacaggtgtatttatgtgtcctggtatttcttcgtttttattttcccccaatttgatttcataaatgatagtgcaaagtgttggctatggttaatttcagtaaataaggcccaaatatgaggtatctgtttctctcttgagtaaaaaataaagtcatgttatggggaataaaagcaaaagcatttaataaaaaaatccctttgttcattttagaaaatggtacctttgttaattccttaagagacaatttattatattctgacactatctttgaatagtcaaagaaggcatgatgtctcaatttaaatttcttcttcctggcacagcttttattctgcaaggtttgtgcttttaggaagagggtattgtttctcataggagagtagagtgcctagtggacagaaaaaggtaaagattgtcatttccttgaacatagattggtgtttaatttctacttaagggtgtcttttgagaagaacagagcccactctgtttagcagcttgctttttgctaatcatgtggtgcatggtgtgttttcatctagtccgttccattaagtcttatttatgctttggggatatggataattggctacggctcaggtgaggtgcataggtgatgtgtcatttctctcctgaggggatagagatgacaggcttcttttagataatcactgtcagtggctgggacccaggaacctttggtattcacctgtttagtcagtggggggcaaatttgatgcaagagcagagagggaactgtttttaaactatgtatatagtcactatgtgattaactctttggtggccctttaagtacaggataaatttgcattagaacttagtgtctcagagtcttcgattacatgaagtctgaaaaagtgatgaccaattgtcaatattttggacatattccatgagtgccccctcagaccattggtagagataggtttgcaggtggtgaccctggtgaaatcctcctctgagaagggagtgttcaagggcatacgttggcatcatttaagtagcagaagagagcaccccattgagatggtttaaaaatgagatgctaactttcaaagttttttaaattttattttttacaatgcctgtgatgctactacattgtataaacagtatgtagtgttaaggatgtgcctcgcatgtaagccaccactagcatccttagtgtgggggtactgttccttttctacccaaatccctgcaagatgttctgagattttggtgccaaggagtctcccaacattcaacattgttaaaacacacttccttatcttctttgaggttttttaatagcaaatcccaagccactcacctttttctcatagtattaatgttctaagagtggctatacattatgttaaagtcagcgtagttctccacgggaaggctgttttttaaatgagacttattcaacctctttttagctggtgtttcattaccaccgaggatttataatgcaatagctctgaggcaaagctggtaagaatgccagcttcgctaatatttagagtcataaaattctggatattggacaagctcttaattactctgaatccgtctttgtcttaataaaagttggattgtacccactaaaacaagatggctgtgtttgcattaatctccaaatgtaggttaatacctttttaaaagctgtctcctagacaagagacttgaaaattaatttcccattttcagcttaaaacgaagagctcttccacgtgtggagattgaagggctgccatttttctgatgctgtagattcaagtgccaataataactctttgttcctctttagtttttttttttttttttaatgtcttaggtaaagaagtctttcttttctggtgcttggggacttgtattttttaaaaatctgcttcaaagtaaatagatgaaatttcattttctcagtggagtttggatcactgggattgagggggatgaggaagggctagatagatagtatgaaacctattggattcatactatggctgcagaagtctgggctttacacattaggttgctaccaagctggatattttgaaatatatatatgtatatgcctgtaatgttttagcatttgcttgttgggttttttttttccccataatggtaggttcttaactgactttttcaaatgcaaggtaaaactttcttttccttttcttgtctccagagtactgatgtgtaaccacttagtaccactaatgccaggattcatttctgtgctacagatggtcagtgagattataaaagctctgaaaaggtttttatataatttgaggtcttctcagttgagagtttgtgtctgacatattaattccttcccatccaccccctgccccattctcaatgtaaaccatatgggacatgtattaaaaaacaaatttcagacattttctggagattttaattcagtagttctggaataggttgcaggaatctgactcttaacgatcaagcacatttgatattcagacaactctattgcatcctccagaagctccaggattctgtatataatttgtaggatatacttgcctcttctatgtcaagtctcttacccagtctgattatgtgagatgtcttaaacagagcgttttttcataaacctttatgtaggataatactactcctaaaacactttattacatagtttttggattggtaatggcaaaagaatgagaaagcacctgaggaggcaccattgtgagtgatgaaactggggtatcagacctggttatgaaaggagatgataacccttgtactgttttcagacagttgcagagttatcctatgaaggaggaaccataattctggtggccctgcagagcagaccggggactgatgaatggatgctgtgggggctgaacataaagagaacaggtttaacagaagggaccaacatcctttgagagatactactttttaccttctaattatttaacccatgaaactattattttctcccaaagacacctgtttttagactatcagttaataaaaagaatggggctacttaggtggaagctggctgaggggcacaaacagattaagccccttttctccccagagctagcaagcagtacccttagccagaagccttgggctccatagaagtggccacaaacacaactagagtatggtgagttctgttcagtggaggtggccgcacagccccctgacaaggagtcttgtgagctccgtaagggctggcccttatctgatttgctgctgtagacagccagtgcaggggactagcacagagggcagagcttagtgaaatgtctgtcaatgaaagctgtggaggacatttgtatctcacattcagtgctgaatgagatttaaaagtcctttctaacataaaaagtctgtgatctctgcttccaagattaattcttaggtctcagtatggatggcccaaggatataagctttgtgtctgcagggactttgtttcctatagtgctggatttccagtacgtagactagcacctgacattagtgggcactcagtgaatatttgttgaatacatgcatttgttgaaaaaagtgaaaattgtttaaagtggtactttgtgaacctttttttctcttttttctgtcatcctggagacttctcatttaacccccagtctgtctcgtgatccatgccccatccttccttcatgcctcacaccacctccttctcaatctatacttggcaaagaggaataaagacgctaaggatattgtggtaaaccaaagtcatctcagaaacacagtgaaattccctaggcatctgaattgggaaacctattggctgatttgctttgacttgggtatttcctgtgattttcagccgggatgtgctcctgtgctcagaagtgaggatctgttgtaggtttatggcctagattaattgggatattttgtgaagtctctgaagtgttatcacttcatctttatccttgcctgctattcctcatgaaaagcatttgaattattttagagaagatataaatttgcttgtgttatccagtgtcagcttaaagctgattagcattttgcatcacctttgcaactcataaatcatccacttaccctctcagtaagcaggctgtaagtcagcatggaagcacctgctgcagcttcttgtcctgtgatttagaggacactccagattctctgcagacccttctgtggtgttattctctggtaaggcttcacctatatgggaaatgagtaaagacttttggtgacttttttttccctagggagttcttaagggttaccctggacgagagacttctcagaaatatagtctttaataaacctggtccaggcacaggtttggttcatttggcatatttgttgttttaaaaattttggaggtacttttcaacatttaaagtccaggacatttcacatttaaaaaaatccagatttagggttattccgggaaaatcagaacacctggcagtgtcaggccatgctgcatgcctggcttcatttgttattgagagcaggagtgctctaggaaaggggtacagattttccattttgctgtagactctacccctctcagtttttccatgggagtcaactttactcaaagtcctgcactgtagatgcttgaattggtgacatccttctatgttgtgcgagtgtatagattgttttttttgtttcttttttgagtaatatcaaccatttaactcaattgaataataacaagaggctaacatttatcaaatgctattaatgtaccaagtactgtgctaagtgcttgtaatatgtttgtttatatattctttacaattatcctaattgtatagatgaggaagaaattgaggcaaagagaggttagataacttgctcaaggccacctagctagtaaaagtcgggcagagtcactgtggtgtcctcagaagcaagtccctgcttgggctagcatttttgcctagtccgggttatctccagaacctggtctgctcctcattcccatatcccattaggaacagtgggcatcagttgcaaaagtagatgacagtaacacactccctaagtccccagtctgctcctgggaggagcagcctgccttgttcatggcagtcatagccacagggggatgtttgaaagacagccccttatacagtgtctattgattttcttcaccctcttgttttgctcatccatcctgttgttctaggatgcttatttgtcatgcataaaagccttgttacagtgaacccaaacaagtcattgacatttaaaattaaattgcaacaggtattgtcaatagctaaactgctcattgacagtgcattgctaattgcattgagagaacatcctaactgggtatattctgccaaatcaaatcggaaacattggctgtctaccagcaaattcattttgacttgcacagagtttggggatccacagatccctcaccaatctcaaaatactgtgtttatggaaacgctaattattatttttttttttgctgaggttctttgcagagaaggggaattctgatcatcttcactgactgctaagccaggagtcagaaactgtgcctttggaagggagagaactacagatttggggtggagtaaagttcaatgcaagggggtcatttggggaggtgggccatcaggttctttatctgtaaatctaagccatatccttggatccattttttttttccttctctcctttttcatccccttctctctcttctataggtacatgggagggggacaagggtggagacacttaatttttattaagcactgttcgtggtattttatgtgaattaatttgtttacttcccacaatgaccctggggagcagatatgctatcaggtaaaaaaactaaggcacagagagggtaaaactcttcgaaagagtcttgtggttagtcagcttctgtgagagtgagagtgggctgccctgaggccatctgttccctctccccagctgatatttttgtgctctcagggtaaacatttaagcctgtgagttaaactcagccttggactagctgagttcctctggaggccttgcaagtagcagtttggttggcagggcaattaagtatgctaggtgcactgtgctgaaccccaggagggagggaaggaatggaatctagtctttgcttgcgttatacatgcttattggtttgtggcaggcgtgattgatgccagaatcaaaatgacttaaagcagcttcccttgagaagcactactctaacggttttttttcctctttgttgccctaggtcccttgtgaataggatttagctctgattcagctgctgctgttcttttggtaatcagtgtggaggaaggagatgagggctgctattaatggcttcttattttgcattctcctaatcagatatcctgcagttattagtgtgaatgcaagatgttcggtggtgtccctgggtggttttcttaggtgtactggactgttagctttctaagatggaatgttttattaggttctggcctagggggttggttagatgggtggaggttgttaaaaagcactaaagaaaaggaataggatataaaaccaatcttcagggggtgggaataacaacccaccaccttcacttccctcccctcctgccctgaaaaccttatcttgctaatacccttcagatattaaaagtgaaataacagagctatttactaggcagctaaatgcaaattctctcccccattagttttaattaggatgaaatcatacatttaaataaccacttctattactaataactgaacttctgattcactctgaacccaggcaaatgcctcttctggtatgaatggcccacctctgagtcattccgcacctgcatattgacacagccaggctcctgatgtgggtacacacatctgggatttaagggcatgactggcatgttgaatcttgggtataaagctttctgcactataccctggggacaaacaggatagctcaactggagaataaagagcttgcaagctcaaaagaaaacaacaaccaaaaatacctcaaccaaattctgctcttgcttctatcctactgtttctttaggtgtttaaagggctgtagttttaaaaatctcccacccacctcatctttttaagtaaatgtcacaacagtactatgtcaatacagttgaaaataagtatttgagttgaaagaattggctctttgaggctttaactatcagatttgtgctaattctttactgtttccttgacatagtatatgcagtctgtgctaagagagtatggatgttgtcgtcggtgtatagaatggtggctgttgtaaacttctgtatgttggggaaggattgaacctgctgtctggagaattagaaaccagcagcttgacttaaatccctcagtgtcacaaccagctaatgaaggagaggactgctaaactcccagtggtctttgtggctacgaggacttactcaagtttgagactatctttagtgggccaatgacgtaggaacacaatcagcagaggacatgtagtttacagcagcctgtaatgtgccagagacatgactagctgcctctttggccctggggaagtgtgtctggccctgcttgcatcctctgtgagtgggaattgtgccagacaccagctagacatgaccagctgcttcttcgatgttctgtggacatgattggctgtagcttttgatcaggacagtgttcctaatgaagtgtgaccagcgtcatttagacaggaaagaatgacagctgatgtgcaagaatttttcttgattggcagcatttggaactagtaaccagagaaggtaggtggggggaggagaagccagctctgattgacaagagcttatctttatttaatctacttctgaggcactgaagttgaaatcttaggcaagtgaaagaaaggaagacacaattgtgaaacataattaaagattcttgacaaaaacatacttaaatcagaaatgtcttttttttttcttttttgagatggaggtttgctcttgttgcccaggctggagtgcaatggtgtgatcttggctcactgcaacctccacctcccgggttcaaggaattctcctgcctcagcctcccaaggagctgggattacaggcgcctgccaccatgcctggctaatttttttgtatttttaatagagacggactttcaccatgttaggctggtctcaaacccctgaccttaggtaatctgcccgcctcggcctcccaaggtgctgggattataggcatgagccactgcgcccggccagaaatgtctttcaataggagagcaatgcagagtttaggtgtgaggttatcactgctccttcggctatgagaaagagcttttgcccagggattgttaatttttaggcaaaatttaaagtggcgatgggcttggatagttctagcaataaaaaaagttctgcttctagttaccatcttgttgactttccaacctacttggaaagatttcctttggagaggccaaaaacaagtgctgtgtatggagtgtggcctgtggtggtaatttctcatcaactcttgatccactgaggatttaaatcttaagtcttcatgtgctttgagaaaagatgacaagcggaaatagtatgtttgtttcctaaggacacacatgtgatttctgagagctgattgtatgcaatgtggtggtattcttttgcaaataggcttgggaacttggcatcctggattcgaatctgggcaccaccattttccagctcattccttcttattcaactccaccccacctcgaaccccgatttggttttaaagattcacatactattgttttagtaattacccttgaaataaagtcacatatacttttaagtctaaagttaatccaggacaggtgcggtggctcacacccataatcccagtactttgggaggccaagttgggcggattgcttgagcccaggagttcgagaccagcctgggcaatgtggcgaaaccctgcctctactaaaaataaaaaaattagctgggtgtggtggcatgcacctgtattcctagctacttgggaggctgaggcaggaggatggattgagcctggaaggcagaggttgcagtgagccatgatggcaccactgtactccagcctgagcagcagagcaaaaccctgtcttaaaaaaaaaaaaaaatccatagcctaaccaccttggataatacaagtgactaccctatatctgatcatactgccaccccaacctaaatccagtatttgttttgccttttttttttttgagacagggcctccctctgtcactcaggttgaagttcagtggtgcgatattggctcactgcagcctcaacttcacaggcttaagtgatcctccccacttagcctcctaagtattaggcatgaagcaccacgcttggctaatttaaaaaatttctatttttgtagagacagggtctccctatgttgcccaggctggtgttgaattcctgggctaaagtgatcctttccacctcagcctctgaaagtgctgggattataggcataagccactggtgcccagcctattttacctttttttttttttttttttgaggggggagggcagatggtcttttagatttacctatgtatttgacaatttgtttgttcatatttctttcttgtgtctcagaccttccttcaggtttgacttttctttagaatttccttgagcgagtgcctattggtagtaaatgctcttttttgtttatcatagatgtctttcttttgcccttcatctcaaaaggtagttagctggatacacagttctagggggaaagattttcttctctttgagtcttgtaggtttgttgtgaagattacctgggttcatatctaaagcccttagcactatgcttggcatgtttgctctgtaaataacagtggctgttacattctcagaaaaatactggaacagttggaggcaatgcaggcttggttgggatgtccatactttgactaactttttacattattttcttaaaactttgatttcattgagattggggtgggagtacatttaagcatcaaaactaactttgaagatagatttgattgaactgtgagttctatcactcgctagttgtatatacctttggtagattatcttacctgtcctaagaatcagtttcttcatctatacagtgatcattgtaatacttcctatttctctgagttgctgggaaggttgcatgagaacacatttaaagctcttctccaagcctcacatagtaggtggctagttgtggtaattatttgttgcctgtaaaccacttttatgacttttatgtagagatgttaccaacttgtcttttttattgttgttgttctagctattctgtttttatttgctcttccccagatccacagaaaagatggggtatctcctgcacaattaactttctactctactgatggggaaggccttctgcagagttggtggctcttgcttggaggcaacactttgatgcttgtctttaggtgggaaagtagctttccaggcccagtactttgctacttgtaagactctcacttacctgaaaattgtttgctctggtttttcttgtgactttgggcaagttacctaacctctcagtgcctcagtttcctcatctgtaatatgggaataataatagttccttcctcacagggttgttgtaaagactagatgggttgacacacatgaagacctgagagcatgcatgacacagaggatgtgcttagtactttagcgttcatcagtgttgtcagtagccagggcttccttctgtaccatattgttgactttcagaataaaaaatacattgtttgctatgactttgtcccagggcgtgtgtattaagcttccacatataatttatatcacttattccttaataacattgtcatgggttagatgggacatgtatttttttcaactttattttttacatacaataaagtgcatcgatttttaagtgtacagttttatgactttgagctacagtcaccactgctatcaagatataggatatttctgtcaccgtaaaaattcccttatctctttcccagtcagtctgtcattcttacatttggccccaggcaaccactgatctgcttcctgtcattatagagttttcttatttagagttttatataaatggaattacattttacacactctcttatgtctggcctattcactcagcataattattttaaattttatctacctacctgcatagtacctatattttgagataggatcttgctctgtcacccaagctggagtacagtagaacgatcatagctcactataacttggaactcctgggctcaagcaacttctcccatctcagcctcctgagtagctgggactgtaggcatgtgccaccttgctaggctaattaacatttttttttttggtagagactgggtgtagctgtgtttctcaggctggttttgaactcctagtgttaattgaggcctcagcctctcaaagtactgggattataggcatgaaccaccacgcctggccagcgtaattattctgaggttcattcatgttggcatgtatcaggaggctggtcatttttcttgctctgtggtattccactgttgaatgtactacagtgtgtttagccgttctgctggcgatggcttttgggttgtttccaatttggggctgctataagtgagctgctatgaacatttatgtacaaatctttgtgcagctatgttttcatctattttgagtaaatatctaggagtagaacttctgcatcttaaggaatatgtatttttaacccccttttactgatcaggaggaacttagagggttggaactgaccaaggtctcacagccagaaaggtgtcaagcatggaccaacatttgatactccttttctgtttcctcttcaggagtcattctattagaccagtgatttcacacttttagagcaccaagactctttttaaaataaaatactgtaggtccaggtgtgatggctcatgcctgtaatcttagcactttgggaggctgaggtaggagtattgcttgagctcaggacttggataccagtctggactacaaatcaagactccccacactacaaaaaaaaaaaaaaaaattagccgatgtggtggcatatgcctgtagtccctgttatctggggatgctgaggatcacttgagcccaggaggtgaaggctgcagtgagctataatcacaccgctgcactccagcctaggtgacagagtgagaccttatctctaaaaaataaaagataaaatattgcttagaatttctataaacaagctacacaaaagcactgtaaacaggctccttagaaagttcagtcacttttttgctgttatcctgttgtgcacccaagtgcttctcaaggaatgtcttttttgcaaagtgctgcagtccatttggctgcttcttgagaggagagtcgtggaccccctgaggcctagttcttaaacatctcttcttagtccccattgcattagttgtttcagaacaggtcattgagcatttcgcctttgcattttggtggttcagagagtaagaaactctttctccggctgaccaaaaaaccacctctccctacgcctcgtgtatagattgggctgtacaactggtgagaatagtaacatcaccatccctgttgctataaatcactgctggtgatatagctccttgatccaaagggtacttcgggggatgtagggccagataggtacattcaaactcagactatttacctttgtcacctggtaatatttacagatggagcagatgccagtatgttccattgccctattctggagtagtgattctcattttatgttatcagagcctagcttatgaaatttgaaatgcacttttgcctcctttgcactgttaccactgcatcagagcattttaatcagcttgctttcgttgaagtgtacaatttttcttctcattacgtctgcaagctctcaagtttacagacatgatctccttggctagactaatattacttggccattcttgcatgcaaatttaaaatttaatatcttgctgcaggtctgttgagttttatgcaaattccaatatagattatattttggagctgtaaattagaaattacatttgggggaagtaatatttgtgtgggtttaaaaaaagtaatcttgcagtttgtatggtacatggcatttcttctgaagaaacgggattttgagtattctgtgtgggtttagtagatgtcttgccaattgtgttactgataatgaaaatacaaaaacaatgccagtatgtacattaaatttttttccttaggagacaaagtctcactcttttgcccaggctgaaatgcaggagcacgatcatagctcactgcagccttgagctcctgggctcaagtgatcctcctgcctcaacttcttgagtggctgaaactacaggcgtgcctcgctaattaaaagaatttttttttttttaatttagagacacggtctccctatgttaccaaggctgatcttgaaatcctggcctcaagcaatcctcctgccctagcctcccaaagtactgggattatagggcatgaatcactgtgcctggcctacatcaacattttttatgacatttggctgctttttctaagttatttgggattaactgtgttctctcatttattaattcattgagtatatggttatggatgcttgataggctctcctcttggctttgatgatacagcaacaaacaaaacaggctctgtgctcatgaaacttaccttctacttgggagaaacagacttcaagcaaataaacaccaagtaaatatttggtatctctgatggtgatacattctgtggagggaaataattcagggtgtaggaataaaggtgtgctgagatggaggtgctagtcatcaggaaagacctctctaaggttacctttatgcaaagacttgaagagggaatggaatgagctgcgcaactcttcttaggagaacattagtctgggtggagacactgcaaggtacaagtgtcctaagtgggtgctcttgccgtgtttgaggagtagcaaggacgtcagcctgactagagcagagagggaggtagaaatagggcagaggaggggtagcagatgatggagaggtgtcacaggtcatataggaccttgtaggtactataaggactttggcctgtgctctgaatgaggtggggcactgtgggcgagggctgtattaggtaagaagactctgaccattgtgttgagaatggagtttgtggggggaaactcagatctttggatgatgggcatgggacaccatcatcagccattgcaggtgtggaccttggatgctgcctgcctaaggctggtgaccaaaaagaaggtagagttggatacaagagcctggcattgttggcatttttgtgtttgagtgtcggaaagatcgtggcagaagcctaagtatctgtgttgcttgggcctagcatctgtgttttcacaaatcccccaggtgatttgatgcctctttaaaacacagaatgttgggccctacccaaagggtttctgattcaggaggtttagggcagggcccaagaatttgcattatttacaaatgtcaaggcgatgccagccagtgctgctggtcagggaccacgctttgagaaccactgctctggtgaatgggtattgctgtgttgttatctgcaaagttacctttgtgtacttctgctttacaaaataggatgtagcttgaactctgagtcaaactgccatttactgtggtatgaccttggatatggcatatacagtgattcctcacacatggtgttaataagttcttagtaaatgctggctatttgaatatggtatgtaggtataaaatgatgtggtggaggtaaaatatgaataatttgctgaatataagctctggactgtggacattataaacaagatcttgttttgttttcagcatgacatgaaaggttcattagctttgttttacacatagggaagtggcttattcatgatcacgcaactagaagtagcaacggtagatttcaaattcagttctttctggcttcaaagcctgagatttgccaccaccgcatgagctgcttggagtactggattggctctcccacagtttttgtcattgtgtgtgtgtatgtgtgtgtgtgtatatgtatgtgtgtgacagacagagagaaggagaggggtgtgtgtgtgtgtgtgtgtgtgtgtgtgtgtatgagagagagagagaaagtgtgccagaaattatttgcgtacgttttaaaatctctgttaggccattttttaaatctgtaaaatgggcatgaagcatgcagagttcatagggtttctttgctgagtagaatatgggatggcttagcattgtattttttttccttttctaattaaaaaaatttcaaagccaaatcgaatctagatagaataaatttatggattttttctttagggttccttattagaatggattcttcctaatatgaaacttgagttattgaattttgtgtggagaggatgcttctcattagggtctcagtttgggaagaagagattatgttccctttaaaaacagcttactgtgtttgcaattttagatttcttatctcaggaagttcacatactgttaggataaaactttcctagataaggcatctgtacaaaggaatgaagtatatgggaaactgcgtgtgtggggagaccatatctttaatttttgaaagggctagggtagcctggtggtttggaaaaattaaaagtattgcataaaagtcaaatgtaatagcaattattgttagtgttgtaaacttccacttatccacaaatcagatgggtggcagtctctttatcttaagttctggttataaaattgaaaaagccattgattaacaaatagctgtcacaaagctggaactttcatagtaacagtttctggtgaagcttcccttgatccctgactcaatcagctaggtagagataaaagagaaattttgtattctgaagatgtacagacaattataaggaactctggttgactgcagggggaagagacacaatagctattaaaataaaagtatgacagttgggctaaacaggcagcctcaaacatcctaggagtccctgagggcaacactgtatgtagtgactcaggttcttagaggaaagtgggtcatcaacaagaagcatacaggcttgtttttggtatctttataagaatagagggaaataatgagtgtgtcagagagctcttgtcaagtttagtttcaataaaacaatttgcttaggggtaagtttatttgggaaaataaatcactgataacagcataaatactgtgttcctcagtgatgagattagatgagtagggaggtagtggggtgaggtagaaggagcatggacttggacacagatacttgattagaagcagaatcaccttagatatctctgcgccccagcttctctgtctataaattgggaataatacctgaagaggtcattgtcaggattgaatgagatgatgtaagcagtgcaccttgcccagggcttaataaatagtgatgagactggtagatttctctgtgagggggcttcaggatatacctcccttatacagacttctattcctttgagtccaccgccccccacaacatctttatgaactgtaatgtatctcatactgtacaagtcacccatttaaagtgtacacttcagtggcttttagatttacagagttgtgcaaccactaccacagtcagttttagaaaatgttcatctcctcgaaaagaaatctgtaccctttagttatcattactttattccctcatcctcttcctcatcagatgttgtaggcaccacctttcttcccttccttcccttatcttcttttcagctgtggactgtgctgatttgcctgttgctggatcatgtgattgaaattctttgaatttttctgtaaatagccaatttagctttttcccttccagagtatttgtttctttgggtgtggaagcagctgctgcagccagtgcaagggctcaccattttgcgctttgcggctgttcatatggcaactttattcaaaaccgctcctgcactgcttaagttatttgttttatacaaaaacagttctcgctggcttgcggcttctctgctgccatgttgacaaatgttgcttctagtgaaatacacaaaaataaataacagcaagggagaggggagcacagagctaagtgaattcattttgcctcttgagtgccattctcatttgttttaaaaaccaccctggcacagacagaaaaggagaaggcagagaaccgcaggaaaagaaaaggccacatttgattctttgaattgggctgtaggggctggctgaacagacaacttgagaagtatctggaatgtaggccctggggatgaggaaaagtttacaaggaatctgaataacctgcagatattcatattgcaacagcccccatttacatagtcttcagagttcatttggtatgttctcttgttttctcgttctgttgatgacgagactcaaatttaagcactgctggtgtagtagtacatgaccatggttggtttctgtcagtgtggtaggttgtgtattaggaactggaaaaaggcaaaagcgtaagggtgtgtgggttctcaagtttcgatttgaaggtctgacccacatgagaaggtggagggaatgctgacaaatattgattgcctttctgagccaagtatttccacaaatactatgttattagtattattattatattaagatatattagtattatactattatattagtatatattagtattattagtagtattatattagtatattagtattattatttgtatataacaaatactatgttagtagtagtagtagtagtagtagtagtagcagtagtagtagtagttttcagagagagggtctcccaggctggagtgcagtggtgagatcataactcactgtagcctcaaactcttgggcttaagtgatcctcctcacttagcctcccaagtagctagacccacaggcatgagccaccatactcagctaatttttagattttttgtaaagatctgggccttacaaagtgctgggtttataggcatgagccaccaggcctgacttcagaaacattgtttcattggttagcatgacaaaggttggtggtcttagcttcatttcacagactagggaggacagagttttgaggaattgtggtacttacttgccaaaggtcttactgaaattaggggagtggaatgaaatggaaaccccgtgcttccagacctagaacttgttccttttctatattagtagtaagccatcagaggtatggaagaagaaaaggagaagggcattggaaaataaggagggataacagcaagcagtagaggccaaaaacattttgtttagaaaaattgtacatcttctttgaaggtttttgttcattaaaaatcaccaggaaaacgaaagtgacttgcaagtccacaagaaactttgttttgggtgtgtgagttaagaatgatcacctgaccaattattattgactagaaaaacatttccctgagcctttcataaattatcttaatgtgcatattgttgaggcagtgtctgataaataacagcctaattggccacccagggtctgagaggtttgcttagccacaactagcctttcattctgggtctggcagattgatttctttccatttgttgcatgattttcaatgctatttatgacctaaatattctgttcaaaatattttttttttggtctattgctaatagtagatgcctctagggagaagaggagagaagcaagagtgaggtgacagggacttacttttccttatattctccttggtactttttgaattttgttccgtgtactattccatatgatggaaaggaggtaagtgtatttaggcaggtggaaggtaagaagggtagatgaaaggatgaattattgacctgaacttcaggcctttattcatcagtggtttagcctgtgggattgtttctcagcatataaacttcttcagttatgtagacatataatagttacttgttcgatttattgcatctgcaaaggtatggccaggtgtcatcatgaggaagtatagtagtatagtgtttaggcttaaaagattctgaaacctagacttcctgggttgtaatcctttctctaccacttagtggctgaacgtgaccttggatcttactttatctagcatttttgtgtctcggatagcttgtagttaaaatagtagttataacaaaacttgtggaattggaaggattacatatattacttaatccacatgaagttcttataatagtgcccaatacacagtactcactaaaagttaaatttttttttgatgactattatcacagatggtgatttgcctcatccatctctctgtcccttaatgtggtccaaaatccaccccccgccccacacccggccttaatgcccagacagtgcccctgtactgactaaggagcctttcttttgagttcactggtctggcactggctcctagaagtgctgttttccagtgacagcaggatatttggaccactgggagagtcagtgggctggggtgggcccttgctctctgcagaggtgttctttctcccagtgggaggaaacaccacttgtcagaacacagctttggcttgcccaggttcctgttgtgcagatggggcctagagtctctctgggccccttgtcatggatccaagccaaggctgtcgcttgctgagccaggaataatataggaattagtctttttcttctttatactaagcactaatcaatctacagttaactctgtatctaatttctgaaccagatgccgtgaataactgcccctgaatgtgtttttgccaataaaaggataagtttaaggcttttaatcaatgccgcttgcactcagtatttaaggtcagaatcttgtgtgcgacttattttgatcaggataattgttgggttaaaaaatgaacggtttttgaaattgtgacactcgcggttgactcgtgggtgaattaatctttgagaggatggaaaattgtcgagttcataagagttctcttgctctctagttgtctttcaggtcacttatggaaaaatatgacttttaggaggaaggcattctttttcaatgggaaaggagataagagactaatagaaatttctaaggagtcagtgatggaggctcaggggaaattggaaatgaagctgggtgttttggatctgcggtgagctgagggactggaacagcagctgtgtatgttctaggtaatattaacttgttgtaattttatgtctccagcatacctttttcaaaggaactcatgtttcctgaccaacgactgtgtactgtctagaatgaagcatagtgtttagaaacatctggggtttagatattggcttcactgaatggcctagggcaagtcactgagcctctgtgccctcagtttttataattataaaatgggatggtaatagctacctcgcagttggaaaacttaaatgtgatcatgtatgtgagaatgtgaagtgcagtgcctggcacacaagaggtgctgaaaggagcatctccttttacttctttgtggagtttgtttggctggtctgctggtctgtcatacatttgtctggtgtgcctctagatacacgtaatgtggaaatttccctaccttgtaacagtgagttggaaattgttcctgttgatctgtttttttttttcttttgtgcttagggaaaggcatgagaaaaatgagtcaggatgccctccatttctggagaagcttggtggtaattctgttccccagtggctcacaagcctgggcagttcagagaatatgagaattggtagatcatggagaactaggctctgcccctttggctatgcgggagttacttagtcttcctgaagtttcctgtccatgaaaaggggatgtgtgagggtgcaatatgggtaatgtttgtgaacaacctttgttagtgtcaggaaagtccaaaactatgtggtgtggtattttcatcatcttgagttgacaacagtgcttatccaaaagtcaattttggtattttgtcaaatgttaaaggctcaggaaataacttccaactcaaggaagatttgtatccactctggagctggaggagcttatattaagaatgtaagatacttgggctcccaggatttctggaagagctggcagtctccctgaggttcaggttctcagaccagcaggccatgcatgggggcttgtgattaagctggtgccgaacattgctgaattatataggtctttctgtgctacaggttggttttctgctgttcacatgtagtctaacagtggcctgttttcctttgcctcaactgtgacatcccctcgaagtgacctttatgaaggcagagcttggatctgccttgcttcttgctgcctactgtgtggttttgtgcagagtgctcctttccctcctctggtgtcttcacaggtgactcaactggaagaggaggttaaagaaggtcgggttaccaagcacctctcttcatgcctcagccaatccaggccccaacactgtgtgggaagaggtgttcatctgttgagaaggggtggggacaacatatgttacatacagaggctccaaggtggttttgatgagcatagagtatagtgggagaaggagcaaaggatggtttgggaggtaggaagtaaaagtttcagctagagctgactgtcaaaggccttttctgtctttagacttttactctgtaagatacagggatttgtatgtgaggcttttgactttaactctgttggaatagggatttgttgcaggctgttaagtagggaggatggtatgagagatgcattttcaggggtttcatttgctcatggcatggtagaagatgaagggtggatggtgagtagagtagaaataggaacacagaagactgctgcagtatttcagatggggattgtgtggggcctatttaggtcatctccagtgcaggtgcccaggagaagttacagtagatactgttgtacttgtaaaggaaaatgacattcgagttcctgttttgtgccaggaactttaagtaatctgcatatcttagctcatctcattctcaaaacagcaacaagcggaaggtgttatttctcaccgtttttcaaataaagaaacttaggtttagagcataagtaatttgtttgccatccctggacagctcctaaattgcagggttgaggttaatacctgattacatccaactccaagtcctttctgttcgcattacaccacactgtggccctcaggacacagcctcatgtagtgattttgcattagcaaataactttgtaaggactagtctgttaatagtgatctctttcaacattcccatgagatgagggagcacaattaattgttcagctgagggattagagatataaggaggttaagtgacttgacgaggtcacccatcaagtggtttggggcggacaggcagaggtgagtgaggcttggagctggccattttgagacagtggccttatcgagaacaagaattttccagcctcattttataaatccaggcttctagttctatagactagggaaactatcatggaaatggtatgcaaggcaagtgcctgaggctgagatggcacaaagcaccgtggtatcttggggttactttataatcaaactctctcttctagcatagtctttaattaaaacaacaatcatctccaccaaaaactaatcatctttattaagcatacagattggaggaagagtggggagtcttgtgtctgagaaagatctcaccaataaattgtttcctttgccataataattgtgttgctgagtttaataattagaattctcactctacgcttcctttttctgtttgattttacgggtctgacatcgctgttgtttttcctgggaatacttgaggtgtcacaaagagcaacattatgatgagagccatgggaaacacttgctaattacagtatattgtgcccctgttccttatctatcagtctctattggttattattactcatttaatttttatttttgagagatgaatgcacagggcagaataggtcctgagaatgaatctagagctttgcctttgacttggatggacactttgggcatgtacgggtcaagaaatagatgattgggtatcttgtggtaggagctagaggaactattaatacatttgggagtggggagtgaaggccatggactgaaaagatgccgaactacaaacctgaatgattttatagtttgctaatggttatccctggatgccatgcaccatcatgatttaactgagccttgcaaacagggacgatacttttcctaaccccctgccatctactgctttctcaccagaggtcacagggcaaagacaagtaacactggcattgtgcatgtgtgacaggtaactgtaggtagtaaagtggccacctgtaccattgcaaccctgtgtaatagtctagtgaagtgatctgctttctgcagtcaggatgccaaatacggtggagaaggaagtgacagtcatttacagtgtcatgtttagtcttttgcagatgtgcttacagttttaacaaaggcggagaagaaattatagggtgggaaagaaatgcctacagacaggctgctaaagcctaagaaggaggaaactagtatttgtgtgttttaggaatgctaagcccttgcttacatatcagcaagcaaaatattggcattcacttctgacttgaggaaggcatctctgaagtcaatagaaggaaatgcctaaacacaggcctcactcagaaagaaaggagagctgtggaaatactcaggattatctcataaaagctctttgtgtatttgaagcctctaatgaaatcagccttgttctccaggccagacaactccagttgttcttacctttctttattgtatcttttttttttcatttcttttatgcttttgtcatctcttgaaatttcttttctttgaataataccaataaaaattgaactttttgcctgaatgcagggatgacttgctagtaactaccagtttttatcagaaagcagagtgggatgctcagtgatgttgttgatggtgaggatgtccaaatcttctttttatatgctagctccattgtctgctgcatttacctgtttgtagcgttggtgcgtggaacattggggcatataaatgtttattgaattagtgaatgaagatatactgaattttttccttaaaaagtcagtatttgctttgggtcaataaagaaaccctttattttgctttttcttcataaacaccaaaatcctaggaaatattggttttactttgccacagcactctgcagcttgtacagacttttccagagatgaaaaattctttctcacttctgtattagtccttcgctttatcctctgattcctccttccttccttcccttttctgccttcctctcacccattcatgtattcattaattcagtaaatgcttcttcaacctctgctataagcactattttaagttctagggatattgttataagccaaataatgtctctgctttcatgaagcttatatttgggtggtgggtcaaggaacatgattgatcagaagaagttagatttccctgttgggacaaggctttcagagaagtaagtggttgtataggtagtagagataaaaggattgctccctgtgagggacttgctggcaggataggctgtgatttcactttattttctatttacataacaatctgaatcccaatatagtgtttaacctgatatgtaagattctgtttgggcagggttttgtcagttatcatttatatctcctttcttgaaattagatcagattcctttgatttatttggagagaaaaatgggcaatacacaatgtgtttctgctgaatattttgctatgatgttgacacagtaatgtacactttattttgattttagtgtgttttatttaaacattccattattcagaaattgttaccccctccttgttattactgtttgcctgcagttatttagaaagcagtttaattaatgttcttttaccgccccctgcttcagtatgagtttcaacacttttaatacaaagtgttcatatcactgtatgaacttactaaaacccaggacagtgatattcattcattcattgctttatccagcaaatgtgcaatacaaaaaaagatacatgcttcctctctacacatttcagtctaatatgaactgtttggttgaaatacagaaacataacatgcaattctctgggataaacgtttcactaaataaacagcagtgagaattctgaagatacacttaactaggtcagcctaggcttatcagagaaggcttcacagcataggcgatctttgatctggttcttgaagggtaaggatgtgttttccccccagggaccagttgagaaatagctagaattaattagttctgctgtaatcattgaggtgctgatcctagagtgtggcttccactgcagtactggatgtggggatgatgatctcattgcaaacacagcctgggtgggtgtttttggttttgttttaaggattctgaagcagcatatacacaaggttgacctcaggacctctttagttggttgctgctgctgttcacaatagatttagattggatagggcttcagttttcttactgttgcattccagcattttggatcagtcactttattacatcatttactttctggcttaggcttagttgttattaagtgaatcagggataaaccttaggctactctcctgcttcctttttcaaatgatccggagtaaataaaacaactacatctctttcgtcactgtgtttcgttcccatctcagaacgggtaaaatggccaatattttcagtgaaaatgtattgaaatgcatttcactgaaagaaatgttcacattcagtgaaatgtatctaaactctaaaaagagtctagaaaagctcattgacacatttgttacttgctgaaagccccagtgaattttccaacctccgtattgtccttaaaaattgccttttagttcttaaggtggtggaggtgtgtttttttcttcccccttaaaccctcttctgagcaatctttgcagagacacctggtgagagagtaggcccttctgctttgtgtgccctctagtaagagatgatcatcagcagctttatatcctaatgtagaaaatgtgctgtgctagatcatttcaacccagcaactcacctcttcatgcctaatgcctggagctagggccttgtttctctctacattagacaaaaaataaataaataaatgtgggtgaggataataataattatgatggcaggaacacttattgagtaagcaagtgtttgcttatttaatctacctgacaaccctaccagatgtaggtactgttattttctccatttggtggataagaaaactgagtcacagagagactcggtaatttgcccaaggtcagacagctgtctgcccggggaacctatacacttaattgctctgctgtactgtggttgagtatctcttatccgaattgcttgggaccagaagtggttcaggtttttgattttttttttccgagtttgaaacatctgtatctacataatgggatatcttggtggtgggacttaagtctaaacacaaaattcatttatgcctcatacacgtagctggaaggtaattttataaaatacctttaatgattttgtgtgtgaaacaaagttttgactgtgttttgactgcagctgctcatgtgagtccagtgtagaatttttcacttgtggtatcataaaagtttcagattttggagcatttcagacttcagattttcggattagggttgtgcaacctgtacttcatgagccaattgagaaaaatgccttcataatttctttctagggcctcaaacgcctggacgtcacccctgactattgcatgttgtgcattggacagttagatctcctcagtgcctgtgaacaagtgttcttttgagtgatactcttctttttgtgactgtattatataatatagctttcatagcccccactttatttgctgttattttattcccctctcatccccgcccccccccccccccccccatataaaggactcatttcaaagatgggcgaacctggaagctgaacctgactctactcttcatgtcttcaatttactggccataaaggttcagttttgtatgggatcttctgtcctctagaagatcccgtacaaatagaggctttaatttatgcttgcattcttgcattttgtgtgatttattgcctaataaatgaaagaaaaaagtttatttagatagtaaactgaaaatgaaaaaccatttttttccacgaacttgctaattttcttccattgtatagtatgaactcaatctacaaagatctggcaaaaaaaacaagtatcatgttctgtaacaaactcagttacactaacaccagaacttactgagtttaattggagataattaaaaaaaaaaagttctttttttctttttttttttttttttaaatagagatagggttttccatgttgacctggccgatctcaaactcctggcctcaagcgatcctcccatctcagcctcccaatgtgctaggattgcaggtgtgagtcatcgcacctggcctcttaatgtagatgattttttaaaatgaagatttttttcatagtaagaaaagggaaaccataattccagaccacagagaaggacttctttaatatatttaacctctttatttacagatcacttctttctagagagactaaaattagggcagagaaacctaaatcctacatacaaagagctgctgcccattcaaaataattacaagtgtgtcgggcgcggtggctcacgcctgtaatcctagcactttgggaggccaaggcagtggatcatgaggtcaggagtttgagaccagcctgaccaacatggtgaaaccccgtctctactaaaaatacaaaaattagctgggcgtggtggcacaagtctgtaatcccagctactcaggaggctgaggcaggagaatgcttgaacttgggaggtggaggttgcagtgagccgagatcgtgccactgcactccagcctgggcaagagagcaagactccgtctcaaaaaataataataataattataagtgacagtaaagcatctccccacataatcctgtatatcagtaagaaaatatgttttgagattcacaaaactcaatttacgaatctctggttgtagttatttgacttaatatataagacacttaccagaggagatggttgcaaacagatttgatgacaggtaaatttttctaaaggtctgctaacttcttattcagtcatggccaaccactgatacaatgctgagagttgctttctcctttcccctctactagcttggggtccacagaccaaaaaaatctataacttgcaaggctaataaatgcatgcttcagctgcctggaaatgctgttggactggcaatttgctgccccgctctaatagagactgcctcagatctggtctttaacctggattagctggataaagagaatcctctgggatcctgtgtgccatcacctgttagtgtgtttgctgtataaatgtaacatccactaactttgtcagatgatgtctggcctggctgctgtggctgtgattggaattgaaacatacagcttgttattaaggtagtgactggctgtgggggacaccgacgtctgttgtttttcattgttgatctagtgagttagaatgcctttcctgggctgttaatgttaaatagttcagtcctgttagtcgttttgtgagatcatctttctgtgtgatttgtgtgtatttccttgatctagtggggtgcagggtcagggactgaggggaaggtataattgtttacagaaaatgtgacaggacatggatttgaaatcagataggaagttaaggaatgccgggctcctctgaatattaaggaaaatctttaagcccctaattaacttcagaaaatccccttgctctcacagatgggaatttggctgggtaagctaataactggaatgaaggctaggagttgtgggttaagtttctccctggcaaataccaatatttcaggattacttcgactcttgtcctgctgcctcccactggatctttacaaactctgtgcagtagagattatcttgataaagattttggatgcatgttgggcctttattgaatgatgaatgctgttttttattcatttgcacatttattgggtacctactatatgtcagcctctgttcttggtcttgtatggtggtatacaagagaaacaaaattcttagccttatggaatttatatcctagtggactataaattacaatgttcactatttgagaggacccaagcttcagatgttgtggctgtttggcacactggtccgggttgaaagaagagactgggattcaagttgtagttcctgtcctgatttctctgggcctgagtttaactaccggtaacataatgacattgggctgtatctaattatttatagggttctttccagttctttcacttatgatcctgattttcccaaacattttagccaagttgtctttttttttttttttttttttttttttttttgagatggggtatcacccagtcacccaggttggagtgcaatggcactatctcggttcactgcagcctctgcctccctggctccagtgatccttccacctcagcctcccaggtagctgggaccacaggtatgtgccaccacgcctggctaatttttttgtgtttttgatagagatggggttttgccatgttgcccaagctggtctcaaacttctaagctcaagccatctgcccgcttcggcctcccaaagtgctgggatttcaggtgcgagccattatgcctaaacagcccagttgtctttaatctagttgggcttctggctaattcgtgttggtgaccaatgtttgcatattaaatcaaacaatcagttattgtactggagaagaaaataattgtttctaaaaagttcatatttcgactacatggtcatgccatttaaaaaaaagtagtaaagcaacaataaggaaatactcttttattctggaatgacatacctacctgaaatctttgagtttcccttgtgtcatgtgagctggttgattacaggtgaggagaattgcatgttcttacatgctcctcagaaacactcatcactgtgtaaaaaatgcttttttgtttgtgtgaaatcataatatagagcccattccaccatacaccttcatcatcaagctcggggatacaagcctgttaatcaagtgggaatacaggaagtgagacatgaaacactggttttattttcacacctctaaatgagtgactgcagaggatgaacttaaaaataataatgccacctcatacttgcatcacaccttttaataaggcggtttaaaaatatttagggtgaaccttcatcaggatgctttaattgcctcagcatagttgaatagtacattagggtaatgcctctgctgtgctgaaaagcctggagggagatactgtcactcaatgatgcgttgaggatgattaggtagaaccccttcagatcttgggatctcagtttcctctcaaatgcatgctgtgggtagagaagcctgggctggtgtgtgtataatttacatctgttataagtgactaaacttgtaagaacgggtacacaaggcatctttagtaagaagtaataatatctgccttagtaataatatcttctcattcttgtaggtccatttgaaatggctccatctctagtacatctttcctgactactcccacctggccatcatatcatctttctccattagatttcaggcagactagaccgagactgtgggtttttatcctgttagccacttagaggctgtttgatcttgggaagattacttgcttttctgtacaaagtatctttatttctgcatctgtaaagtgaagataagaatccctacttcatagggtgttagtgatatgagttagtaaacatgatgcccttagaacagtgcttggcatgtgctgctgtggttttgtcatcattattactccacttcttccttggtacatagctcatgttctccttaactatacggatgtatttagcgatctgccttaaattgtgatgtgttccttctggtctgagagcccttgtcacacataacatgataactttgacttggtaggtacctagtgagcatcttggattgagctcctacaggatttagttaagaattcaaagcagggtgtattctcattctgacttttaaagcctttgaggtcagttgggggcaggtcttatttgtttcttaactggtgaagctgccataccaaggccacttgcccatgatcgtctactgggtagcctgataagaaggtcagttactcaaggctgtggactcgattccattcttgctgatattactagcgtaaatgagatgcttttggataattctctgagcaatttaggccaggtgaatactggacagtaatttcctgaagtgccatgaagtggcaggaacatgatttatgtaacatgggctcttgctagctgggatgaacactggagcccctgccgtgctctggaattatgagtgcctgccagagtgcctgcctgcttttgttctagagagtttttttttttttctttttcctttaagttaaattctcaagttgcgggcaggggcgcaggtctctatggtgatgaatggagagatgttgaactggctggttgcaaaccttaccctagcagttcttagagacaactgggataaggacattttagctggttgacacttgggttgaaagtactgatgtaaaaaaaaaaagtgatgtgtgtatggggagggacatatacaaagaagtagtaccttggcattctagccagataaaggagatctgtgttttttaaggtaggagctttgagaaaaatgcaaaacttgtatatttcagcatgcagaaaattgcacttcactatcaggcaaacctcattcatattagcaagagaagtatatgagaagcatgtggttgtgggatgccattatcaggaagttgctgtgttcttgaccttgggctctggaagaacaattagccccttgcatgcaaacttgctcagtaaagaaaaagttttggccctaaggcctgtggaaccaggcttaggatggatgatgggtttattgtccttcacagccaaaacacaacagtctttctccctttctttccaggctacccacgtgagtacgttgataatatttctgagagttttaaagaattttccagcagaatgagagaagatagaaggaccatcttgataatttaaggacatgctcttatctcttgatctgctgcattttgtttttgcttctgtttaggccagtgttggtagttatattgtcttctctccactgggcggattacatgtagcaatccaaaattgtcaacataattattccacttcttctttggcacatagctcatgttctacttaactgtactaaattgtgatgggttccttctggtcaagagcccttatcacacctaacaggacacattggacatggtaggtacctagtgagcatcttggattgagttcctccagaatgttgttaagaattcaaagcgggtgtattctcattctgacttttaaagcctttgaggtcagatgggggcaggtctcatttgttttggattacatgtatgcaatccaaaagagttaggttttttaaaaaaattaattacccccaccccttttgttaaagagtcagggtctcactgtgttgcccaggttggtcttaaactcctggcctcaagtggtcctcctgccttgacctcccaaaatgttgggatcacaggcgtgagccactgcgttcagtctaatttttatttaaaatttaaaatttaaaatttgtggtatagtccgggcacggtggctcatgcctgtaatcctagcattttgggagtccgaagcgggaggattgcttgagctcaggagtttgagaccagcctgggcaacatggcaaaaccccatgtctacaaaaaatacaaagaaaaaaaattatctgggcatggtggcacgtgcctgtagtcccaggtactttcggggctgaggcaggaggatcgcttgagcccaggaggacaaggctgcagtgaggtgagatcatgccactgcattccagcctggctggcaaagtgagaccctgtctcaaaaaaagaattaaaatttgtggtacaatataaataacataaaatttaccatgtacagttcaacagtgttaactatatttacatcattgtgcaaccaatctccagaactctccgtcttgcaaaactgaaactgtctaccattaaataacaaccgcccattctctgttcttcttagcttcctggaaaccaccattctggtttttatctctatgaatttgattactctaagtatctcatataactggaatcatatagtgtttgtctttttgtgactagtttattttacttaacataccctcaaggttcattcatgttgtagtatgtatgtatcagtatgttcttcctttttaaggctaatattccattgtatgtgtataccacattttgcttattcattcattcctcagtctacatttgggttgcttccactcttggctgttacaaataatgctgccataaacatgggtgtgcaaatatgttcttgagaaccccctttaaattattttgaatatatacccaaagtggaattactggatcatatggtaattctatttttatttttttgagaaactaccgtactgttttccataagcagctagatttttaagaagtacatttaaattcatcgttttgggccttggtctccacgctgccttgagttgtccctaggtaagtgaagttctcagtcagtcacctgctctggcatacctctgagctttgacacacctcagccactttccatggctcactttggccctttgtaggttggtgcctctcattagattcaacgaacaatttctcaggatctgggcctaaccagtggtgttgaatcttagaaagactgagctgaaatgctcatcagctggtgccatgcttctcactttaggttatacctccagttgtgtttggataagagttggagtggcatgacagtctcccacagaatctgaaaatatagttccagatgtgcttctcccaaacttcttctctgccattggggttgcaccactggaaaagtgtgtgaagcaatacttcactctgacaccctgctactatatgcttgaggaagaactgaagactgtatcatggaatgagctgcccataggtcgcgcatgtgcgcacgtttgtacgtgtgtgtgttgagatgggagagggaatctagggatccttctatactccattgattatgctaacatggatcttatttaatattacaaggacatttctttgtcatcgtctttttttttttttgagacagagtcttgctctgtcacccaggctggagtgcagtggcgtgatcatggctcactgcagcctcgacctgctaggctcaagtgatcctcccacctcagcctctcaagtagggactataggcacacacaaccatgcctggctaatttttctattttttgtagggacaaggtttcaccatgttgcccaggctggactcaaactactgagctcaagtgatccacctgccttggccccatcaaagtgctaagattatagagacgtgagccaccagcctaaaaagacatttctaattagaaagtgtagtgtgaacttttgccgtagttggacttctctccatgtgggcccttaaacactgatatctcagtcatatgaagctatcaaggaccaaaataagggggcatttgccttttctgtcagtgcagaaccaataggggccaggccaggtatgaccaacccattgtatgtgcagtggcttgctccatctttctgtctctggtttatgtatgtgatcatttgcggattccagcaggtacatcctctccaataccttacctggtaagctgtctagtaaggtttatatttcagaccattgggggatccccctcttcatggcacacactgtgcctgttgcctaatattcctttattgtctgcagcatccaggaccaatttaaatgtcactttgtgaaacttcctcagaccctcctctagagcaagttagtcactgcctcttctgtgccttgctttgaggttattgtcatcactgaacctgacccagtgtattgtaattacttcagacggtctctcccaccagagtttatcctcctctgtgcaagtgctattttttagtcctatctgtctaccttagaaccttctgcagtatttggtgtattgttctgtctgtggcaattgtctggtaaatgttttatcagacaagtctctgatgcaatgggatggagtggaattaatagttttaatcatgaccatggcccgaaatagccgtttgacaacatccaagccactcactctctcagactctcacgctgggttgtgtaaattgaattctttcaaatgagcataagttaaaaaatacttagcacttaccatgtgctaggtactttgtaattaagcattttacttacataaactcatttaattttacaataacctagtggagtacatttcagtttcatagatagtgaaaaagacacacagaacggaggttacctgctcagttcaaaccctggagtgtagcctgtgagtgtatatttctttttgcatgtggttaataaattaatgttgtatttacagctttgcagagctgggatgcccttaacacatgcagctctggacctatataagctgtcaggtgtagaagagtgagcaggaaaaccttgtgggggtaactgattccttgtacaaaagaaccagatttcagttagtgatgaaaatggaggaagtgaagaatccaagtcgaatgatagaaaaggttatgtgtcgttgggcaagggttcaaaagacctagttgtcttgattagagaggaggggagctgagggaaaatgagtcacagaggaggaaataatgaagatgaagtggccagagaagacgggctcctgcaaggaggggcctgggttttagatagcctccaagaaggacaggaagtgtggcctgatgggattagctagtctcaagacaccaggtagaatgcaggccatctttgtagactgggccttggggtgtccaaaccatgaaatgcatggcagagtgtggacacacttgtttgtttatactctttctcccatcctgtacaatgaggcagaacatgaaggaaaaattaacaaacaccccaagtctcctgacacagggatcaaaacatattgatgatgtcttgcaaatctgataatttcattgaaccatgtgaagcttaaaattgatacataggcatacccttaacattaagtgctgctgtcagtctgacatagctggataaaccaatgttgaataatctattaaatatgtcagacttgaacaaagaacgtaaatcatattatattatttcagctgtaattaggtgggagataaaatcacaaatagatgagtttagtgaatatttcttagtgtgtacacagtgtcactggaatttctttccttgctctatgggaagaaagaaattgactgccttccaagtattgactgctgtccaggaagtgggaggttgaagggtgacttatgtaatgttcacagagtgggtttcatttataaattcaatgagattagctacaatcttcctgaagttaatggtgatggaaatgcaccattctgcatttagctggaaatagctagctatccaacttggagacttaattgttcctcagattatgatatgtttgcatttatatctccctcccctcctttcctgggagctggctgctgcctttattgtctagaaattaataatgcagaccagagcttgtgggtgaacagggcgatgtattgccagtcttttgatgttcctgtttcccaacccacggagtaaacttgattattgagaataaacaagggacataaactaaggtggaaaagataaagaaattgcattaggagggtccagtgaactgagctgtagctaagaaatggagataattctagtcattacttcacggggttgttgtgaagggtgaaatatatgttaaaccttcagaacagtgcctgccatgtagcaagtgtttcagtatatatcaggttgctttcattgttataagaaaactaattggcatttgtggtggatggtcagggtggtgtgaatgtgaaattcaagagcataaacatggttgtttcctcccagatggttggtatagtgaaacagacagttaagggtaaggaagtgtaggccctcattggggctacacatcacagcatgctattaatataagcagtgtatactggtcatcttttattgagaggctatggcttttttgtgtgtgtgctggtggtttttaaaatattagtttgattcatttcaggtgattttgttaatctagcaaaacatcttcttgcactttttacattataaatgaggaccatagaactttgtgtggacattgcagtcattcagcagacatttagcaaatgcgtataatgtgtgtgaatatttttttgtatgaaaggttttcgacacctgagactcactaccctcagccctgagttcacatgatgggtcggtggatttccagagaggcaggtggaggcgccgcagtgggagcatcctggctacctgagatgtgttttgaggtgccagcctcttggctccagctggagccaattggcctgttgggcatgagctacatggcatgtagagtgagctacatgacatgtagagtgagctacatggagttagaggtggttatcctacttcttctacatcacaactttgcagagcgcttcatataagacttttgtaaatttcggagatagtgtgctttatatagcaaggatttccagggacctactagaggacaacagaaggctgacatttccccctccaggccagtagcttgtctttcattactttgcataataactacttccgcttgctttttttcccccctcacctcagctgcacttaggaggacttaatgacatcatttaacgttaaggataaatataaaaccgatctgttcatgaacaccagtaaattgcacttaaaaaaaaatggtttcacataaggcagaacaggttgctacttaaaagagttaatggccagttggttttagagtagatcacaaaaagaaatgtgacttcacccgccaactccttagttaaagaaactgtgtgtttgcagtgttggagaaccatggaggaggattcagaactttaggcaggaagaactgtgaatgagtagccctgttattcccctggccactgtgcactcatggcttctgcacattactgtgtaaactcctttctcaccacctaaaacctaccaaagcacccagcgatcttcctgtatgtgaactcacaggtttttcttggataatttgcctttccattgacctactttcaagagcaattttccctatagctttagcaggtaactaaaaaggggagtggtgagaaagtaaatttggagttccaaagggaaattacttggctttgagctacttagtcaaaaacatgtattgcatgcaggtaggtcccaggcacagtgttgaacacgggggtacagaagtgaataaacattgcttctgctgtcaaggagttcacagtctagtgtggaagatctgtgtgcaagtagatggtttcagtgcagcgtggaaacctgcagcagtagaagtgacaaaaggtatgttggtagcacggaagatgcagtgctagttccgtgtggcaaagggtgaaggtgtcttagaggactccttggtcaagaagagtttggaggacaacagggagtttgcctagtagacaataaggcagattactggggcagaggaacagtggtctcttggggagattaggagctgggaatcaaatttcaagatcaggtttttttatttcggttcagtctcatacctgctgcctgtcatgtgaccttttttttttttttgagatagagtttttggtcttgttgcacaggctggagtgcaatggcgcgatctcggctcactgcaacctccacctcctgggttcaagcaattctcctgtctcagcctcccgagtagctgggattacaggcatgcaccaccacgcccaggtaatttttgtgtttttagtagagatggagtttctccatgttgatcaggctggtctcgaactcttgacctcaggtgatctgcctgcctcgccctcccaaagtgctgggagtataggcatgagccaccccacccggcccgtgacctgactttttttactgagaagaaacagaaatggggatccttatgtcttcattccttttgtttggcataggaagctggactgcatccaaaattgttaccttgtgcaatttctggataactgaagcttacacagcctgaagtgtacacaactggttaatgacagatccggttcaactcagaaattcacatttgtccagattcattcagttgccctataatcttaagtgttttttctgatgttggattcattccttctcttacttgttcaataaatgtttgccaagtatgttataaacaactgtgcagtctgatagaggtataaggtcctttctgtcagggaacttaaagtctttttgtttgtttgttttggagatagggtctcgctgtattgcccagactggagtgcagtggcacgaacattgcaaccttcatctctcagacttaagccatcctcccacttcagcctcctgagtgacttggactacaggcacataccaccatgcccagctaatttttaagtcttttttggagatggggcttccctgtgttgcccaggctggtctcaaactcttggtttcaagtgatcctcatgccttggcctcccaaagtgctgagattataggcatgagtcactgtacctggctggaatttaaggtcttaaagtggaaataactttgaaagtatagacttgtatcagattatgaggagccagactaagaagttaagacttaatgatttatacctctcagcccagagaggatgccagtgagtttctgaatttacagcctaaggcaaattctttttgatttctgtgttccttgactttatttattactgtaggataatgccttagtgtatttgaataagtttaaaaaatttatgcctaaaggtaggtttatgagctttgcattgtataaaagagtacggtatgtaagaatgaggactccaagagccaaacagccagcttttgaatcccagacctactatttatttatttgaattttttggaaggttagtgcgcagccgacctagtatttatgagctatgtgaccttgggaagttcatgtaaatgcagtgtctcttgccttacatggaaaatgtccatgaaaatcatacccacgtgaaagttattacaaggattaagtgaggctgggtgcggtagctcacacctataatcccagcactgtgggaggccaaggcaggcagatcactcaaggccgttcattcaagaccagcctggccaacgtggcgaaacacaatacatgtatctgcaaagctcaataaggcaaagcatagtaaaacagcttgcctgtgtctcatacacggtgctacaaaacctttaaactggaaatgccaagaggcacagaccaaaaaaaaaaaaaaaaaagctttaagaaaaacctttttccccaagcctttggcttggggaaagggtgggctacaacagaaaggctttttgacagtatcctccctattgctgccaaacacccagggaaaaaccacaccccatatcaccaacccctgccagtgcagctgggctgtgcagagttgatcttccacactggtccttggaagcaggcggtgcttcagttcctctgccaggtggtgtcaggagaacggagaagggtgctgatctttcattccccttgctgggcagaactagttagtactccatggcagagccaggagtatcagcggggtccagccttatgctgagcttccgtctctaccgtgtagcaaaaaaataatgtgagtcagctctcctccctggtggcagtggggctaaggggaatcccgtcgaacaccctaacttggaggaaataaaccagtgccagtcagtgcctcatattcagtggaaagttgtctgcagggccaagttgggaggcgaacttctacctcattgtctgcagcaggcaatgtgacccagtgccctgctttttccactctagtgatgatagcgccctggaggaagcagagtccacacccaccaccccatgctacatgtcaacaggggtactgcctgctaagcaaagatgtccagggctgggagcagtggctcaagcctataatcccagcactttgggaggccaggcaggaggattgcttgaggccagaagtttgagaccagcctgggcaacgtagacctccgtctcttaaaaaaaatttagctggcggtggtatgtgcctgtagtcccagctactcaggaggctgaggtaggaggatcgcttgaacccaggaaattggggctgctatgaaccatgattgtgccactgtactccagcctgggcaacagagtgagactgtctcaaaaataaaataagtaaatatcttttgatgtccgggatacagtcaaaaatctcaagaaccaggaagatcaccgcatgaatgcgaatagccagtaatggatacaagcactgagatgaatcggatgttggaattctgacaagaattttaaagcagacatcatgaaaatgcttcaataagcaagtatttatttattttaaacaacaaaaataggaaatctcagcaagaatttatgggcctaccatgagggaaatttttgaggtgatagaaatatatatcttggcattgtggcttatgcatttgtcagactcaacaaatagtgtacttagagcaggtacttttaattttctgagtaaagtatacttcagtaaagttgatttacaaatcagggattttcatccctgaagattctggttcagtaggtctaggatagagtccaataattttttttttaattaatgccccaggtggttcttgggaactcctgatatctccagaggaacctaggctagttgagaattcttcagaatattaatctgttagcaatctgtgtaaatagaaactaggtctggtaaattatgaattaaccagataactacttgcagaataaacagaatacataattagaaatcattaagtgtgttatcaccacatggaaataattttttgtattttttttattgggtagtgttgtgaagaatattacatggtatccttagaagctgtaaattgtgatgctgggttataaaaaaactgtattgtggtatgtttttgcctctctcacttaaccccacccttcactccattccttctcaggacacttatcttcttggtggctaatggcagggtggattccacatttgggaactgctgttgcctgggcagtcatggttttcatcagtgtgtcccagggcgtggtgctttctgtcaacatcctgctctccatagaggctgagaatgatccctgatgcagtcatcacggcttttaggcctctcccattggcctcactttaacctgatgactatcatatttccatctaggctgcatttttaaatcttgtcaaggaagcccagggactctcctcactgataagccatttccaatccaggcctggggttgagtcaggtcaccttatgttcttactctttcccttgacttagattggtctggctggtccacccagataaagtgtagcagtgtctgaagctggatgtgaggggtcgggaagttgttgatggggatgccttcattccgcagcacacatttcaaggcaagcagatcattttcctatagcagtactggtcagagctggattcaggggaaggctgtctgtgtttcccacgtgggccgggtgagctgctagcatttctgtcagtgctagaaggaaagtcattctttcaatgtggtcccagattcaaaatcagttttgagtgggtgtcagaatgtcattcctgatagcttctctgttttgacagtgcaaataccccggtctcatttctctgcttttaaataatagatccttgagattggccctgggtaggagacctcccccaccccacttctttctctgagttcaccatgggattctcctaatctagccagagctggatttgatccttgggtcactcctgtggtctctagccctcctcagtgcttacttagttggtctttgtttctattggttgtttttgcatgtgtcgtggttatcgtcatcatatgactaatgtcagggggtcaggcacagttatagcttctaattgtgttgcgcttttggcaagggaactatgtgtgggggaaaaatacttattaggaatcgtcagcctgcattaaagggtcgtaatacttgaacaatttgcacatgatatctatctctacatcctatatggactgtgctttctaggagggattagttaggtttttcctttcctagtatagaaccaggactagtaggggaaggcatagaggaaaatactatggttctgtttcagagagagcattcttgcaggggtttcccaaatgtaaatttttttgttttttagagatagtgtctcagtctgatactcaggttagagtacagtggtttgattacagctcactgcaaccttgaactcctgggctccggtgagcccctcgcctcagcttcccaagttagtgagactacaggtgcacgccaccacacccagctaattaaataaaaatattttgtagaaatggggtcttgctatgtttcccaggctggtcttgaactcctggcctcaagtagtccttctgcctcagcctcccaaagtgctgggattacaggcatgacccaccatgcctagtcaaaaatgtaaatattaggtcttatgttactgaaggtattccaggaatgtttggatgtggtacagaagatgtgggtattgggaaacctctaagaatatttccaaattttatcttctgttgttctttaaaaaaaatataagctgtgaatacaaccgtggaaccacaagtaatataagaggagctgatttcttggtgcctgcactgctgactaaagatccagtctggttgcttattcagtaaacctttgagttagtgcagggagtcactctctgttttctcagggagcccttatttgagtaactgtcattacctctttccctaacccactacctttaattgtccttctgtggttagaaaaacttagtgtttgaaaggcatagtatctcaagggaactttagaagtatatcttacctttgctcttgggcatttccagatgaccctggcagtgtggccacaagcaaactggagaaggctgccagtatgtgcacgttttaataaatggaggatatctagcacctcctaacccttaccttctcctccatctcatcccattttctgattgaacagtcacgttatttctagtcttaaatacttagcttttctagttgtgttaatggaattgttgtatgtatttcagttgtattacttaagtgtcttctaaaagacatttgtatactttataattcagagaaaattctttggttgattgaagatcttgctaccaggtcctggtggaagcagctagaatttcttaagcagttcctgtgaatgtttcctttttatgtagatcatttcttggaaagctgtgttttaaaataaagctctacaggcactactgttttactctaaggcctttgagctctgatatctaagacatatttatttcttcaactatgcccaggacagtgctttgcattcaataggtgaccagtaagtgttgagttttgttgaatataaaattatttacaaatgattttttgttttttccctttaaaaattaggcttccgagaaaactttgggcttcagagtccctgcttccaagcccctctttgtaacactctatgaaatgaaaagcatctttggatggtatggggagagctgaacaatgtgaggtgggagggcgttggcctttaatcaggtttctggggacagatcactcatgctggttcatgctggcccaaggctgtcttctttcttgtttgtggatgtgggttatgttcctatactgagatgtgctggatgaaaagctaataaatattaatgaagcagttacttctgtcaggcacagtattggctagagagataggtagaaataaatagaaaatacagttcttgactttgagaaccttattgtgtaattggaaaggtaaaatgtaaatgccttaaaagttaattaacagtaattcttaaggatccttagattgtctaatacagtggttctcaaacattagtgtccctcagaatctcatggagagttattaaaatacaaatcacagggccttatccccatatatatatatatatatatttttttttttttttactcatttggtctgtgtcatgagaatttgcatttctcagttaccagatattgctggtccatagaccacacttggagaactactggtgtggtgcagttattctcaaccttggctgtatgttagaatcacccagggagtttaaaaaaaaacccatgccaagaccccacccactgtagaccacttaaatcagaatctcagtggggtaggacctaagcatttttttaaagctccccagatagttgtaatgtgcagtaaggtttgggacttactgctctaacgtgtcagggccacagaactttggattcagagatatgatgttaccatgggctgcagcagtgtggacagaccagaggagttagcctgatcttaaagaatgataaataaagaaaaaggaatgatttttgttcttgtaaagttaatgctgggaacaagccagttggttttctagctgtttcttgggacagactgatgagtttgtgagctcttaggagtcagcatgatttcccattcagcgtgagctaatgagtgggactgaggtgtgggtcaccaccatcaataataagcattcactgaccacattctctttttcctgatatagatgagcttgtgtttatcctaacaagcttagatgtgtgtgtgtttggggtggggtgtggttgtggactgtgcaatagtgagaggctgaactttgaaaaatgactttgccatttttacatttcatctctttaagcctctgtttattcatgtataaaagaaagtactacacatagttgtgagcctttttttttttaaaaaaaaaaaaaaaaaaaaaaaaagagtctgggtcttgctatgttgccaaggctggtcttgaacttcttgggctcaagtgatccgtctctgcctcccaaagtgctgggattacaggtgtgagccaccgtgcctgtttgttagtatgtgtgtgaatactactacaattttaggaacactgttttatttatttagggacccccagaatctatcagtgagcctgacacatagtgtctgtgcagtgaatccagattggttgaatgaattggaaaggttatcttttcacattgactgcccaggcattagaaaggatgggaagagcttgtttcctgatctttacaaaaaatgctgccaccttgggttttccaacttaggcaagaaatctgttatgttcaaaataaaggagtataacttaaaaaatatatagatagaagccaggcgcagtggctcacacctgtaatcccagcactttggaaggccgaggaaggcagatcatgaggtcaggagttcgagaccagcctgaccaatgtggtgaaaccttgtctcaactaaaaatacaaaaatatagctgggcttggtggcacatgcctataatcccagctactcaggaggctgaggcaggagaatcacttgaactcgggaggcggaggttgcagtgagcccgagattgctccactgcactccagcctgggtgacagaacgagactccatctcaaaaaaaaaaaaaaaaattaaaaaaaaatatatatatggaaatacattttctcagtgtgtatactagtcatagctacctgtgacttattctttattttgtgtatttttttcagacagggtgttgctctgtcacccaggctggagtacagtggtgcaattagagctcactgcagcctggacctcctgggctcaagcagtcctttcacttcagcctctgcagcagctgagactacaggtgtatgccaccatgcccaactaaaattttccatcttttctagagatgggggtctttctatgttgaccagtgttcttgaactcctggcctcaagtgatcctcccactttggcctccccaaatactgggattacagatgtgagccaccacagctggccttacctgtgatctaaagaggtattttcaattgatgtttggccatatcagattttagttgctattaaattttattcttaatttatcaagtttaattgattattaaaaaattgcactctaagaataagcctgtgttttatttcttggaactactagagccttcgttacaatacattttagagggctccaaagttataaaataaatactggagatttggtgcttgttaaaattttgaccttttctattaaagcccattggagtgatgtacagagaaaaggctgtcttgtgttgtgatagggccatgctccatccacaggtcctgggaaggatgatgtaactgtggtctaacagcattgtctgaatttttggcctagggcaaagaggaggagggcgggtaaagaaacctgatcagaccatttgatgctaatttcacaggtgactggtcactgtgtgcctggctgttgttatttatagagctgtaagtggctggagctacacacaggaacctgaaaggatggtctgtattagagtgtggtggtagatagaagcacagcagtagaatctagggacaaatggtcactggtgagtgtcattgctggagttaaatgagactcattagtggctgttatgatttccactcttacttcattgctattcctgagtctttttgaaagcaaacaacaaaatagaccgaaacaacctctgatagactctccgttatttttaattgaggttgataggattttaatcaggtcaacttgcatactgatttcaaccaccatttaaagagctatccacaaagctataaattagaattatagttcaaaaggtctgactgttttaacctactgctcctattccccaaattattgatggggaaactgagatctagcagggttaaaaaaccagcccagtttcacagttagcagtgatgctggagctgtgatctggatcttaaatctctcagtttagccttttctgttttctaccgtattagtcctacaatgaaaatgcacttctctgtctttaaatttcagacgttgtctccatggcctagatgaaggttatcctttgttatgatattttctcagaattactttgaaaaatggttccattgttatttcttaaaatgaaagtaatatgaaaacaaattccttctattgataatacatttgcccactactgatagttttaggaataatgagaaaagagggggccaatttatggtattggccaagaaggagcgctcagcagcactggactgctatgtgtgggctggaggtaccagcagataacactcggaggcagtgggtcctgtgaatcacagcttggcctcggcataagctctggagaccagctctcctaaggagaactgccttctttggccctgccctcagcagcctgttggcagaggactagaataattgtttgtttaaaagttttactagctaattatactgcaccgaattgacaggcatctctattagagtctttccagtctcttgaaggctcttctccacattacttgtaatcttgcctcagtgtagactgcagtggctgatttttgtttgtttgttcttctctcctttcccttcccacttgttgcaaaggccacacaccaagtctggagagagagctgcctgtgggctgggaattggctgccttcatctggtcagccatatgtggctactggaaaaagtgcctttgggtcattcattctcaggtcaccaggccctagagtaaagccctaaacatgggctctctagcagaaagacttattaattccccttctcttaagtggaggcaaggaggtgtttctgaaccttcagaataacccgagggaacttgaaagtacagattcccggatgctatctcctggatgtgggttcaggttcagtaggtctgaaatgggaccaggttttagaatcttcttcgcggcccggctcacacctgtaattgcagcagtttgggaggctgaggtgggcagatagcttgagttcaggagtttgataccagcctgggcagcatagtgagaccttgtctctactaaaaagagagatcagctgggcgtggtggtgtgtgcctgttgtcccagctacttgggaggctgaggtggcaggatcacttgagcctgggagatcgaggctggagtgagctgtgatggtattactgcaggtggggtgacagagtgagaccccatctctctctcttgttttttttttttttgtttctttttaaaagaaccttcattacattaattgacttccaaggtctcatccagtcatgatggtttttgcatggtccctaccagtagaagatggatttcagaccacagggaatttatttgtagctacagtcaattttcaaattatttgccttacaaatgttttcaatcccagagacctttttcccagctggttcctgggttatattgccaaagtccctggttggtatgcactcgagaactgaaagataattttcttcttgattttaagaaaagataattaaggagggaaatctaccattaaaaaaaaaatcagacattacaaccaagtataacttttagagcagatcctctattgggaaggagcaatatgttatgttaccttgtatttgagcagttaattagggtcagatgtagttagttctcatgctttggccttgcaaaagtaatcccctttttggaaaggctttgttgagtccctaggaattattttaatggtctctaagtatgtttaactcagtcataatattctagttgtttggatttgttgtgtattgacattgacttagatattctcccctgctctgggctttacctcttactcgtacccaaatccatggtccacatgctgtggtgtcccctgggcatgcccagccttgccatgtgtgcaaggtaatccctttgaccctctcaagagggtgctgctcatcttttttttttttttttttttttttggcttcacttatcccacttgacattgccaaacgtgctttgacttgaagcaccgctgctcctgtggctgtctcctttgcttctcctcttcggctcattgagaatctgtttgagatacttgtcatcctttggagattagaactcactttagagggaggaatgattttacactgggactgttaggatcagtttaggaggaaacaggcccacgatgattttaggaggggtttctactgtggtccttgtaaccacatagtttgtactgagctggacactggccatttgagtagatgcttgttctccagttatagaatggttcccagctggcagatttcccactgggattcagtttccttggccgctgctgtttgttgtgctcacactgatttttgcggcatctttccaggcccttgagtcttttccaagcagaagaaatagcagaatgccttgccctccccttctcttctccttttgggtattccatggctattagggaaggacttcctgtgaaataaaatgagggcaaaggaaagtagcatgcctgtggcataaaaatgctgttagcaagcttgaggcatatcagagagattggtcctaagagtaacatttactgcctttctgcttttgaacttttctttcccccttcctttgcctgtttctgaggtctgggatttatccagaatttaagaacggactgtttttgatcatttgaataggtatcatcattcagcagggaatacatgtgcagactgagatgtctcttaaagccaatttatagtataagtcatttgaaatgatttcttgagtcagtaatgcatttctgcttcaaattctctgcctggatttgtgcattcatctcccattttaccaggtgatttgctttattatgctgctatgacagcccccctccccaaccttcaactgctatccccagatacgtgggcatgcttttcagggtgagtagccattaaactacccaaaatgacaccgaacgttgtctacacaggcttggaaacatggagggcctggattccagtaaaattctccaggctgcttcgtcaggctattgcagaaaagattacagggtcctttaagattagttttggagagatctaggcagatggatgggtgaagtcccaatgggaagtcagtacccagttgccacttggaataatctaaaatcctggcatgatctttcctctcataacttgaagtactcagctagaggagagcctctccttcgcaagacccagctatctctttgagaagaaaagggggtttggatggagtccaaccttctggtttgttttgcccgtctgccatttgccttttccttgttggtgtttgctgctgtttgttctttggagtctgaggggcttctgaccttggctgaagggcttctaaccctggacaggtcccgaaggagtggcatcagatagttgtgttttaatttcacaaatctgttatttctttaagaggaaatgagcaactggtagacccagaacagtaccaaggggagctggggagttgttatttgtaagtgtagagaaagaaaggaacagttacagggaggtttggtgcatgatacacagctgatgccttcagagaataggaggttttctttctgtgctttttctcataacattggaggaagaagaaagaggaggcatgtggcttgttggtggttgaactccagtgcagaagttaacattccactcatttagctcactaatttattaattaatttcacaaatacctattgtgctactatgtgccaggcacccttctaggtactgggtttacagtggtaaacaaaaaaaggtccttgctgtcgtgaaccttatactctagccaagggggtggtggtgatgaggacatatttataatggtggtggtgatagtgataaatactatgaaaggaaaaaaaaacaagaaagggaagagaatgggatagggagctattttagtaagtgtgttcatggaaggccttataaatgactatacaatacataaataatcattaaaatgagattttattacctaaaatattttgaacacttcagttgttcaaattattatggaatgctagcatgcatagggactgaaaatatttttttctctgaagttttgagggttttccaaggatttagcttctctttgtttctctggatattcagactcacatagctagattagagttcaccatcacagttgctttcagcattgattgagacagtcttatgttgtaagggtctgctttttacaaaattgctataaaattgttctgtgtgattgagaggctccctctcactcaaagtagatgtttggctgtttttgttgttctgttttaaacagtaatgagtaccttttggtaattaaagtccccttcacaaaactgtagtgagtgatgaataagacataaacaaagaatcccttctgcggagcagagtgccaatggccatagacataactcaggggctgtttgaccacataactcagtgcagtggcttttcaccattggaagggtggaatggtctggtatggttttctggattgctctgataaacaggagttatatttgctgtcagtttctatgaaaggacagcattatatgagccatggtttgtcaggggcctactgtgtgctgggctctttgctataggatcaaatgctaactacatctattccacaagacaccctatcacagtgattggtttttttgttgttgtttgtttttgagatgaaattttactcttgttgcccaggctggagtgcaatggcgcaatctcggcttactgcaacccttgtctcccaggttcaaacgattctcctgcttcagcctcccaagtagctgggattacaggtgcccgccaccacgcccagctaattttttttatttttagtagaaacggggtttcatcatgttggccaggctggtctcaaactcctgacctcagggtgagaggtgaagccagctggacttcctgggttgagtggggacttgcaaaacttttctgtctagctagaggattgcaaatgcaccaatcagtgctctgtgtctggctaaaggattgtaaatgcaccaatcagcactctgtagaaatgcagcaatcagcactctgtgtctagctaaaggattgtaaatgcaccaatcagcactctgttaaaatgcaccaatcagcgctctgcgtctagctaaaggattgtaaatgcaccagtcagcactctgtaaaaacgcaccagtcagcgctctgtgtctagctaaaggattgtaaacgcaccagtcagcactctgtaaaatggaccaatagcactgtgtaaaatggaccaatcagtaggacattggtggggaaaaataagggaataaaagctggccaccccagccagcagtggcaacccgcttgggtcctcttccatgctgtggaagctttgttctttcactctaaatcttgctgctactcactctttgggtccgtgccacctttaagagctgtaacactcaccacgaaggtctgtggcttcattcttgaagtcagcgagatcaagaacccaccagaaggaactaactctgaacacaaggtgatccacccgcctcggcctcccaaagtgctgggattacaggcctgagccaccgtgcctgacctgtcacaatgattttttaaactgcatatcttaatccattagtgggtgacagtcagaattttattttattcagtttaaaaaatagaatcaaatagatgacatcagagtatactacacttagtgtgtgtattgtttcaaaaaaacttgttttaagtgtatgtgcatgcaggcagacatcagaaatttttatgtgtcatgctctaaaaagtttgaaaacaagcctatcagttgaggtttggtatcatttataggcaagtaaactgaaactctgaggttaaggacgttgcctactatcagaactaaaatttgaactcagctctttctggctttcagcatttgatccaattatgtttctcacagagctttccctctctaatggttttccaagactcttgagatcacagagacactgatttgctcctgacgttgttctaaaatcagaggaggaacatgcactctgatgaccagacccaagtttgactggtttctcaaaacatctttacataacatagtctatttcaggagaagggaaaagaaagatgactctagaacttgtctttattaagaaacaaggaaaatctagacactctttttctgtcatagaaagatagcctagttttaccagagaggagaaattctaaccagaagtagtatcaggatctttctctctaaagcacttaaagtcttttgttggcgagacgagtagagcaagaggaatctgccaccttgtgtaaaacattttggttttactagtcaggcatatttttgaataaccttcactagcatttattatagtagttattttattttattttgacacagagtctcactctgttgcctaggctggagtgcagtggcatgatctctgctcactgcaacctccacctcctgggttcaagtgattctcctgcctcagctgtaatcccaagaagctgggattacaggcgtgccaccatacccagctaatttttgaagcctctattttagtttcccccaactttactagagatggggtttcaccatgttggccagggctggtctcgaactcctgacttcaggtgatccgcccaccttggcctcccaaagtgctgggcttacaggcgttgagccactgcgcctagctgttacaacattttggcaccagttttacctacttccccagcctcctaggaatgaagtggaacttttattaaggacagatttttcagaggggcattattctcactggcattccttccctcttgcctggaatcacccttgaatgaattcctgattggttcagctagactttttcttttacagaagaaattgctcttggtgaagatgccagaaaaatatcgtaaaaacctgctctcttatcctcttctctgtactactttgttaccccaccccaccccacctcaagcccccagtaaaaaatgaccttttggcccagggccctatctgagtatattgtgtggcagagttgtctctggctgactcccaggattgttaatgacttccttctctgtccctaaataattgcttgaaaagacagctgtggagagacattgcccccagcttgcaggctcattaattcagccctatgaaagagggtgcaaaggaagaaggtggaagttactttgccaagagtagcaggcttgggggaaactaaaatagaggcttcaggggaagggcagcagcatggtgtcagagattacacttggagtttgtgaagtctgggcaggcttcaatctaaagaaactttatgcacaaaagcccaaatccagggaaataaatgaaagtgattattcacttttctaaagtccttacagtagcgttcctctggtattgtttgaatacagtttaacctgaagggcacttggtttttgtgcagctcttcaagaacagaagcatctaagtaagtagaaagtctgagaaattaacagagaagattccctaaaagtcagccttcattacttgaccattattcataattctgcatttgtctattcctccagtggccttgaagcaaaattaaaaaaaaaaaaagacacttctatgccccttaaaaaaagaataatcaaaacttgcatagacagaataagaatcaaatacactggggaacaaatactctgattagctgtccggttcagctctgacgcgtctagcactctgagttataagggaaacgataggacacttggtttttgttttccaacaacaggaaacatatcaggtttctaagaagatgtaaagtctttcttaaaacccaattatagaaggaatttatgcaagtctttaggcaaggagtattaaagaaattaatgtttaatgccatcaacaagttttcaagcagatgcagaactcctagtgtgggtgactttttggtgtttaccttatatcaagaatgcagcatttaaggccactttgacagagtgcagctaagctttttgggtttgcttgtgtggacaatttccattcagcaatggctctcaaacttcaatgcacatcagaattacgtgggggcacttaaaaaaaatgtatgcccaggctgcatccagaccaattcagtcagaatctctgatggtgagccccaagtatcaatattttgtaaaactgattccaaaggttagctaagtgtgaatcagtgcgttagatgatctttaacgttaattatcttagctggatttctcaaaggggtagtcctagaatgctgatattccctgttattaatttaagtaagtccctgttgtttctgttaacattctcttagaactctgagacttgtatttctgctgggacccagggctactgcacctttcttggcctataggagtgttgtcagaaccaaagtacttgttaagcagcagcttaggatcaacattagcagacctcattgtggctgttggagaatatagaacatcagatgaagtaggggcttgacgtttccacagccctaaatcacatatttcagagtacgttaagattccttttggaactcagatctttttctggccatggatagactgttgtcttggggggatgccagttgtctctccagtgagaaaaggagatgtttatgtattctctagttcccttctggaagttaaaaatacctgtcattgttagatttggtttctgaactctctgcccctaacaaagctgaaatgatgacagtgagtgaagtatttgcttaaataaatatcttttttttcaactttgaagaactaaatatatctcaacgtgttgaaacatcagagaattggctgggcccagtggatcacacctgtaatcccagcactttgggagtctgagctgggaagattgcttgagctcaggagtttaagactagcctgggcaaaatagtgagacctcgtctctactaaaaataaaaaataaaaaaaaaaatggctgaatgtggtggcacgtgcctgtagtttcagctatttgggaggctgaggtgggaggatcacttgagccctggaggtcaatgctgcagtcagctttgattgtaccactgcactccagcctaggtgacagagtcagactctgtctcaaaaaagaaacatcagagaatcattgattttatgtaatctagattttatcccattccaaattgtgcttctgtgaatacacattatggaggataacggaaagggtgtttagggaaggggatgacaatgggaggagagggagaaaagggtggtgggagaggtaatataaatgataattaccatgacttgaatcttggtaaaatcgtataataggaaccatgtggtactggtgttctgattaaaaaccacttcctggctttgtgaccttgagtaagctataactctatttttcagttttctcacctgaaaaattataatgatacctgcctgttaggattgttttgaagattgagattgttcgtaaaatacttagaaaagtgccttggcacatagcaagtactatttaagtgtttatcagagcatagtctcaacttgtcccattaagaatattataaaactgtaaggtccagatgatgctttattctgtaaaggccattaatggagatgcttgaacatctctaaattacctttccctttgcttgctcaggaagtttgctaatctaaattcttcatgctgtgctgctgagtgtcatgtgtgattgcttgtgcaaggagacccaactgggttctatccgcacttaactgaaactcaagttattccctctctagccttaattcctgtcttctaactctccaatcgatttcttggctccactaattgaaacctaccccagttttctcatgctgttgagcagggatcttcttgagactgattatgatgggagaatgacctcatagtttctgatgccatcttccaatttatgtaactcagccccaagcatgctttttaaaaataatggccctaaattgctgacatcttgtcatctgctcagactcctaaatctttttgtgttccctcgactgaatgggattcactggagcaagatgcctttgtgcagtctgcatttagtgcacttggcgagtgacctccaatagagctgtgtgttcccttcgagcaacatgggtaatgattacagcgacaatgctgctattgtgtccagaggtttggggctgtaatttcataatgaaattgaaaaacatgagattaaaaacctgaatatagcacagtaattatatttaagtatcacaaatcatctccctgtatttagttaggtgtttgagatttggcctctttgtggagtgcagtcacgtcgtttcatacatctgcaaaatggaaggcttctaatttatggctaaaatgtgggaattgctttctcttaatgggaaggtgaggagaatggtattgaatttgaaggagctggtttgcttcattgactagagtcaagaagggaggttgtacaatagctgcttaaggtaaagaaatgtttgggtcttttcatggtttaattcccagatacttacacatgactatagtctctccctttagaaattaactgacataggctggcctgggaaattctacagtcctgcagcaaatggtgcagttgcagaagtgtgaatctttacctaaggcagggtttctggtatagataaagacttaactggggtttgtttcccacaggtaagttatggatgagctgtgcctggcccatttccatttactgtctgagaatctgcatgtggcctgcaggctctgtagttgggctgagtcctcctggagtaggaggctggggaaggtgttggtggtggctgtcgataggcattcctgcaggatggtgggtggagagttagggtgaggggtgttctttaataaaggaatagaaattagagtggaaagtggtttaaagctagtgatacctccttctccttgatttctaggaactatcaagtatgaaatgaacatagaaggaagttatgaaaggaatcattattattgtcagtgattcttgattatctactataggcaaacacgttaagttgttgttttttttttgttttgtttttttttaagacggagtctcgctctgtcgcccaggctggagcgcagtggcgcaatctctgctcactgcaagctccgcctcccgggttcatgccattctcctgcctcagcctcccgagtagctgggactacaggcgcccaccatcacgcccaactaattttttgtatttttagtagagacggggtttcaccatgttagccaggatggtctcgatctcctgacctcgtgatccacccgcctcagcttcccaaagtgctgggattacaggtgtgagccaccatgcctggccaacactttcagttttggttaccatctttaaacttcacagtagacattgatacagaggtatactttctctgtgcacatatactgcctctcaccccaaataatttttgatacagcagtgcagagtgtccctttttttccaaagctttcctcccagattcttagtgaatctacgagactgagtatctgaattgcctaaggccttttatcacaaaggccttaggcaaatgtatgcaagtgtacatacattaccaggcttcatcaacatgccctactcagagacatttcggttcattaggtaggggtgggagaggttgtggcctaggaatctgcatttcaacaagcaccaggaatttttatatacaataaattctgagaatcattgccttaggaccttctttctcaggggccgggctattccagtgggtgtgttatgttgagatttgctttgtggagatgtgaacttgctgttcagtcccttttcctagcccctggcttcagtatatctttcacaaaaatacctacttttattctgtttccactggatacaaggagggctgggctttttgctgctttacccactattacagatagcaggttgggagacagtttgagtcctgtgtttgcactccaggcctactagggaagaggtggcctgcctccagcagtaaactggtaactatctaagacctatggtgctctctgtttccactggaaactcattgaaaatgctaccactattcatgtttttgacctctcagagcaaagtatataaaagcagcagttcaagtaaattcgtcaaacatttattgagtggtggctgaggctaaagtattattttaaggggcctgggacagataagtaaaacacagtttccattctccatctatcctgtctttctttctaatgatgtagacagtcctgacacagaactatggcagacttagtgtaacctgtgacatgatcgtgtctttgaacaagtgaaattaaagtgctataggaatgtctgggtgggaacagttagtttaggttaggcaaaaggcttcttaggggaagtggctttgggcagggtgtagggcagaggctctcaccttggctgtgctttacaatcacctgagagaattttgaaaaaccccaatatttagaccaaaccctataacaatcagatcagaacttctggaatttggacagagacagcattttttaaatgtttaaacatttaaaaacattaaattttttaaatgtttaaacatttttaaagcttcctacatgattttaatgtgcagccaagactgagagccactgacaaagaaggataaataggctgtcattcagatgggggatagtcagagaaggaaaggtattccaagcttgagagaataacataagcaaagctgcagaggcagcagagtgatggcttaagttggagaatgccactcaaagcgggggtgattggagcatggggctcctggcatgagcgtggagggaaaattatgctgattaggtaggattggattaaaatactgcatcaaggaattgggagacatgattttgcactgcctttggaaccccttttcacctcatattaggatggagaattgaggttcggagaacttcttgcttgcccaaagtactagtaagccagcaggcatgcttggttccctttgcaaggctctttgccatagacctgctgtctcaagctgtgcagtacttaagacttctcttttggcatctgtcctatagcacttttctttcatcagagcaccctaaaggtaatttagggtcagaatggtaggaaggtattggtgttaggcaagaatatggcacgatttcttatctttttgctgggcccctgtgggaatgatatgggagaattgctgggaatactgggggcagatgtttgcaagtaaaagtgtatatgtttctgtgttcttgcagctgcattcgttttgtgcctgattccactaaggactgtactttatctgcttattgctgtttctaggaagttaatttgcaggtgctataagtatgcatgcttcatatacttcatttattctttcttccttgaagcctctcctctttattaggcactattcatttgtctacttggtacctgtatttttttaatgtcactattttgacagtaccaataaaggtaaagccactcaattacgcagggctctctctttatgctttgggtaggtgcacctgtgcaactgaggggacggtcagtgttatcaaggttacctgttattacaagtagaagaacccacagagatcaggagagagctcattttcctccattagtaggaggtaggactatacattcacaaacacgaaccttaaaatagctcacaaaatagtgtcatacatgtacccagccatctttccactcattccttctcaaaaggaatgtagtaccatatagtagttaagaatatagacactggagccgatcttcttgagttccaatagtggctcttctactttttaaatctcattttccttcatctttaaattgaagatagtaacaatctcatggggttgtgataactaagggggtaatgcatgtaaagtgcttagaaaatgcctggacataggaagctctaagtttgctgctactactgttattatggttactattattaatcattgcaaggaaaatgtatcaacagatgaatttggttcaatactgccttctagttttgtgaccttagaatttataggaacaaaaaagatttgaaagggaggttgggctggatcatagagagccttgattccatgttttaggatgtatacacagtgagaagtccttcaggttttggtcttggtaagagttgtgaatcagaaagttaactcttgtagccaggcggagtggctcatacctataatccaaacactttgggacatcgaggcaggaggatcacttgaggccaggagtttgagaccagcctgggcaatgtagtgagacccctgtttctgccaaaaaattactcttgcaacttcatgaaaaataaatgattagcagaattagagcagttaggaggccatcttaatagtccaaggcacaataaggcaaggaaatgaatgagagcagtggcagcagacatgaagatgagcagttggatgcgaaaggtttgttctatagatagattcctcttggcttaagaaggggaaataggaaattaattagtaatcagaaatatttgcatattagtcttctccatcttcatccttgatgagaggagagcttgttatgtatgtaccattgctgggtacaggaggcagaagagctagcgccagaacaaggagctcagctttttctggtctctgcttttacgtggctcgttataaaccaggacccaattagttctttaggcatgcctgcctgttctctttccatgtaattactttgtggagcttgggttcatgcacatagttacctcgattaaaaaataagtttttggagctataaattttcaaacactgctttgagagggtctgtcaggcattaacattcaaggtttctgtggtgggctgacgatagcctctagcctctggatgtttttcacattccaggaaatgacacctgaagttttcagttccttttcgcatcttcagcaatccatagacagtggggtgaaaagatgtaacctaattgaagacggatggagtggagtagaagttgaaaatagggaagaggctgggtgtggtaactcactcctgtaatcccaacactttgggaggccgaagtgggagaatcacttgaggccagaagtttgagaccagcctgagcaatacagtgagacttcgttctctaccaaacaaacaaacaaaagctagttgtgcatggtggtacccacctgtagtcccagctacttggaaggctgaggtgggaggctcatttgagctcaggagttcgaggctgcagtgagccatgattgtgccacttcactccagcctaggcgacagagtgagactctgtttccaaaaaaaaaaaaaaagaaaagaaaatagggaagagactgcatgagtcctgccatgcagtctttcccagaattggacatttttgtggtgtggtctggaagaaggaaaacatttatggtcatacctctccaaattgaacaattgtgggaatatgtacagacagatttgcagggtagctgaaaagaaatgcagttctgttatttttttgttatagagtggtaacttgagtgaggattatgaaacattgcctagcagaactgtttttttaattgaccttcatgtataattaagaatatcaattattaatgttaaatatattggaattttaaaaattgtgattatttctttgtaatctgatttgtgctatttgccctgattatcagagtgttgtttgagattaaagtggtctagcttgggttcagtttgcaccaggagttttgaattaactaggctccatctgaatgtggaagattttcgtcgtgaggatgcaatggaatcgtaagtgtaaagggcctagtatagtgggtagtaatttattttactcctttttttccactttaaatgaagagtggctaaacttcaacttttgggacattggtctctacctgcacctccagaatgtaacctcttggggaagatatttggagacctggggacttttgcaggtgggtagtattacgcagagcccagatacccctgccttcttgtctggaaatcagtgattctcaaactgctttgtgcttgagtattacctggggggacatgttccgttttcagctccccaagccatagagttaagattcaatagacttgaggagctgctctcagtccaggattatgtgcagatcccgaatctgatcttgggctgctgtgcttttccagtgcccactcagtatttctggggctgcaaggaaggcagtggttccccttcacaggtacgtgaagctcttaactccatttttgtccttttaaattcacattaaagagagttttagatatgcaggaaaatgagaagggaaattgaccttgcctgtctctgggtcttgtgaatagaaaggaagagcctgcgcttggaggccactgggaatttgtggtgttccagaagacctctgctctcatgtgggctcttggcagcctcactgagagccacaatgggcttccttatttaagatgctcttaaattttcttttctaacactataaggttatgtcttcaccagtttctcagattttaaaaaaagaaacagggaggtaaaacaaatcccaaaacattttttttccttcttgtaaaggttacaaacataaatcatatttgagaacaatgaatggaccttattttttatcttcagaatgctgggcctctggcatcttagaaagtctctttactttcgaaaggaaggagacttgtatagtgagagcatcacactctggggatcaggtaacttggctatgctactgggcacctgggacttcttggtcagaacaagtctccactgtgagcttttttttttaatccatgaaatgtgggggtcctgaagctatcaaagcgttaatgttttatgattctagtgatgggcttctgtctgcgtgacaggcattttccagactttgttgatctatttcgagcttgtgaggaatagcatgtaccacccttcattacctcactcatggttcctcttcatcagtgctttataaactgtagtgtgtttgtgctgggaggaacgtaagagaacatgtggatcacccctttactcattttacacatgagaaagatgataccccaagtgattttctctaaggttgggacatgactggggctctccttgcgatttgcctttcccttcagtgcgttcggtaaacgttgcattaccccctcttcagggtattattctttcagttccatatgcctttcctttcccctgggatgctggagtattcagttttatttctaggcaaaagtactcctaactgtggcccctaatttttttttgttatgtatcttttctagaaagagaatttgattatgcattgtccatatgtttacatactgtactcataaatgaagttataaaatatatgtaagttaaaaatgtggagaaaagggaagtcttgtgcaccattagtggggatataaattattattggtattacggaaattagtacggaagttgcccgaacaattaaaaatagctgggtgtggtgactcactcctgtaatccttgcactttggaaggccaaggtgggaggactgcttgtggccagaagtttgagatcagcctggacaacatagtgggatcctatctctacaaaaaattaaaattttagctgggtgtgatggtgcacgcctgtagtcccagctacttgggaggctgaggtggttggactgcttgagctcaggagttcgaggctgcagtgagctttaatggcaccactgcattccagcctgggcaacagagcgaaacctagtctaaaaaaaaaaaagtgtgtatataagtacacacatacacacccctcaataaggctagagagaaaaaaattatatgtaagtatggtattttttttttcctcaatcacagtggatcagtttatgccttccctggatccagggtgaacttgttttgaggaccactgatccagaaagtggtggagttaagtctgtaccaccagctttagaatctcctgtggcacttattaaaaatacgaattttggtatctcaacccagattcactgaatgagaatgcctcctggtggaacctgggagtctacgttgtcttcatttttatgtttttaccaatagacatggggtctgttgcccaggctggttttgaactcctcagctcagagtcctcccacctctaccttctgagtatctgggaccacagtcacaatgcccagcaaagtctccattttaaaccagaggcaagtctccaggtgcctctgaggtccagcgagtttggggaaccggtattttagacaggcagggaagtgtcattcatgggttcatgagcatgggacttcttacactgacatctcagaaattgctcagctgttactgttaaatctacagtgatacagttagcactctggaaaatcagatgggcagttttcatttgagttacatatgagggactataacctgcataatcatacatggaatttcttaaaactccttggcattctctatgtggttttttgatttgtaaatccaaatatttgctattgtgcctcagtctttttttcctcattagaaatctaagctctccccgccccctcctggtgctgttccttgaggggctgtgtttttatttctgagcttttcccatttgtgtgtgttccttttgtctggagtatgcccaaccccctcacctttttacctgggcagttcctactatctaaaaaattccctataaatgacattatttttcattcttaaaatctaaagataatgaagaactagctgataatcagcatttaccaaaatagatttaagggttattatttgtaataactcatgtgtcagtaaccttatgtatgtaaggatagatcagtatcttggttattaagcatatactctctgaaacattcgaatcaaaccagtgtaagtcagataaatatgtaacaggaaatttgtttctgactattcactccaggtcaatgtattcccagctgccttgtgggtatcagggttatctgttccaggatcagctttaggaaagcccctactcaaatctccatgtagcaagagtgcaggctagttgagaacatgtgataattaaggttaaacaaaaaaatcaaggcagaatgactagaaattaggacagcagggaaagcaggggaagcggttgagctggtagaaatgggtaatacctatgattatttctgggatcaacagatacatccctgttgtagaagtccaaagcagtccttctttttggtgtcttttcctgcctttggtatgataagcccccctaacatctggcacactattggggtgacattgtgaagttacctctgcccacagtacttactccagtttgatatttttaagaaatgctcactttccactagccatagtttattggctttcagaaagtgtctggcagtgagtatgccaaaggtcaagaattctggcagagtttgatttatctctgctcccttgatagcagctagccttggaggcatagaagctcttgacaagtactatgagtcagaaggccacatgtgactaggtccctgcccacctctccagggtcaaatagatcttgcctttttccccagcccctccctgcactgttcctgaagagggctgtgtttttctttccaagccctcccatttatttacattccttctatctggagtacttcttaccccctcacctttttacctggctaattcttatatatcttttagataattctacataaataacacttctttcacctttcctaaactagaataggtattcctgctgtatgcttctatggtcccctcatttcccctagaataacttactacagtttttcgttcatacttactgttatccccctggactgtctgttctgctaggataaggattcttgctcaccatttcctcattgctaggcataaggtatgggacatagcaggttatcaataaacattttttgactgaataaaagcataataaaacaatatgttaattaatggggtgactggcagggatctagttgccaatttcagcattggtaattaacatggctagatttagctgctaggttctatgagaaagaatgattaaaaataaacagaaaggagatggaagttgatacgattaaaaacattttatgtgcctgctgatggacctaaaactgggcaaacctttctgcaaataaagctctaccttgatggtcttattgatataccatatatacatatatatgtatgtatataaataagatatacctatatataaaatatttatacctatatatggtatataaatgaatataaatataagatatataggtatatatatgtggtgtatatatacataaatatgtttgtgtatgtataataaaagacattactctccattgaagtgtttactacattatgtactatcttaaaacaaaacttcccacaggtgtcagtacaaacatgcatttgttcatttattcattcattcaacagttttgttgattgtttgatatatgtcaggcacttttctaggtgctcaagacacaacagtgaacaaaacagacaacaatctctctgactcaatggaacatgcattttagtggaagggaatgtcaataaagaaacgtctaatatctagagtattagaaactggtaagtgctaggaaggaggaaagggggccaggaaatgatgtgatgtgtgctgttgtggtggtggggcatgcaattttagattcagtggccaggaaaggagtcactgagaaggcaactcttgagtaattacctaaaagggggtgaggaagtaagccaggtgggtatttgggagaagtgaggtaggacagtgtgcatagctctttggaatgtgctcctcatccctcatgtttattacgttggccagaccagcaggttgggctttcagtggcctgtttgatcagaatctgcaaatgtttcctgtctttggatagtttccctgactaaatcttagcctgaagacgtatgttaaggggagagcgtatgtttcttcttgccaacttagttttatggaaaaggccctaaggaaaaagcctgtcttttccttttcatgggtcagaatttgtgttttgttattttctaagctctagtttgtggtggaaccacctctctcagatcttgtttttccttcagggcacagtgtatttctcacttaagtagtttatgcagtcttatcacagtgtcccctgcatggggacctgataacttactctgattgataacggaagggcttttctgtctacttctgtctccttgatggcttccttatctgttgtcctgtaacactaactgtgaactcatttcattaggtaatgaaatgttatcttctgtaattgcttatttgtgcagcagtcttgtctctgcaactggagaggaactttaggttctttctgaaccttagagtactggctcatagtgcctgtgctataaccatcattgattgctgttggtcaaagcacctgactttttggggtaagtaaaccaacatcttgcttttcagtgttttgtttttctggattacccatctatgctttgggtttaatgctccttaggacttggccttagtatgctgctggagagcccaagggaacagtatattagtaagggatgaattctttgtgaattcttaaatcttccattgcgaagatctttgtacagaatactggttctgtttatattgacagttcttcagagaattgtgtgttgactgttcatggcagaaacaccataagttaattgctgtttcaaatttcattgacactttccccctcatttggaggtcatttcctcaaaaatgtcgttgtccacatgacagtttgtgtatgcttaataaaagagaatgacaaacccaagttcagctgttgttactggactgggtggtttttagctcctcccacaatgggcaataatcagtttggggtctcagcagaattataaatacctgcatttcatagtcttcctgaaggaattgctttacttggaatactgtagttcagactgctgatgtaccgtgcactcctttctctttgatgatcagctctgaagtgcaccaattggagagaactcttgaataaatgctgtcacttgtcacatgtggtcactttctggggactgtgcatgtgccagtgggggccatctagaagccaccgatgcccactaatataacaaaactcactgggtttgcttctctataatgatgttggattgctttgctggaaatccttaccatcttggtttctctcctctgtttcctgtaaacaccaaataaaagtccttgcatacaaatgttaccatctttggaaaaaaaaaaagtccttgtagttgttaacagttacagaaaatataacctgaagacttggagtcaaaaaacaaatccctgccttcccatacagtcagtaccagctataagctaattaaactcaactgttcccacctgttcccggggaggcctctaacagtggcacatgcttttctctttgggacttaacatttttcagaactctttaaatttcattttctaggccaggcatggtggcttttgcctgtaatcccagcactttgggaggccaaggcaggaggattgcttgattctatgagtttcagaccagcctgggcaacatgacaagacactgtctctacaaaataaacaaacaaattagccaggcgtggttccaggcacctgtggttccagctactcaggaggctgaggtgggaggatcatttgagcctgtgtggttgcggctgcagtgatcattgtttgcaccacagcactctagcctgggtgacagagtgagactcttgtctcaaagaaaattttttttcattttccattgacaccatactaaacaacgtgtatttccagaatcaacctttatttccctaagaaaatgtagattgtgatgtccctggtgagcaataagttaatattggctgatagtatttgagcagcagtgacagataggaggaagacaggagggaagagatgggagtgttgctgggggagtgggtgtgaaaccataacacacatatatggtcacgtacacatctgtagtttactcaaatggcattttcacaaagcacagtagtgttgcaggtatcccccagtgggcacacagagctttcagtcctcactgtgtgaaacttctcatacctttgatgttgaatttaagttcattagtggctcctatagcatgtcagaggtttacctcacttggttcctgactcaactctgaaatgctgagtttagggtggatttgaagtgtcaccttcgtctctactttctaagagtcagtaaagagctgccatgatagttaatcctatagtgcctccaatgaagacttaaatatacttactagcccagactttgctttatcattctcctgatctattagttttattcctgttgacagccaaaatgtaggatcatgaaccccacagttacatggatggtgacagacctgagttgttgtcgagaatcgtgctgagttttgttatcacatttcttgtctcgatttgtagcatctctggattttacttctttaccagaatagtggttatcaaagtgtggtcttcgaagcagcaatatcatcatcatctgggaacttgtttgcaatgcagatttccaaggctctaccatgacttcctgaatcagaaacctttgaggaggaagccagcaatctgtgtcttaacaagccctcctgtgattatacccaactttaagaatcactacacagacagacgttgctttccttttagtctcttgagcttgtaacagttgatattttaacttttatatgagagaggacagttatatcttcctttaaactcttatttggtgcagttgattgtcagatgcagagtgctgatgtgaggatggactgtgaatatgatccactgtggcagtgtttatagtctcagcccaatgccttgttgacttaagtagcagccttgataacaggagataaatctgcaaagatactgtgaggttacatggcaaggcttttaaaatacaccaacattacatttgtggcaagtgctttgctcaatgttggcatttttgaagtcaccctttacctctgccccctgcccagaaatttccttgtgagaaatgtttttacgttagacaaactgccatgggggaggatagtcagaaagaggagacaaataatacgcagaggcagacttttttttacatttgttgctcagaagaaaaaaattccaatgaagaatgaaagaggcttcatatcctgaataaagtaaatgatctgggtaggatggtacaggaatagaatgtgactataaaaaagaaccaaattgtgcagacaagaaaatatgaaggaaaaaagaataggaaaaagacagggaaaatgcaaattcttatggaatatttttgcaaatctgtgtacagaaggaaccaagcaacgcagatcagttcttctgaggctgggagttctaaaaattatgcagtatcaaggaaggctttcttcctgagtcaagtgtaggaagcagaaccaacctttatttctctatgaagatgtatattgtgatgtccccagtgagcaataagttaatattggatgatagtatttaggcagcagtgacagaaagttttctttctcctgactgaatctcacaccaaggtccctttttatttttaattgtttagtttaatttttgttttttgttttttgagacagggtcttactctgttgcccaggctggagtgcagtggcgcgttcatagctcaactacatcctcaaactcctaggctcacacgattcccccacctcagcctcctgagtagctgggactataggcacgtgacaccacacctggctaattttgtaacttttgatagagacacacacggtcttggtcttgctatgttgcccaggctggtctcaagcggtcttcctacctccacctcccaaagtgggattacagatgggagccaccatgcccagccaaggctttttttttttttttttttttttttttttttaaaccagcgtcacaaccacagaagaaagacaagaggaagatatgaagacaaaactcaattttttttacttagtgtgtctaggtaaaggtttagtaggagataatgtagaaatgaaatatgataatagcttatttgtgttgagtgctttgatgtatgaggcattattctaagggcgttatacttgttgaactgtctacttcttacagagtctgatgagctacactctgtttgtgtatttgtttttggtggcttttttgagacagaggctcactccactgtccaggctggagtgcagcggtgccatcacggcttactgtagcctcgatttcccaggtttaggtaatttacccacatctcagcctcccaagtagctgggactgcaggtgtgcactaccacgcctggctaatttttttgatgagctagactctgttaccctcatttgctagttcatgaaattgaggcagagagagaaagtaagcaatctggccaaggccacacagctagcaaatgggatttaatccctagcattttcattccagagccttgcctttagccatcacactctactgtttctcttccatagtcgtcttctttcttgtgattccaagttaaagaattgtcatggatgagctttttccaggagtaaaggtacttgttggactcttcatcagatttggtcgcgggaaaagaggttgttgctcttccttagagacctgttctttctgcatttaaaatctgagtgtaaatttttttttagctggaaattttaaacgtgtagcaagtgtggccagcttgctcttgtaatgtttagtttcctggacctcatgttgcctccctaaaacttaaatggggttgtggttgcacaacagtatcatggaaatgaaatgaatcttaagcctaatgagtttgaataagatgagcacaatctaattttgtttccagtcgtttttcctcctttaaacaaagaatatcatgccaaattggaaacattggattgtgtcactgtgggtatttattttttactacatgtcaccaagatccagatttgttgagtgtattagttacatatggggtaaaattctgattttttaggtgtattagttatgtatggggtacaaaattaccacaaaacttaccatcttaaaacagcaaacttttactatcttagtttatgtgggtcaggaatttctgagtgacttatctgggtagttcttgcttgacttctcttttgagattccaggagtaaaggtacttgtcagactcttcatcagatttggtcccgggaaaagaggtcattgctcttccttagagacctgttcttgttgcatttaaattcttagtgtaaatttttttttagctggaaattttcaacctgtgtagcaagtgtggccagcttgctcttttaatgtttagtttcctggacctgcagccgaaatgttatctggggccactgtcatctgaatgtttgactggagctggagagtctgcttctaagatggctcattcatatggcttttggcaggaggccttggtttctcaccacatggacttcttaacatgacagctggttttaccagcgtgactgattcaagagagagaaaaatgacctaatcttgcaagtcagacactgtcacttctgccacattctgttagtcagaagcaggtcattaatggcagcctgcactcaaggggaggagaattaggcccaagctttttttttttttttttttttgaaatggagccttgctctgttgcccaggctggagtgcagtggcacgatctcccaggttcaagcagttctcctacctcagcctccggatcctgagtagctgggactacaggcttgcactaccatgcctggctaatttttgtatttttagtagagacggggttttaccatgttgttcagactcatcttgaactcctgacctcaggtaatctgcccgcctctgcctcccaaagtggggattacaggtgtgagccaccgcactccggccaaggccgcacttttgaagggaggagcattaaattgtggacgtattttaaccaccatagtaggcctgactccacacctactaaatcaaactctctgggtatagtaattttcatttttaagattctctcaaatgatttttatacacacttaaaatagaggacaactgggtatctagaagtaaatgaatgctatcatggcactatactagtttatttaaaaggccagatgtttttcacatgtttagcattctaaatatttgaggtttgtggatgaggtcacttggaagtaaaaaaaaaattttttttcaggtttgcgcttaggcactaaatcatatactaggtaatatagtacactctgctcagactgcattttatctggatgggcccttagctttttttctgttgctcattcaggcagatgagccccactctaatgtagcctgtggtatctgaccagctgctctcagtgcatatagcccaagcaggagctgtagctcctgattagaaagaatgaagtatatgtctgggcagggcaagccaaaagggattctgaggttcttgtctcaagatccagggtgaaccaggcaccatctgatgatggtctttggctcattggctcctacagctgcatactttgttaggagacatgaggggtacagaaccaggagtttgcaaagaacaatcatttgccttctggagcccttctaacctggacatcacacccttttgatgttaaatgacagacgtctggctctgtgtgacatcatacctatcttatcttagtgtacctcagctaacctcctgaggcttttggtggggaatcaggcctcattccccatcatagacataatttcctttttttttttctgagatggagtctcgctccgttgcccaggctggagtacagtggcgcgatctcggctcactgcaagttccgcctcccaggttcacaccattctcctgcctcagcctccccagtagctgggactgcaggcacccgccaccacgcctggctaattttttgtatttttttttggtagagacggggtttcactgtgttagccaggatggtctccatctcctgacctcgtgatctgcccgccttggcctcccaaagtgctgggattacaggcgtgagccaccacgcctggccgatcatagacatcattttcttaccttcccattcacattagctcttagccatctgaatgcatgcctacaaggaatgcaattggttgcttaagaacggaggaaacatgttatggaaatctatacttctcttcaaatgtttgtaccactcacctacccaattcccttcccaccccaatcaaaagacaaatacccatgctcagaacctgggggctcacattttacctgaaattccacaagtaacagaagcacacatttaggggataaaaccctagagagagagtaacacaatcctggctgccatctcagaacaagagagcattgtacccagagtccatgatcacatactggaatgactgtgtgacggagctgacatgccccaataggtacaacagattgttctgcttgtaaccaatcaataccacaattaacaaatatttattgaacaccccggaagcaccctggtatatactgtcctcatcagctatttgttagaataacacgaaacctcctgatcctctgtctgccttcaggcttgcctctgccccaataaaatcaattctctacatcaaaaccagagtgacttttcctaaaatatacacatttgaccaggtcatttaccttgaaatgttctggttgatgttcagcatccagataaagcccacacttcccagcatgacctaagaacctgaccgtgtgactctgcttccctcttacagcttctccacacatgttccagcgtccaggcactctccactcctcgtgcctcccaccatgcccacctctcttgtccttcccatctttatgtgccacataacagcggctaagagtgccggcgtcagagctcataaggctttgattcaaaacccaactctatgacttaataattgtagagtcttgggtaaattactggatgtttctgagcctcagattcttcgtatacaaaaataaaccaccagcctcacaggattctcataaggattaactgtgatcatatttaaaatgtttagcacagtgcctagcccataattaagactgagtaaatattgctattgctatattgatgtatggaaagcccttggcacacagtagttgtttaattaaaaaaaaaaaaagatccttgtctccgggagcctcagtttttttttgatcattggaacttctcagtgtgacattcagagtttgatataggagtggggatggcattggtgtgggtagagaactagggttttgagggaaagagagagaaagttgataggaggagcatagatgtaaaaaccattgtgtgtttccatgtgatcttccttccgtttgaatatgactaaaaatgtcattcgttttggggcagggaaaaatggtagactaggattcggaagaaactgacattctgacgttgagtaagtcactgctttgcgcctttattagttcatatgtaaaattggttcatcagatactgtttttgagagctttttaaagactagaaaacataacgtgaaataaaatgacaatattatacccctaattctacatttacagcatattcaacatttttttgaaagcaacatttttgtttacacataacagatgctgaagcacacagccccctagaaatggaggttgccaggaggataaagaagatcatgaatgctgccagtgtctctaatctttgccctcattccttgtgtgtctctcatttgagaagttctcacctttcctgggggttctctggccagagtgtttttactctgcaccactctacctgccgttgactgggttaccttcataaaagaggaatctgaagggccttatgggaagagtactgctggtggacacatggaatcaggaagcatagtttgaaatctagcacagattaaaacttgacctaacactcaaaaggttttcttctctgtgatctagggctctctgtggtcaccatattgcatcactatgaggtttaagatgaatgtgtgggtacctagcaaaggtctggcatgtgatggatacaggacagtcttgtcttttcctacttggacacctgagatagttccccagtgtaccctgaatatctgaatccaaaatcttcagtcaagaaggagcctctacggactagatccaagcctccctttctgatcttatttctattcattaccttcatgctccccctcccgtccataataattatcctccagactcaaggcccttcacgtgatttttagtttattacaccttagcttttcctttcttctgtatagactttgctgtacctgcaataagtgatacctttcccaggtccatgggacttgaaaatcctgtttccatcaagcttttccgcaaaccacccctcctcaccaggtgggagccatcgttcattccctgttcccccaatgcatgttgttttgcttctattatagctcttatcacagtctgccttgtagcatagtcatttctgtgtgttttccctctggattcggagcccctggagggcaaagactatgttttattttatgctgtatttccccacccccacagtgcctagtgcagtaggggtttggtaaatactgcttgaatcaatgcatgaatgaaattgcctctcctagttctgtttgcaaggctgtaatgcagaccaggtgaatgtagaattttggcttactggatttagtttagcataggaagggagttttccaagaagcaatagtggttttgaaaacagaaattgcctttaatcttgtggaaaacatatgccagccctctccataatagtctcaattacaggagagcatcgtgttactgtaaaaacacaaataaataaacccatgacaatactgtgtttgggagataaaaaccacataaaagccatctttccccaactctccagcatcataattagggtatttctgggaggagaaaaaaaagacaccagcaaaaaacaagtgatactatgtttaagaacacttcttgctattggcaagatgggagtagggagttagattttccatacagcacaaatacaagggttcttcccagctcctaccaggcttgatgctatatagattacactgcatgataaatttgggcactagaggtgccaaagatggtggcagaacctggagggcagaaaatgtcacccagaaggtgatgctgtgaaatttattgctctgccacactttacctaaacatgtcctattattctgaatgctgggtcttcattggctcagggatgcccttggtgcgtccgttgccatgggctacaactttcaactgtattttgtttattgctggtcatttaagtctctatctggtttttttttcttttaacttgagggctccagatttaggttcttttgaggtaagagtaggaatgactttgaaatattgcctacttttgtcagtattagttaacaagcactgagggctgaatgacactgaacagaacccagccatttctcagcacctctgttgccactaccctggtctgagttgccatcatgtttcacctggactgcctcagtagcctcccacctgacctctttgctcctactttgcctccctgcagagtgttcttcactcagcaaccagagtggcccttttaaaatgtactttagatcatatcactcctcagttcaaaatcctccagagtgcctcccatttcactaagaatgcaattcaaagaccttacttaccatggcctacaagacactgcacggtctagtgcctgctatctctcaccccatctcctactatccccttagattaatcctctctgacccttcagcttgcttgctgttcttgaacctggtcaagcatttcccaactcagagtctttgcattattgttctcttagcctggaacatttggtcccagatataaacacatggttcatactctcacttccttcaggcccctgagtgtcaccttgttggggaggtcctgtccacctgtatttctattgctggagcaagcacttaggaagtctttgttggaattgtgaataagcattgcccagagattctagcacatttggaaaaagagagtgtggtttagaaggacagtggctctggagttggagcagttgggcactgctgggtttgcctgccccccattggatagatggctgatgttgggaaaattatttaacctttctaagcctaggtttctctactagttaaatgagattatgtctatctctcagaatcgttgtgaagagtaagtcagataatgactgcaaagtgcttggcaatgagtcttgtacacatactgggaggcttcctaaataccacttctcacaaatcctacttcctgcttgtgaaatcatgttatatggaagaaggggagtgtctgaaaatggtttgaatcttgtgtgtaattctcaagtaccagcaagtagttgtgattatatttaaagcacctagccctgtgcttggcatatggcaggccttaataaatacccaagtcttcctgcttttaatcatcagacttagactctgggtgtgaactaaggtagctctgtgggcacacagggattttggtaaacagaaaaagaagtcagcagctgaggtaggggtggttcacagtcttgcttgtggttcaacagggactgcatttatgaaaatggcaagtgagcccagggcaattggaactttgggccttgccagcaagtgtggtatttcagtttacatcctcagagtaagtacaatttcaccattattccattgaggctctccttgccaagaaaaacccattgtaaatttctggtttaaaggttctgcagttttagggagttgtactttttgttgctttaacattttcttggcaccacacattttaagctgcactggcttaccttgtaaatagtatacacattttgtgaaaagctgaaccacgtcatttgttttcctatgttccttatgggaaatggtgatgcttctgccccactagttcccctgggtttctgatcaggcagtttggagtgagaaaatgagactgagacaaaatatagattgtcagcaagagattggagctgtattcacaaaagcactttgtggacatggtagagccaggcaggagagaaaagtctgtggccggcagggtgtctgtgtgacgtggacccattgtgtgtatgggctcctcccgctgtaccagtggccagctcccagccaggccacccgggcgagggcctctgaagcagagagccctgcacagtctggagccgctctaacccagtgtactgaataggactccaaagaataggagctgtgttccctttgtcacctgcaaccctgctttcagcctgcacagtgaatgtgcacttgggggctgaattggcacttggaaaaatctgcaggaactttgtgtgtgcacagcgtgtgcccagcggtatgggcgaatggagcgtgcacgctggagatgtctgggggctgggtgcttgcagaggagggctgacctctttatgctgcagggtttgccaagaatgctccgcccttgacagtgttgtggccaacagaaaagcattcgtggcatcttaatgaaaggcagcagttccttttttcaagaatgataggcattcttttcttgagcgaggtccccatttagggatggagagagaagccaattatttttcagttaaaatttattttttaaaatagtgatgcctcagttgtaaattaccctggctttgccatgaagacatttacagctagccttctgacttggttttaagttgctgccttgtagaataataaaatagtagcccaaactgtgataaggcatcaaagactttcatatcctatctgtgtagctgatgtgcgttgctccatagctagaaaatggatatattttctgaaagggaatgggtgtatttccctttaccttgcagcttgcacataatcgaacacttcttttattgaaattgggggttttctcccttggacttaataaggagatatagatatctatatatctatatatctatatctccttaagagggagtttcataagttcaaaagttgtcaggttgaaaggattgaggtattggaaacaacaatcttaaagttacctttggaatgatagatctttgaaaaaaacaggtagtttatagtacattggaggaaatgctctgttgttttgcatcttctccaggcctctttatgactactttttttttgagatggagtctcactctgtcgccagactggagtgcagtggcatgatctcagctcactgcaacctccgcctcccaggttcaagtgattctcctgcctcagcctcccaagtagctgagactacaggcacatgccaccatgcccagctaatttttgtatttttagtagagacagggtttcaccatgttggccaggctggtctcgaacccttgacctcgtgatccacctgccttggcctcccaaagtgctgggattacaggtgtgactacttttttaaatgcttcaatgaaacttaacatgatgacctacacatttcagctgcgcatatgttctacctgttaatggtgagatacaacagagccatctttgactacttcacgctgtttactctaagaggcctgtatcattagatgacttcctgttggaagcagtaatttgtgtttggacttgggtgactgtcagtatgaatctagccaagaaaggtcatgtcacctgctacacagtttgctagagggaatacaggccaagccttttgcctctgaaatcaaagtactgtagaaggtgtaatagaaatgatgcctaggtttgtgtattcagggcctgagtttctgattaaagctgttaacaatgggggcaagctttccccgtgggagacaggcttcttggatctaaacctttctgacatctcaaagctttatttcctgatgatttctaaaagggaaggagccagccccttgaaattaaaatatcgacttacattccgttctccccagacggaagaatattagcagattgaatcagttggggttagtactttcttttatgtgttaaactcagttattctggctaagatcagatttttgtctaggacggagctgaaacacatgcggaatcttgttggttgagggctggaaacgaaggttggcttcacacaggttgcttctccaaaccgtaggtaagctcttcggccccgtgcacagcattcacagctgctgtctgctgcgctttcttgctccatcctgtctagtctcagaagtttcatggtactaatatcttggatccttacaaaggactgacttttgacccagttgactgataactatagagtactttacagtttaccaagagctttccttcatgtttgctctttacatcaaaattacaagatgggttttattatccacattctttttgtagatatgagggccagagaggttatgagttagccaaagtctatccagtaattgacagagccaagattctaggctgggacatctgattccaaatctactgctcttcatgctcctttatactgcagctacttacctgctcaaagtatgtcattcactcattcgttcagcaagttcttggtggcatgggctttgaagccagacagctgggtcccagtatctgctcactagctttgtgacctctgttacctcttggaacctcagttctttcatcagcaaaatgaagatagtaatagtacctatctaggaaggctgttgtggagtcctttaaacagtgctctggacatagcaaatactccataaatgtttgccattcttcttcatcatgggctcactcagtggtacagggactccacaccagtgacagcactgctgttgaggatcacttgttctgatgcaaatatgaaaatagaagactgacaattgcatagtaaagggattgctaagatataagcaggatgctggggaagcttgaaggatgaacagctgtgttttcgattgccaagaactcggctctctagcagctcacccttgttgcctctacccctatttggtcacattcctgtcttactcattccttgctgaaggcagtatttaatgtgcaggggttttatgggtactttgtgtataacctctttgaggaggaagagaaggagagtatgtctggctaagggaaccttagtggtcatttgggattataagacctatatttaacagttggaggactgttcaagacaaaatagattccaaggttctggtgtgcagtgttctgtctgagcaccacaggatatcatatgtgagtggcttccagtgggttgctgagggaggggactttgtgggggaagtaggccttgagttggacctgaaagaaatgaggatttggattatgagtagcagaagcgtggagagctgggcagaggtggagttatgatatttaaaccatggcctgccttgggtggcgggacagccctgcccggggatgtgggtggtccaggaggcaggtgctgtcccctcctgcatgagaacctgcctctggaccccaacaggatgcacacagcttatccccaccctctgcaaagctacctaataatatctttgtgtttatggtaatgttttttgctgatttggtgggagataaaacctagagagacccacagcatggatgctaggtctgagtgggtctgtgagctgcaacctagctgcagcccctttgtttgtgagctgtttgcctgcatttaaatgccatttacataaggagctgtcagagttgagttggcccatgattattccttgatgtatgttgaaaaaagagaagaaaagaaaaccctggctaatgaggagctgggttccttttctccattgatgacagcttcctttctgatctgatggtccgtcagaaactaaggtggtgtgtgactgtggggttatgtccccgctgaagccgtcttttcctcagagttgtaattgatggggagacctgtcacttgttatgctgatgctgtgcagatttttgtgcagctgccagccaagagagttgtaggacagcatctgattgggtgcaggttgtggcaaaaatgataataaatagagagctggtgagggtagattttgattgacccgagattgtatattattaaactggagtctgcatgtacatgtcagtttatgaagaaccagacccataatccaactttaggactgtggcagttcgggtttattaaatgtgctttatatcactattaatattgaggagcaaagaggaatatctgtaatcttttaatctatgcaataatggtttggagggagattaccagatacattggactattgtttgtctataattgtattcagaactctccgaagcattgatttgtttctggcatgctgatttggctcagcagtctcataaagctcttttatagtcctctttgctttgtgttttccaaaaataattggagaataataataatgtggctggcgataaagaagagagagtaaggttgaaagcaaatttctagccgagtggatagccataaacatcttctatgctcataaacacctgggtctgtgacctttgtgtttataagatatttatcgcctcatgggctctctgtttgggggttaccacttcagtgccttgtaaaatttgattgtgtttagtaagtagattctgaatttttgctgagtagggaaaaagtgcccctcacctttgttttctttggaacaaccaatctgccaagaggggcagatctcaccaaggacaggagcagagagcttgggtgtgcctgagttttgtggaaatggtacagtgggacccagtaagggtatcttttgtacttgattaagtggcttgtgatggaaatgacttttgaacggaagggaattgtgcaacacatcaaataaactcaagcagtgtcgatgggttttccttttccagtagaaatggaatttttgattcaagtcgaggaagctttcttgggatttggatttttgccacttcctcaccctttcttcccatttccaaaacaggcctgaggaaatgagccagagaaatggtcaaattcagtttcattgactttaatacgaaggtatgactaagtgctgcaaaagcacagttgtcttctatcttcagcagtcctctaaacatttcttggggaagttttaggcactttgtcaacctctattgtcctcctgatggtgttgcttaattactcttgaaggaaacagttggattcctgtgaactgatgacaggtgtatgctgagctgcctgtgtaaactattggctgcctgttcatgttgtgcacagtggatcagaggcatatgggagaatgtgccaaaacgggaatcttaagggagttttttaaaaagtaaaaattgtttgcttttttgctgtggtgcgaacatggctcacttccgccttgacgtgctgagctcaagtgatcttcctgtgtcagcttcccaaatagctgggaccataggcacatgccactgagcctggctaattttagtgtatttttgcagagacagggtcccactatgttgcctaagtgggctcaagtgattctctgtgccttccaaatcattaggaatacaggcctgagccactgggcccagcccccagtaagctttattataactcaactagcttcattataactaaagtatgagccagtcttgaggtgtataggacctatatttatcaaaggagactgttctacctaagacttagtttcttgtcctatgaggttaattgctgctgcatttcatggagtttatgagatgtgcttccctctgcccttcttcaatcagatggtactgcctgggagtcatatacatgcaggactgataaagagcggctcccacagtggcagtacctacagtggactgtgctgtaggtaaagggaagctccatcacactggcatgtgggaactggactaaaaggccacgaatcccccaacacttactctctgcccagctttgtgaaatacaaaataattatgagttccagactccagagatgctttccacctagttggggaaggagaagtttaggtcagtggttctctaagttggtccccagacaaggagcaccctaattctctggggatttgttagaattgcagattttggggcatcgcccagactaacagaattggaaaccatggatggtgttttacaaactctgcaggtgattcagatttatgctaaagtttgacaactcctgctttaggttcatcagttccagggggaataaatgagtaaacaaggcacatagaattaagggcttcctatagggcacagcgaaggagagaataaggtgctttatagcaggatgctaagctggactgtcaatcatgtgggaaaggggtcaaagactggaagagcagggatcatcaaggcagtgtttgctggggagagaagttattgagccaggttttgaggactgaataggagagaaagaggtagagtagcatgaatgagctcagatgtgatagggagggttctgttccttcaagagcttagttaagtgtagtgaaaacacacacacactccggacaagaaaaattaatgtaaaatcaactatagaacttaggcaggtttatgaagaagaaaatatattcctcacaagttggattcctgtgagttcatctcttttattacctctggcaatggtgcaattaattggggccagggctctgcacctggaaaggctttataacgtgagattctcaagaggaagattttatttgcctaaggctactactttaaaagtgagagaggcactcatgaaaattaggggtaactgtaaaaagtgataagctgctcaacatagattcagtgcccagtatgtataaagtgctgtgtgtatactggagagagggaactggaatctaacttggggatgggggtggatccagaggagtagagatatgaagaaatacacatttaagtccagtaagtttttcatgcacctgtagtcctgagaggtgaagccagctggacgtcctgggtcgagtggggacttggagaacttttctgtcaagcaagaggattgtaaatgcaccaatcagcactctgtgtctagctaaaggattgtaaatgcaccaatcggcactctgtaaaatggaccagtcagtgctctgtaaaatggaccaatgagcaggacgtgggcagggacaaataagggaataaaagctggctaccccagccagcggtagcaatgcagcactgatccccttccatactgtggaagctttgttctttctctctttacaataaatcttgctgctgctcactcttagggtctgcaccacctttaagagctgcaacactcaccgcgagggtctgcagcttcattgctgaagtcagggaaaccatgaacccaccgggaaaaacaaacaactccagacgtgccacctttaagagctgtaacattcaccttgacgtccaaggcttcattcttgaagtcagtgagaccaagaacccaccagaaggaaccaactctggacacagtccaagctactccagaggctgaggtgagaggatcgattgagctcaggaggttgaggctgcagtgagctgtgattgcaccactgcactccagcctgggcgatagagtgagacagggtctccaaaaaaaaaaaaaaaaaaaaagtctagtaagtttttgttttcctttaaaggcagaggggagccactgaaggttattgagcagggaagtaacaagattagagttgtaatcatgaatctaattaaaaaatcagtgactggagggaagtagatgggttagaaggctagtctagttttaatactgtgaggcagatgagaagggcttgaactagcagagttctagaaaaatggtgatgtaagcaacaatagagtcatattagttaagggtgagagggaagaaatatttacaattcactgtggaccagccacttatgcctgtcattggtagagcttaaccatcacaattttagcaacacagagattgatttttatagaaggtccaaaggatatgtagcttggagacatattcaagatttgactcatgctgggtgttatggctcacacctgtagtggctcacagctacctggtaggtcaaggtgggaggactgtttgagcccaggaattgggaccagttgggcaacacagcaagatctcatctccaaaagcaaaagatttgattcaagcctgcctgcctgcaaagcctgtaccctttttgctctagattctagactttggcgaatagaatgatacattttgtttataattggacagttgttgatcttggcagaagtgttgactgctgggaggtgttaagagaaaggaaaaagcagcataagatatggaagtttgtttgatgaaactgtatctcaaagagtttaagagttttagcacaggacagatagaatcttgccccacccaagatgatggaagaacaaaacaaagtctgtgctgttttctttgttaaccagagttgagagtggagtccaatccaatatctgcctagtgggagtctcttgagtcctgatcccatgagatcatacatatggctgctactcctgttgtgaggaaggttgcaattttagaaataaacctggagcttttgaaggtcctatttattacttcagcccacttactgccgaggtccccatgttttgcaagtgacaaaaataaatctaaaatggaaaactagggagaaggtgagagaaagtgtccagagaaactggggactttgagttgtttggtctaagctacttatttgcatttttgtctccacttcctagcaagcatattggtacttagcaatggtgggaggaaggcagaactgtaaaaaaaacgaagtcatcattctatccttacacttgagtttcctttcagcaacctctctctcccttgtctttgtcccgtctcataacttaggcgtgatgtgctgctgtatctgccttgctgccttctcctgagtggaagctgcagctacagtgttggttattacacctggcaattagattgtgcaggacagtagttggctaggaatggcataaggttgcatgcctcgttaaatctgaactccactcagcatagactcttgtagaagcaagggggatttgtttaggtaaggagcccttgaaaggagcctgcttgttgaactgtatgttgagcagcagtgatgaaaagatgcctaaacatgtgtcccacagcagctacagtccatcagcattggacacattggtagatcacccctgctgttaacacaggtcttttcagcttactcgtttgtgtacttaactgttgagtgctcttttaattaggggcgactaacatcaaagtactatagttgtgccgggcctgctaatcaacaggtttcacttatactggggatcacttcagctttacaccaccattatcatgacattgatttttctgtgcacataaaaggaagcacttactgaatacaggaaaaaatcatgattgctaggtggaaaaaaaaacaaaaaaccagcaagaggaactcagttacccagggaaaatgtaaacgtttcatatgaacattgacagtgaaatggatttgatgagttttgaggtgattttgttagatactttgagagaaattgagaattctgtattccgaagagacagccggacttgaaactctagaggtatgattttgaccaagacctgaacttctctttgcctcagttttttcatctataaaatagggttagtaataataccaacctcactgagatattgtgaggattttgtgagatattgtgagattgaatgattagcttagtcactggatgtaagtactcaaattatagctattaataagtgtgatacggctgggcacggtggctcacgtctgtaatcccagcactgtgggaggccgaggtgggcgtatcacaaagtcaggagttcgagaccatcctggctaacacggtgaaaccccatctctactaaaaatacaaaaaattagtcgggcatggtggcacctgttgtcccagctactcaggaggctgaggcaggagaatggcgtgaacctgggaggcggagcttgcagtgagccgagatcgcgccaccgcactccagcctgggtgacagcgcgagattctgtctcaaaaaaaaaaaaataagtgtgatacttaatgtcataaatcattgttattatttctgagaactgatatcttgtggtccattgttgtggcagaagtataatttatataggaaccgaaaccagccctcgatttttttttttaatcgccgatcttggttgggcttcactatcattttcatcagcttcacaacccctcagttctgagaaccctccttgccatacaagccactggagtgtctgcgtttcctttctgtggacattgtcacctttcccttcattttggtaaggccatggaaacagagcaatcagataaaagacctgggcatttggcactttcattggccatacttctccttctggcttgagtttatatgtggtttggggtagttactggtgaaattgagctttgcagctgtctacttaatctgcatttcctgatctgctttggctggcaatcaaaagctgtatctatttcggagattgcgcaataagacttttaatgacaagttaaaagacaaagggttggtgggattgaaccttatgcagaaaatacttcactatacttcggtggctcctgtttactggtgattttgtgtggatagtaacttaaaatcaagaaacatttttgctaacatatttcctgggccattttagaaagaaatttctttatttagccagtaagtagagctttctttagcgtttacatagttatctttttaatattaatttttgcaatccatatgaatgaggccacatgtcctttaacaattttagacctcttctgttatgcattactgccatctgtcagtatgagagaaagcttcctggggcagaaggacttaaaacaatggttctcaaccctggggtcacattagaatcactggcagagcttttaagaaattttagtgcctgggccagttccagatacatagttgctctgggatggggcccaggcattgatgtttttaaaaaactccctaggtgattctagggtataactgggctgagaggctctcctccgaaagcactgtcttaatggaagaaccagtggcatgagaacagttctgctttttctcagcagtaaccttgttgtcttccattgcagtgctgattttgacaatggagccatgcggttgtatttgggtagcggtttggagggtaacaagtgtgtcttttgtatctctgaatcctctgcagccagtctagtgcctggcatatactagatgctcactatcctccacttcacttcttttggatgactaaataatggaatggagcccagatgtactagcctttttacttaatccctgagcctttctccttcagtggtccgtaagggagcaggtccacaagcatacacttttattgttccaggaggaggaagacgcccagcttcggaatgcttgaggcataaaactgatccttggttaagatcagcagaggcttgctgtgtgcaacataaattgtcaggtaaagaagcaattaacgtagtgccatttatttcctctttaagcatctagtccttatgagtgttgtggttctgcactccaactggaaacaggttctctattgccctgttttgctcttaaacacagacacctttttcagtcaagagaattagggccttttaaaaactcttctttctttcttttcctttttaggtagcccatattgaatcaggtcctgcagctatagttattcatgcagggagaattctatgaacacaggggagaatggcctgggagtttgataatttgttattttttggtttgtagattgagaagtatattaagtaaggataaccccttatagttagttagttattttatagttttcctgtccagaaggttttaatctctcacacggctgtggactggcaaagtaactaattattgtctccagtttatggataaaaaaatttaagatgcggcaaggttaagtgacctgcctaaggtgatagacctgggccttgaatccacagcttttgactgtaaatcccttcagtacactgagctttggatagtacttttgcttggattagaacaccctataaatgtgactaatggcatctcagggttctgtcctggctgtcatagttgaatcctttatttgcattgcatgtgcttgcttgtgtgtgtgcgtgtgcaactattaatattaagcatcttgccatttgcctctgtagagcacagttgatagacgggaatatacacttgatgtagtcaagagagtgtcatcttttattaagaattctgatcttgcctctccaaaatgcctactttcacttttagtctattgtaagtgtgaatatttgtgtgtggtattttattcctaggcaaggtgtttttctcagtctatgttgtgtgtctaggatgataatgttaaagcttaatatatttagttttggaagactacatttttctggggtggtttatgagttgttttccttcctccaacaaattattgagtgtctagtatgtgttctatgctgtctacctttacttccatctcaaggaagtctaggataaaaataacattgtttatctgtgaagggataaagagtcaacacccatttcatgtcagctctgtctttattaggcatttggctattgagctttctaatttcttgacttttgggagtgtttctcccagttaccagacaggtccagggtgggaaatgctttccttgggccccagaactagctcatggagaggtggttgtagcttctgggaattttgaaaagagccacacccaggaatctgcttggactatgtgttctttctgtcctgcctttactctcctcttttctccctcttataagcaaagcgtctttttgcttccttgcccccaatcccagagagactgttaacttatgtttgcatgtaaggagaacagtcagagttaaggatctcaaactcaggaaagtggtttttgtactcaagagctccctgtgtgtttgcgcagcacacttacctccatccaggatgcacttatcctgcgtagatggattgtaaccgtgatagagggggaaaaagaagaggggaaaaaaaaacccctaaaaaaaccctggattctgaagatggctgcagtatattcttcaatagaaatttgaagcatgaagtggattttagaacaccacatgaagctcttcttacttaaaacacaagaacttaaaacttggccaggggaaaggtgtagggaggtggagaaaagcactccttccatttaaggggaagtaagcacttgacttcatcaattgtggttaagataaacaaagcttatctttttggttggcatcagaaggggcatttaaagtctcatgaaatgagagaagggttgttctgttccttatttactgtacttgaacggagtcactgaaaaccttgatgggatgtctctatgactgctcattcctagttgtctgcagcactgtggccagtgaatatgctggttcccacagaggaaggcccacagcatggtttccttcctcttcttttaattttgcctcgtgtcttttgtagacgagagtgctctgcagtaattcttttgtagaaactgccatgcctcaaatcacattacataatacaggctggggaccagcattccgtgaggacttgatcaatgggttgggaaacaaggttgatagcattgctgtggaggagatgtcaatgcgaatttgtcagctcacctcacatccttgcttgcagaactttgattttatttaggtgttcacttccatgtggacttgagttcaggggggtacatcttgattagtctattccagtcattatatttctactccttgtcagtgatgggcttaggaaggtccaggtctggctggctggacatgaggggaaatcttgtgtgggcacttctagaaaacgtttccttgattttgatgaagagaagtataatttctatctggttgttgtctgcatgtggtgctttgaaattggcagttgccatctttgaaccgtgagccagcgtaagaggacaggcccacatgcaggggacagcaaagctgtacaaaagatagatactatctttgatgatattgtggagctgttgaattgatcagcctgagtccattccattttgggacttcttgttatgtgtgagaaagaaaaatcacgttttaactattttggctggattttctgtttccttcagtctagtgtattataactgataactatcttaccccattcatacaggatggtttgagataaaattagaaaatattggaaatgcttttacacaagtatgacacacacaattaacatagacattaacataaatattatattgtaatgtccagtgttctcatactttgcttccatatcacttctgctagcattttctccaaagcaaggggacaggccatgaggatgaaaaacagccatttaaaaactgtcttgggggttttcagtattctttctgtaagaattgacatgatacataactcctaaaacatagtataaggcaaaaattattctttcctgatgaacttgtatttcttcttattggaaagtggcaaataaaataatccagtataggaggcatcatgctacctgacttcaaactatactacaaggctacagtaaccaaaacagcatggtagtggtaccaaaacatacatatagatcaatggaacagaatagagacctcagaaataggaccacacatctaaaaccagctgatcttggacaaacttggccaaaacaagcaatggggaaaggattccctatttaataaatggtgctgggaaaactggctagccataggcagaaaactgaaactgaaccctttccttacactttatataaaaattaactcaagatggattaaagacttaaatataaaaccccaaaccataaaaaaccttgaagaaaacctaggcagtaccattcaggacataggcatggggcaaagattttaccatgaaatccccaaaagcaattgcaacaaaagctaaaatggacaaatgggatctaattaaactaaagagcttctgcacaacaaaagaaactatcatcagagtgaacaggcaaccaacagaatgggagaaatttttgcaatccatctgacaaaggtctaatgtccagaatttacaaggaacttaaacaaatttacaagaaaaaaacaccaccaccaaaaagtgggcagagggtatgaacagacacttctcaaaagaagacatttatgcggccaaaaaacatatgaaaaaaagcccaacatcactgatcattagagaaatgcaaatcaaaaccacaatgagatgtcatctcatgccaagtcagaatggccattattaaaaagtcaagaaacaacagatgctggagaggctgtggcgaaataggaacgcttttacactgttggtgggaatgtaaattagttcaaccattgtggaagacagtgtggcgattcctcaaggatctagaaccagaaatgccatttgacccagcaatctcattactgggtatatacctaaaggatcataaatcattctactataaagacacatgcacacatatgtttattgcaacactattcacgatagcaaagacagggaactaacccagatgcccatcagtgatagactggataaagaaatgtggtacatatacaccatggaatactgtgcagccacaaaaaggaatgagattatgtcctttacagggacatggatgaagctggaagccatcatcctcagcaaactaacacgggaacagaaaaccaaacagcgcatgttctcactcataagtgggagctggataaggagaaagcacagacacaaggagggtaataacacataccaggagcagtgtgggaggaggcaaggggaaggagagcgtcagaacaaatagctaatgcatgcagggcttaaaacctagatgatgggttgataggtgcagcaaaccaccatggcacacgtatacctatgattacataggtatacctgtacattctgcacatgtatcctggaactttaagttaaaaaataagtaaatacataaatacataaaaattcagtatgttttcttgttgtcttatttcaccaatgagctcagatccaactttaatggttaataacactttgtctaaaattcctaatatatcttctaatattttctagttggttttatttattttagttattttaacaacagtgagtgatctgtatcacatcctcctggaagtaccttggatttcattataactgaggaagcgtttgttatttgtttaaatgagtgtcccagatagcttgcaatggagcatatttatttgtttactctcttatccattcactacacatttattgagctcgtactaaaaattagccagacacttaaatcgttttctttggcttgattgtagagctcataaacaaaagtactaggaatttagaattgtagatcacagagcattagaataggggaaagtcatttttcattgttgagcctgaggagagtttcgaaggtgacttgaaggtattgatttgaggaatgccgatggttttcatcttcttttcccatcactaaactaagtatactcccttcagaggtagagagccaggagacctttatagtagtgaaaggacaggaaaggaaggctttcatagacagcctggtactggagtcagtattcaacagtgaaattctggggtatagaaaatagttaatttatatactttaattcccacctgatccccactccccaagaaggttggaatccttgtttttcctccttttggaatttgctactttgaagggtttttttcttttgaaggaataagaacagtctgttcattgtgctatttagtgcaattagaattagggagcaatatttgttctgtgagttatctaccctgacagaagctctgatagaagctcagaatagttaactgccctcatagaggcttggggcatcattgctggaaatgagatgcctaactccaggacttcatcctgtggactgcagaattaaacggaaccaaagaaaataagcaacaaaaaacagttggaacagcttctcagtggacttactgctgccagtcttggtggggaagcaccagtgcttcttggactctggctactttgatcttcccagggtgctggagaacctggaaggacccaggttgtctctcctatgtccactgtaagccttggtaagaagcatgaaccttctgtaagccaggacccaactgaccttttaagatttttttttttttttaatcatctgaacatgctatgccgttgtcttggcattgctttgatcccagatgtctcagttttaaagagcacctacactaagtggcaaggagaaattagaattatccatattgatgatgaaaaataaacctcagagggcttccaattgcaccctaattcttctcccttaggatattgagagagtgaggtgtagaatttaaagttaaaaaattttacatcactttacttaataattgaaagttacttggctttggcccttggcatgatttaaatcacaatggatttgagagatgctttgtcattgacttaattttcagggttttaactcattcagtaagttggcttggcagccctaagcagcattagtattttgtgtgacattttcaaaatatcctttgaacctatggtaatccctaaggcagccatgttctaaaactcagagaaggacctccccaggggcttgaaatacctgtgtttcctcccctcaccgacaaccccctaccctgctccccatagcaatgttttgaggttgtgtgatctggatctgggttgaactcctgcagcgttttaaaccttttgtttctttcttctttaataacaacagtgtttcttaccctggtcatctattgagaagtgtaggtgaaagtaagcatcaacagaatggtgattttgaatatgggaatgggttcttgggagccactgatgtacctatagggactggggatatgattggtagttctagaatgacgttgcagttgctctatacatgacccatcacgtggaagatcctgacctcagcagcacacagcaagcatgtaatagctgcagagaataatgctgagcactagtcaactggtaagcattacagactcccctgcttctctctcccatgggtcaactggtgttgaataacagggagactagtactttggacatttttacctactgaagttgactcatgctgttcctttagaaggctaataaatttttggtgattaactgaataaattaacaacaggctaagagaataattacagacctatttaggaaatctagttcttggttttgcttggagattcttgccagaactttaccttgtaagttagatatttttacctgttgcttctcagaaaaacctacaagcatactcttaggtttataccttctatccctaacaacaacaaaaacattaactgtaaactgcctcctgttatctgagggtaaagtcgtaaaaatcaaagaggaattttgaggagaaagtcttggtaacagaaaatactaattagttgtctgtgttgtgagatgtgttgcttgagagtgtctgagcttcagagaatgtataatttccctccttgatgtccacaaggagcttctaggatactttattaaaagacgagtaatcagttattattcttcgtaggtatatctcaaactgcagctttaaacagaatcaactagagggctttgttacaatacagattgctggactccactcctggtggtatggtaggtctggaaaagggcctgagaattaaaatttttaggtcctccagtgatgtctaggttaccggtccgggaaccacccattaagaatcactgttgtatctggtcctctgcctctttctgcacatcttatatccatgcagcaggtatgaaaatgagctccccaaaagcattcaccttcactgttgacctgattattatataattataattggatctcaaccttttaaaaggccaatcgtatctgaactacatattaattataaatcttagtgaaagctctattatattatctcaatttttttttcttttgagatggagtctcactctgttgcccaggctggaatgcactggtgtgatcttggctcactgcaacctcgtctcctgggttcaagcgattctcatgccttagcctcctgagtagctgggattatagatgtccaccaccacgcccagctaatttttgtacttttattagagtcggggtttcgccatattggccaggctggtttcaaactcctaacctcaggtgatccgcctgccttggcctcccaaagtgctgggattacaggtgtaagccactgcgcccggcaattatcctgatatttgatcctgaaaaatcttgcttgaacttgaaacttgtcctagaatgtctttgaaaagttcatattccgataagtgtattacattctacaacaattatgctaaaaggttacttcacagaaaattatatccacactcatgatagaatcatttggaagtttaaaaaatatggtcatggttggactccatccaagactgattgaatatgaccctctgggattgggcaccaagtaatatacaattttgaaaaatttccaagggattttaatgggcagctaggtcatgaaccactgcgataggccttggagagggaggggagcagcagggctctggtaagtcctttacacttgctttaacctgctgctctttccccttcccactgttaaactcccctgcacctctacgtcactcttctttacaggctggctagcgtcatcacattgtaggtcgttttctgtgggcttaggaaaacagtccaacagactgttaccctagtgcgtgcaatgaaaggcctttattcttagggttcaaattattttacaacgaaattgtttagtttggagcctagccagtttcatctcttctatactccaggttgatcttctgttttagatggtgttcctcactctgccttcttcacctgaataaaggaaaggcaggcaatgtttccagagctcctgagccacccttagtgctggaggcaggtttaggaaagagctggctccctcattgctaaacagaattaatgttgttcaatcactttattctggctctgtgaaataatacacaggaggaattgctgctttatgactttaatctgataaactacctgctctggtgtgttacattctgtgtgtgtttctctgccaccactgcagaataatctcagccttatgtgtagcaactagaatgcaaggttcaaaactcaaaccaagccttgatgcagacgtcaaataagaactactttagaatgctctgtgataatgctaggcacttagcatgactgctggggctcctaaaaggagccaggaagcagcagagcctgagaatcctataacatttccttttgagcttgggcctgaagcagccaaatgctgtaaccaaataaaagccagtttaccttttgcttttcttatgtcttcttttcttgttctcgtcttataaattatgttcacacttttccttttttcttttccattcatgcctttcctccgttttctctgtactccatgcatctgccgcctgtctgcttgcttggtttttcttctgtgttctctcagcttttcacttttggaagagtcaggaatcttgtatattttgagaattagcgaaacatcgtgggtatttatccaaagtggaccttgtacagtctcttttatgctcgtttttaatctcaccaatttctagaatctcactaatttctaggtttgttaagggacaacatggtgtattgctggagatcaagacacaaagagtaacagagcctcagagctcattaatggtggtctgaaacaaggaaaggagaattaaaataatgtccttaacccaggacataagagatacagatagagagatggcaaaatccatggcatatctgtgacggttttctttttttgtagaaaatatcataaatagatcttagaactctgatcttctgatttttcttaacacagtactctagggagaggccactagacaagatgaatcccatcactgttagtgggagcttagagggaattttaggtgagggaaaatacggagataaatgccatcttttgagataggtcttttgattcagtgttgaagatttgtgtcaagagactcccaaaccataatagatattgcaggccttccctttactgcctgttaacccaggcatgtgacaagagcaagatttctagagattgccatagaggaagaataatttcagtgactttgggaaagcctgaagactgatttagggtgaaaggcacatgtcattaaagagtttcattatagattgctggttttattaggaggtaagtggttggagacattcgtttcctggaatcatgtaggacatttaaagtgttgaatgctatatacaacaccccagaggtgaagaagatgtttatcaatttaggtgcacagatgtcagtctgattattgggaagagggtgaagaggtttgacagtatcagagtatggacacatttgagcagcagcagctcattgtcctagaacgaattgcctcctggccgtgatttattgacatagctgatggagggactcagcagaagccaccatttatctgtttcttcagttgaccattggaaagccttacaaaattatgtgcgtgagaaatgtcaaagtgacagatttgggttcaaaagattgtacacttttatacatccaccctttgcccttctttttggacttgagtattttagacaaaactaacattttcttcagcttagtataaacagatttctgctcagattagctgagaaggcatacaccatgttatccttttatggatgagtgatacatgtgatgtctttgtcaaataggaattgccctctgccttgtgtgtttggagagatgactggccacacctctgaagcaatcagctgtggccaaattaacataatatggtacctgtacataaaactaaatatagaacaattttatctttttgtagtaaggatactatattccgaagaattcatgtaagttgaattatttaaagtggatttagggacattcattgtaaagttaatctttggtaaatccttgtgtggtgattttttttctctcctcttttgcatccccatttgaaagcccacaatttaatctatttgggtaaggtagattcttatgtgattaaatcactccagtttatacgcattgaggagtaaagtcaccagactaaactcctcaggaacaatgacagagagttttgccatgggtgtttgggaaaactgcatttactttctgcacacttaaactctgtttcagtccacatatttgcacgcctaaaaaaattaacaaattttcacagtaacaatgatactagcgtttacttattgctcaaaagaggtattgaccgctatagtgtgtgtgaagttggaaactttaggatgatagccatagtttgtacttcgagctcactctagtgggggaaatagacaagaaaacccataattagtacacagtaaatgttaggtatatttctcatgtgaatgtgtgcagtatggtaactgctcgttagaggggaccctatagaattgattacctataagagaccttgactgcgcttgggatagttaaggaaggcttcatgaaatagcgacaaatcagggttagctcctggcctgggatgatggctaaaaggactaaagggcgagtctttgcctcagtttcttatttgaaaatgaggataataataatccaactttatagagattattatgaggattctgtgaaacaaatgcacatagatagttaggcagtcctggtaattgggaagacatcaataatgatgtaagttatccatgtccctagtcctttatttcttacaacaacaatcctttcaagacagtagtactttccctattttgaagatgctcagagaggttaatttgcccaaggttacccagctagaacttggtagggttcagctttgaatctagacgtctctctcctggttaccttttgttctctttatgctactcagggggcccaaaatgattccagctgcttcctgcttcattatccccctaagtgccccactgagaggagtctacaattgcctgcccctcctctccctgcctcctggtcttgccatgagtcactgctgagccatttgtgtcagagaggaaaatgggggcttgctattcacatgtagcaatttgctatgtgttcttgcttatttgccagggacaccagcagagaagcgttcatcaagaggcgtcatgtttgttaagggaccacatggtgtattttaaaagctcttaactctctctggtatcatcgattatgctttagcataagaaataaagtgacactgagcctcttattaataatacacgttttccatttaactttgactggttaaatctggcataaaatgcagacttgcaaaccagcctccctgggatgtgtagcttctcttaggctatttatgatgcggatctctgttgagcagcagcctctgcctgcagctaaggctctggactagatgttctcttttccttttctctcttgatggcatggattgttttgtttcacaaggctcatgttctagatgggattgtagctggtctactacaagctggtctagttgggattgtagattggtatggataaatactgaaatgggagctggtatctgacaactggaggggttatatatgtgcccccatattctgatcaagctttggcattttgtgcatttggcaaaagtcagtggtcaatatttgaagtttgcatgaagttagaagaattttgggctctgaatatgagatgacttagagataatatgtttattttacagataaagaatcaggcctaaagcgattgatgatgatgatgatgatgatagcagaatctctaacaatggttaagccagacactgttcagagtgatttttgtgttaacttgcttgatcttcacaatgactctgtcaggtagacagtattattatccctgttttacaagtgaggaaactgaggcacagagagtttcagtcatttgcccaagccacatagctggcaggtgatagagctggggtttgtacccaggctatctggatccatcaaaacctttgctatctgtgtatcactacactgtagcttgtccagagttacaaagctgggcaggaatagtccaggacccaaatcccagtcttttgttggctgaactatatttgttatttaaagattcttttagcagtggaactcttctttaaatggagatattactagatagcacaaccaaataaaaaaagtggaaacttagctgctgtggtttaagtgggataggccaggcattgaccatgcattccctttattcagcccttgctgtggcttctgagaaagccacatggagcatagttttattttatttattttaatttttagtccctacaacaagactcacagtagggatatgattttaaaccctggctctagttagggatatgagctccagattgctctcttttgggtcacaattaaaatcctaaccggcaacagatatttttggtcagatctggtcattctctctgcctccgtacccattgggggcaaactatgaagcttttgtagctgcattattgtagatttgcaggatttctgttcgtaatcagaatcgggtatgtgttagaaaaaggccttcctgagtgtatgaacccctttgcctgctgacagtctctgggctggagttaacattaacatctgcatgcccagaggacagtgaattgctaacttttcactggctttctttttgcttggacattttacagtgctccagggtcatcattctgggcagtacttaccttgtaagtacctgattttggctcttttctcactcactagtctgtgatctagtcttctctctgtgtctgcagagttcagtcccatttctggagcaaagcagtagctcagtaaatgtcagtggagttttttgaatcactttttattattccagattataggcatatatgtatagatcaagtaggctgaatatgacttaatccccaagtttcttctataataggaccttattttatctctccaagtaatggaataaagggatggaagctggtctagttggggttgtagatttataaacaagacattaatctgaagcttatattcttttagagagttacaagaaaacccaagatctccccccatccccaattaaacactttgttctttgtaaggatagtagagtagtaggagtgggggtattcaggaaagcaggtcttaaggcagaagaatcacatcaacatcccaagttctattcctcactgcctcacgaatggtctgctagccacctgcagttgttgttgttgttgttgtcgtgttttgtaggtaaaggaaatatggcaggagagtgaagtataagaggtccaggagcttggtggaggtggaggagaggggggatggggaaagataaagaggcagataagaaacaggaatcattgtagaccagtggttttcagagtgtggtccctggaccaacagcttcagtgtcagctgggaacttattagaaaggcaaatttgctggtttcactctagacccagtgagtcaggaactctgatgggggtgggcagcgtctttgaaaacctttacttcactaactttttccccctctatcttaaatattcccaattgttttaggttttagttgattcccatattatacttcaattgtgtgtcagtgagtaggtctgtattaaaggagaactgttgaggaaacataaagaaatctctttgtattccaaaaagcgtttctcagagttaaattacatgttttgttagtgtctgttgcttttgttcagattaagctctgaaacaaaattaagattctcgtcaaggcttgagcttattaatagctgtttcatttgtttagcgctaatttaaaatgtctgatatctgtagaggaagtgctttataaaaacacatacttgttaagtgttccactaggagaagcactgtgaagtccaaaggatgtggagattaggcaaataactgtggttttgttgagctctcttcagtgtaatatatgtgtgggtgggataagaacactgggcttcacaggtcgaagaggcttccactggtcagatttcagacaatttgtgcattcaagagaattactgcaactgagtgtaaaacactgaacaaataaaaattcttgaactcatagtgatgagagatggggtgggaggagagaaagagacagacagacactctgggcatcattggaggtgactatgatgtcaacttctcattctataaattgtaaattacatgaaacaaacaccctgtctttactgagaaactgtagttctttcatgattggtaagagaaacctctgctttacaaatggatgctaccaaataaaatatagaaggatacagaatatcagcatttgcatcctgcagtgaaaatttgaacaggcaagtgccgtcaatgcaaaactagttgaaagcatgttggggaacagaataatcttattagagaataacccacaaattaccagcaaaggggaaagtatacccttaacaatggcggtcaccaccttaacaaagtggttcaacttagcatcacagtggtaggatagcctgacagtaggagcttcctgatgtgacgaactacacagcatcaccaacaatttatgccaaaaatgtttaacctgaatctaaccaggtgtattaggctgttcttgcatggctatagagaaatgactgacactgagtaatttataaggaaaagaagtttaattggctcatggttttgcaggctttgcaggaagcatggtgctggcatctgctcagcttctagaaggaggagaggggttggcacatcacatgacgaaagcaggagcaagcaagagagagtgtgggggaggtgccacatacttttaaatgaccagatctttcaagaactcactatcacaaagacagcaccaagccatgaaggatccactctcatgatccaaacacctcccaccaccagcattggggattacaattcaacatcaggtttgggcagggacagatatccaaactataacacaaggtttacagaaaatagaagggtttgaaaaacaaattaatccacaccaggaagaaacagaccaaaaatgtgggtcattctcaagaaaactggtatgtctgatcttttcaaaaagccagtgtcgtgaaacaaattgctggtgggtattactccggattacaagagactaagggaacataacagtcaaattcagtgtacaaatcttgatgggatctggcttaaaaattataactgctgtaaaagatgtttgaggcagttgtagaaatttgaatatggactggctatcagataacattaggaacttaatgtcttaggtgtgatagtattttggttgtgttaggaaaatatctttattcttaggagttgcttattaagtatttcatgaaagtatcatatctgcaattcactttcacatggttccatgagagagacgagtgcatagataaggtgattttggcaaagttttaacaattttgaatctaaatagtaggcatatgggtgtttgttttatatttatatttatattcagcatagagaaagctgtgaattcaggaaaagtttatatgtaatttctgagatttctagctcatgcatgcatttctgtttgagaatgccttatctagaattttttatcaagaaatctgaatggtgtttaagaatatcttatctagaaatatgttggcatcttaatattatggtttggtagataaaatggatttttttaaaaaaagacttgcaaagaagtggatgaaatgctaatataagaaaattagattttataaggaacatgtgaccagataaacttgtcctaattattgtgagtctctttaaagcacataccttaggacattgtgtgttgacgcttttactgttcataacatattctttaagaattctctcagagccttaagatgatttgtttttgagaaacatctgaagtctcctgtagcttattctgatgttatgaagtaagtgactaaattttgatcacagaagtgtgtgacagggaagtagtgggatattctttgcccctctttgtgtcctgtgatgctggtggaaatttcaaaggaagagtttcaaaagtagtttactttgttcaaactctctagccctaaaccatcagtgacaccagtgagtgtttcttattttacctatttgggtgtgttagatgtattttcactgggactattcttttggtcagagagcctaaagttaagtgtttgagcttctggtcctgtgatctcagcaactggacttgattcaggtgctttgactcaagggcacagtggtagcatcaccaaaaatagatgaatggcagcagatccctaatggctggctctctgctggttgcccgtctcagctcaggacttccgagaggtataaaacctcactgatagccaggcataatggctagggtttactcagagatgctgggggcttgagtgtagtattgctctgttgtaggctgataatggagtatgtgccaggtgggggcaggatggtatccaggcagtgtgggcaaagggctgcagttagtcccttgttacactcagtgacaggtgactctgagctgtctggaagtaagataaagtgattcaaggataggatccatacctgaaagagaggtattcagaatagcatttgaagtcaggtagacttcagctcttccaatggacctgcaagaggtggtcaggaaatatctcatagatgaattaaagaagtgttacatgaaaatgtaaaggggcaaaccaaataaaatgggttcattaggtcccaggactagtggaggggcattcatgttggaatggagagtagtgagaattggggaggggttgcataggggcttgttcttagggcagagtttttcaacaacaggtatatataagaggtcaaaatttaggaagtctgttagagaagattataaactccatgaggacaggagacatgtctgcattgttcaacactggatacttgatataatgcctggaaaatagtagatgtgcagtataaatttccgttgaatgagtaaaaatgttaagtggcgaataaaggaatgcatggggatgatacagacaaagcagtaatctgtggtggttgatggctgacctggttgtagagtaccagggggaatgtgaatattttagatttcctcagaggctagtttctgagatgttttgtttaccagtgtggtaaccttctcatggccctagctcaaatggtaatcaactagtctttgcagcacaactgtgaggtaaacatgctgtgtccattttagagaagaggaaactgagattcagagagatgaaggaatttgcatgaaggtccacaactaagaagataagatgtgaaactagatatttcagctcttgaatacaatcttctttttacttgagcgctcaatgctggggacagttctgcttttcaagtggcctgataaatagtatctttgtatcatgtgagagttattaagactgtgatagaaataaataaggaaaaattcacataccagccaatcctcgttactctgcttattcccctattcatcatttggctgattgaatactgaagatgataaagctgaatcggtagagcaatgtgtgattaaaaaaaaatctgctattccacttaatgggctacagttattagaaagaaatagaaaccccagttaatgttagtatgggctacttatttaggaaaggagatttttaaatgaaataagcctttcctttttattatattgctggagacagttttcatttttgcccacctggtacttaaatggttattgctataaggaaaccagtcttactgataaccgaatgaaataaattaaacagacacatgcaaacaaatccaaaatgtgcctgagaaagatgtggtcttctagctttcagtcattcagtgagacatttggcagagatgggtgcagcagataaaactgtcatggttttcagaagtcattccaagacaccagagaggaaacatgacagacactggaaagagaccctctttcagatatgagtaatatatattttatactcatattaatatttcattggagagaaggtcaaaatctacatttaaatggaaatatttaaaaagcagaagcataatatttgactaagtgaaacactcagggtttttcaagaacacaagctgcacccctgggacctcagctctctagatctgttgtttcttagagcacggtagaatgtttgaattcctttagttttatcggtagatcttagccctggcatttaggaatcttaatccctctactccccttccatttgaccccgaattgtgttacatactacctaacagtgtgttcagtgcacagtatggcctctctcagtcctataaaattatttaaatttctaaaaattcatttttctggtcctgtgaaatggacataataggattgtggagatggacataaataagatgctttcaattatgagtaatggaaaacccatctaacaaagtatggtggcaagaagatgggaataggaggcccagggtttattcagaggctgtgttcatccttcgtttccctctgctattcaaagtgtgttagaattcaccttcaggcttctgacctcatgattataagatggctgccattgtttcagaataatttcttcatggcatctaaaacaagaagatgggatgccaggagcaaaagaatcttcctggtacctttttcctcctttttatcagagaagatgatttttcctcaaagcctacagaagacttgcctttatgtctcattgaccagacttgggtcacattaccactccgttatccctgccctcaaactggcaaagagaatcaagaagaccttgattggcgtagatcactcatgcttgatttcctgaggctcgtctcattgcctctctcagaaacttggggctctatttttattagctaagaagggcaatggttattgtctgccacagtgatgctcttgtgtgaagtaaaggtgcataaaatgcatgtcttccctggactttagtgcatccttggtttgtaagtgactacgattacatgaatcagaaataaatcaggaaaaggaaagttggtaattttggcctattcctgcagaaatcatagcagggaggggagtgtttgtgaacgaagggagggtccagttctctaaagctgtgctggtgaactaccactgcatagggtggccctctgctgaccctagagcaagctggaggtgagacgagtttgtcaggacatcccagattctttcttctgtactctttcctcttctctgttttccaccaatccaatcaaaggcagtgctgatgtagtcagcacaactcctgggatgcaggtgcctggggctgcaattctgttctgacactgactgtggacattctggttctgggcagccacttgaggtaacaataatgatacacagttcctgcttttaagaggttcatgatgaggagcttcactgctcccctgttgctttatgacaggatgaggattcagactaaatgaccacttccctcttttctcactctcaagttttatgatttctttcaagtttatttgggattttttttttttggtctgtgccttttgttaatatattctacatgcattttgcttctaggcatattgatattcacaaagtttaccactgacagttgtagtctgagagtgtacagaaaaaaacgtagttgaccactctatgattattctggactctgtgactctcttaatgcaagccaagaccacattagcctttttggcagtcttattactttgtggcttttgttgggtttgcagtcatccagaatttctaagaacaatatttggaaggtggctttgcagagacttgagccactgaacttctcttgtcatgtgcttcctttacttcactcctttctttaatatatgcctggcattgggcccagaatccataatacgatattcataataaataccaacatcttttgagcactccctatgtgtcgggtgttacactaagtgctttacaggtattgtttcatttaatccccacagcaactttcttcccctttttctggagacagagtctccctctgtcgcccaggctggagtgcagtggcacaatcttggctcactacaatctccacctcttgggttcaagtaattctcatgcctcagccttctgagtagctgggattacaggtgtgtgccaccatgtccagctaatttttgtgtttttagtagagacagggtttcaccatgttggccaggctggtctcaaactcctggcctcaagtgatccgcctgccttggcctccaaagtgctgggattacaggcatgagccaccacacccggcccccacatcagctttctaatctaggtgttaataattcccattttacagatgagaaaacaatatggagcaagctaagtcatttgagcaaagttatatagtagcaggtggttgaggcaggactagaatctaggcaatctagtagcacagcccaggctcttaaccttgaaatgcaccttaaggcattttataaatttgtcttactttccttaatttttcccctctcccctaccccccagtacatgcataattgctttaaatattattacttgtcctgtctttcaagctggcttaatagaacatacgacgtagagatcaaaagttacagagtactaaagccgtagaataagagtttctttattcattaattcatcctttaattcctgattgactcagttcctgaggtattacactgagcgtgtggatagagagaggaaaaagacctagcattctgcctttgaggagttcacaaagtcatatggtaaatggtgggcctgagattcttgtcccgcagcaaattctgtcattctttgtagatcatggggaaaactttgcattttgctctaagtgtgctgagttcagagtgtaacatctactttgctccgccatagcctttaaaacaggattcatctctgagcctcagcaccagtacatctctgggaatctacctggccttcttcattatgtcctgcttccctgacctacatttttttcctttttcagattgatttgttgttcaaaaggccggtgcccctggaatgaggacctacaagcttacttttatactagaaaataaaagactagaagaatcaagcctttgctcagatcatactttgtgaggtgggcaagagtagaaagccgaacacttgaacgtgagagcgaggagggagccacagatgaaggttgaggacagagaaagggaagctggagggctctaaacttgcagaggcctgacctggcacttcatctgtcgcctctgaaaacagctctgctcttgctcttgctctattctcatccaagtactaggcgatcctccttttatcacttcccagtttcttcctttagtttcctctaaggtcattcctcctttgcactggatttactttggagtaacagttgttggtgggaggttctgattctgcagagagagaaactgaggcatgggatagagaacagccatctgtactttgtcctgtaagtcattagagactggcagagccttgtcatagatcccgtggtttgctgtaagccacaggtggccctcataccctcataggaatagggaccttcttccttccttaacatgattggattttgtttttacctgaaaatacgagctacttctaacagaaggaaagacgattgcagcctgtactgcattgcccctatctgtaaccccattaagaggttgtaaatagtactataatgatatctcagtcatttgttttgatgtatccaggcttttaataaatcagccgcagcttgcttaataggaatatgagagcagagcacgttgctgccagcagctgctagtaaattataaagcattcatctgttttacaagggaattaaatgtttgttctctttaaagggttttgactaaacaagggtgtgtgcgtgtgtgtttgtgtgtgtgtgcacacacacagtggcttcctgcccatgccctcccaggtacagtagcaacctcaggttcctggggaacacctgtaaccaaagccatatgaattagagtgcccccaggtaaaccctgtcattattggtctctgctctgcgtgcatctctaaagcaatatttgttggattacatttgtcttccacgtcaaaggattctgtgaaatacaagtcccatttcccgctttctcctttttttcttaagactgtctagggaaggagctttagataaactatacatccagcacaacattcaattgtctgcacaattgagttagcctactttatttgacttttatgtttacatttgaagtggactccccccgccccccgccaccaccttttcgacacccttggttttattgactaaataatcttcagaagacaagacatcagagttggtgcttttggtggaaattaaaccacagcaggtgtttcaagaccagctttggcaacactgcaagaccctgattctacaaaaataaaaaaaattagccagttgtggtggcgtgcgcctgtagtcccagctactggggaagctgaggcaagagcatcccctgagttcaggagtttgaggctgcagtgagctatgatcatatgactgcaccccagcctgggtgaaagagcaagattgtccaaaacaaaacaacaagacgtggggtccagctaaccaatattcaagagctgttggctacttatcttgtgaccttcaacaagttatataggtttttaaaatctattactttattttttgttacttttaaatttggaaataattgcagatttataggaggttgccaaaataatatagagagatccagggtgaccttcacctagtacaatatatgtgtatagctctatgtcgttctttgacatgtgtacattatgtaaccatcactgcagtaaaagcacagaactgtttcatcatcacgaagatctccctattgcttcctttttataacaacttctaccaccttccctatcctcccctccactgtcttacctcctggcaagtactaatctgccttccatctttataaattttattcatttaaaaattatataaatgttattacacatttgtatttatataaaatataaaatatatcacataaatatgaaaatatgaaatatatacattaaatcatacagtacatggctttttgaggttgactttttaaactcactgtaatgctatccatcaaccttgttgcttgcttttatgaatgtttattctttattactacctagtagtattccatggtgtggacacatcagagtttgtttaatcattcgcttattgaggaacattttgattctttttacttttgggctattataaataaagctgctaggaacaattatttacaggtgttttgtgtggaagtaaattttcatttctgtgggataaacactcaggattgtaattgctgagttttatagtgtttggtttttaagaaatgtcagacttggctgggcgcggtggctcacacctgtaatcccagcactttgggaggccgaggcgggtggatcacctgaggtcaggagattgagaccagcctggccaacatggtgaaaccccatctctactaaaaatacaaaaataaattagccgggcgtagtggcatgcgcctgtagtcccagctactcgggaggctgaggaaggagaatagcttgaacccaggaggcagaggttgcagtgagctgagattgcaccagtgtactccagtgcaacagggtgacactctgtctcaaaaaaacaaaaacaaaaacaaaaacaaaaaaacccggaggttgcagtgagcccggatcatgctactgcactccagcctgggcaacagagcgaaactctgtctcaaaaaaaaaaaaaaaaaaaaaaaaaaaaaaaaaaaaagtcagacttttccagagtgactgtaccattgtacattcccagcagcagtgtatgagggaatcagcatccttgccaggatttggaattgttgctgttttttaatatggctgttctgataggtgtgtaatgatatctcattgtgattaatttggatttccctaatggttagtgatggcagacatttttatgtgcttatttgccatttgtatgtcctctttgatgaaatgtctgttcatgtcttttgcccattcttttggattatttgacttttactgttaagttttgaaatgttctttatgtattctagatatcagtatcttgtctgatgtatggtttgcaaatattttctcagtctggagcttggcttttcattattataacaggatgctttgcagagcaaaggtttttaattttggtgaggtcaaatttatcagcattttattttatggagtatgcttttgatgtcatgtctaagaaactcttcaccaaacccataggtcctgaagattggctcctatgtcttcatcagaagcttaagctttacattttacatttaaatgtatgacccattttaaattaagttttgtgtaagtatgaggtttaggttgaggcttatttattttttgcctatgaataatctaattgcttcaacactgtttaaaaggcatttcttctaacattgaattgcttttggatcgttgtcaaatatcagttggccatagttttgtgggactgtttctaggttctctattctgtccgttgatctgcgtgtctgtcccttcgccagtcccttactgtattgattacagtataactatttagtaagttttgaaatcatatagagtgattcctcttactgtattcttttttgttaatagtttcaggtattctagtttctttccatgtaaatttttagaacaatcttgaacgtatttacaaaaattttgcagggattttgataggaattatgatgaatacttttatttttatgttttgtagagacagtgtctcgccatgttgctcaggctggtcttaaacacctggacacaagcaatccccccaccttcgcctcccaaagtgccaggattacaggcgtaagccactgcgcctggcccatatgtgaaatctgcatatcaattttgggagatttgatatctttgctatactgaactttcccatccatgaacactatatgcctttccttttatttagatcatctttgatttctttccatcagcaatttgtagtttttagcatacaggtcctatacatcttttgttagatttgcatctaaatatttcatttttctgagacattatacataacattgtaattttgattttgcttttcctgtgttcattgttagtatattgaaatacaatttgtttttgcatgttggtcttcaactttgcagagttgacttctaggagtttttatttagattttttgggatttttgtaagcatatcatctatacgagcatgtcatctataaacagggacagttttattatttactttctgatataccttttccttttattgccttattatgctggttggagcttcagtactatgctgaatagtggtagtgagagtggacatgcttgtcttgttccaaatctgaagtgaacaagcattaggtctttccctactaaatttgatgttagttgtaggtttttgggtagttgttctttgaagctgaggaaattcctttctattcttggtttttataaatatgtattgaatgcttttttgcatcaactatgatggattatgttgattggtttttgaatattgaaccagctttgcatccctggaataaatcccatttggtcaggatgtataattctttttatatattgctaaattttgtttactaatattttgttaaggacttttgtgtttataagaggtagtatgtgattttttttttctttgctggtatttttagggtaatagtagcttcataaaaattggaaagtgtctgctttccctgttttcttttcttttttttcgagacagaatctcactctggagtgagattcagattcagattcctaggctggagtgcagcggctcaatctctgctcactgcaacctccgcctcctgggctcaagcgattctcctgcctcagcctcctgagtagctgggattacaggtgcctgccaccatgcccggctaatttttgtatttttagtagagacagggtttcaccatgttggccaggctggtcttgaactcctgacctcagatgatccatccatctcagcctcccaaagtgctgggattataggtgtgagccaccgtgcccggcccctgcttttctaatgttatcatttattgctaaaagtttaccgttagtactgcttgtgtcccctaaacttggtatgttgtaatttcattttcattcagttcaggtcattgtttaagttattttgaggcttcctgtttgacccatagattatttgccagtgtgttttttagttcccaagtttttttagattttcctgttatctttctgttatttatgtctgcttttctttcattgtggtcagagaatacactgtatatgatttcagttcttttaaatttgctaaggtttgtattatatcccaggatatggtctatgttatttgttctgaggtcatttaaaaaaaaatgtggcttatgctttgttaagtgtagtgtgctataaatgtcagttagatcctagcctgttgatggcattgttgaaatcttttacatttgctgattttctgtctagttgctctatcaattaattgttgataaaggggcattttagtctccaactaccttttgtctatttctcttttcagttctgtcagtgtttgcttcacactttacaactccatttttttgccacaaatacatttgggattactatatttgcttgattgattgacttacatatcatttttaatgtccctctctgtttctactaattttctatgttctgaagtctacttattttattcatgtaggtactcctgttttcttttgactgttttcattgtatatatttttcatatttttactttttacatatatttatcattatacttgaagtgagtttatggatagcatatagttcatgcttttttattcattcaaccaatctgtattttaattggtatatttagtcactgtacctttaatgaaattattggtgtgttagaagacccaggcagctcatcactttgaagttccttgcatcctaaggtccctagcagttctgcctgttctctctaccttcaagaatcttttaatgttcatgttatatatataacacccaggaattgttttactgtacttagcagaaatgataggaaaagtacatctgttccatctttctggaactgcttctttacttttaaaattaaaaaaaattattgatacacctataccacaatattgctgtaagtgagatgaaagtgaaaaaggattcaacatttaaattctatttggacatcagttattatatctaagtgatatatgaaatcatgttgctctagaacaatattaacagattttatgaggttcccttataggaatgaaaatttatacgtgtactctttctttctctttgacaccactctacccttttctccttctctaacatattccattaagaaattttactcaaacttatgctttgcagttggaataccctaataccgattataagtcctgaatcatttattaagtaccttgtaattgcccagcactgtgctaccaatgcctttcagtgactttctaaattcaccctgttaggtataattatcttactgtgtagctgaggaaacagaggcttagagaagtcaagtgatttgctaaggtcacttagctagggagtgttaaaactgggacttgaatacaggtcttagagtttaaagttcatgctcttaacctttatgttttacttcctccctgtattctcttgtacttcatcaacctgaattctttagagctttttgatctgttgggacctagtttgaattcttaagcattttattatttttatttgcttcaatgaaaggtaaaagatataacctagattttatccattgctagtttcttttagtgccatagtggttttatctgtcagcgtgtctgtgtgtttcttaatgttcctagcaaaatttaagatgtgatctagtaactgtattcttccaattgattcatctttagtgtcactttaattttatttttgaaaaattaacgttatcttctcatttctctgttggagtgtgattgagtgattaattcagcaattatttatagagcctactgtgtgataattattgtgcgagatgctggggatattcagtaattatgtgtttctttgttcttgtaattgttctgtgactttagttacatctttcttcagaatctttcaattcacaagtcatctgtaagatttcactcattttctatttctagagtgtagtccagaaaccatatgtgtttgtgggagtttggtttaattttggggaagatattgatacttctaaagttaggtacaccatggtctactgtttacttttcaatgcaaatagagactttattgatgaatgctttccttctcaagtacatgttttgagattggtgaaaatctacagaaaacaaataattttaccccttacgctgaatgctgggaaaagaaagggtcttgtctataaattaagagcattacctatgagcttcacaatgtacgtgatggacctagtctgtgtaaaatgaagattctagaagcagaagaaaatggcttcaaaagcaaatcagaggttatagttcatggacaagctaagtactaaaccaatcttattgttgtgaaattaacattttctgttttatctctgtggtatcacggaattttattattggacaggctaatagagatctgtttgagcagcctattcattttatagacaagaaacctgacacctgtagaggtaaaatgacttttaaggccttttgtgatttagcctccaaacttgaagacctgggcccttgttactgtatcctctggactgcattttagtaatattttatcatttcattatagtctcatacttacccaatattcttcctttacagggtttcagttttctcaactcaagagagtagataaggcacttaatgtagttcatttctagttggagtctgtaaaggtttatgaattgctttgttaatccacgtcactttgtatcttagctttctagactttaaatgttggttgtagtccgtataactgccagacttaacttataatgaatgccttcaggtaggtagatatttgtttgtgtgtgttccgtaaagaacaaacaaggggctaagaattatcaactcttgctgtgagggccccttagccaggcttccaccctctgcctcttcagtcttagggacttgtcaaccaacttctgcttcagggcctcagggatggtgggtggtggggaccttaggttggctaattttaccatggcatgacttccatttttaagagttattttcttggattgagacacagttagcttgcctgtggcttccccgcagtgattcttctgagtggatggaataaatcaagtttctctgtgtttcctgactaaatattgcaggttgtttgtgccattcctcactttttggattttagataattcactattctacatgcttcattttttttatgtttcctcaggtgagccccaacttttaactgagtactttagaaataggctgagtcccaaggggtcagtggaactttcttgttccacctagcataggcctgaaacagaggctcagtcttgggactccttccttcagcctggaaggaagaagtgagggagaaaggaagaaagtgatcaccaaggcaggcctggtgcctagaagctgagctttgagaagcatactttagtaacgcattttctgtgtcctctcctcagttaactcgtctcttgaatctttattattaaaaattaacacctgaactggtaatctcagttcctgcggtccctctctgtatttcaactttacatcagccactttttttagtattataaacaggagatcttttagacccctaggcttccagttttgattggccgtcaccttctagctccctcatctcattacagactaagctggatgcattaactagttgcatagtcttggacaagtcacttaagtattctcagccttagtttcctcagttgtgcagtgggtctcctcacacctactcacttaagaaataaatgaaataatgtgtgtgagagagttttctgaacaagaaaatattagctaaatatcatctttccttgttgtacccttgtttctacaggacacagttggatcagcggattcagtgcttttcctgggatctcttacaggttccctccatgcttgttgcccttgactgatggtatattggaacatttgtacacagtggccttgaactatagtgggcacttgaaatggcaacattttgtattcttctaggaactactgtttttctttgaaaagccaggaatttcacggctccagaggaggggatgcagaagctatttctttttattttcccctgttaaatcagtataatgagattctatgtgcatagtaatccttaagctctttgcctagttccttttgccctaggcaccttggagtgatggaattgtagtcagtcagacatgtgcagtgtattcacacatacacttagagggctcctcgtctgctccccctagctaagcagcccctttgaaatgtctaataaaatccctgctcttgtgcgctgcattgaaacaaagcaggctcacgcagtcctggaaatgagccctgagaggtattatttctatatgtcggtctttatttgcctgttttgacagtgtcgtacaatgagggtcctgctgctgatgcagcagaatcacaaggagccgtctttgctgtgtaaattctccctcaaaggtctggcattcgacctgcctgctaaaccctctttgaaacaatgcaatgacaaaatattttcttcttactgataataggcagattataattgctataattgcttctacctcattctctgaagggaggaaagtagggctatggaatgagtgcttaaaatttttatttatcgtcttagagatatagatggttcatttattatacagaagtttacatagcagcctctaagtgtacgttgtttctcaatagttggaattaaattcgtacttttggactactgtttattaagacattcccgggaggctgaggcaggagaatggtgtgaacctgggaggcggaggttgcagtgagctgggtttgtgccactgcactccagactgggtgacagagtgagactccgtctcaaaaaaaaaaaaaagacattcctccttggtgatgaataacacctgtgtgccaaaaggatttttctcattggctctgattaaggggatatccagccaataaccgtagcaagccttagggtgaatttttggcaatctccaggtctagtcattgccttatgggcagtctgatggcaccttgggcattgtcttattgccctgagcacaggtgttaggggcatggagtctgatgagccgtgctctgctgtctacccccagtctgttctccagaccccctaaccaaacttctcatagaggtgaccatcacaaggacctggtgtgtggctagatcagtgacaatttatgaccacttctggggaaatagctcagagtgcacgtccttcgtgtggtaggtccaaaatattatctttgtatgttcaaagtagcataagctttagttgctgctgttggtttcaggagaatcacctggatgtcagtgccttggggttattaataatggtaaaaaaccagtatgagggtggagcttagaagtagaccaagacttgtgagtcatgcactgctttttaatttgcaagctaaataggtgctaaaactcacctaccctggctgctgagatagtcactttctcctggtcctcctctattgtaaagagaagaggttggacttaatgcccttcaaggtcttttctctctgactttctgtgaaactccaaggtgagtcctaaattttgttttggtctataaatttaaatgcttcccctgctgagctgctttgggctgagaatagaatggatggaatttacaccttctctctctctctgtcccatgtgatgctttgattggctgctaacagaagggaaggtggtcagaaggcaaggaagccttggcaaagaggaagaggagtgaaagtactaaagaataggaacaactgggggtcagccctggaataaaaaagacttcacagggcagttactaggcttgcctcactctttggaatcatgagaggtttgctaggtatgtactgtaaggcccgtgtggccagagactgagtcttggatttactctttttgccctgacattgccttgtgtagcactggatatcatgtaggtactaattatttcttctttacttaacttcctggaaaccgctgcaattgtcaagtgaatagaagtgaataggactgttatattaaacattatagagaagggtccatgctcacagcatcttcatcattccaaatattgtgcttgttgaagcagagaaccttgtcaggacagtcattgtaccaacatttacgaaatgaaagcaagagctattaaccactgtataagatttgaggatattgtgctttcaaaggaagcaaagagggtttaaaattactccagtgggatatctctttagcctcacttaaggattgtttaaaaggaaatagaaataaagattgtttcaaaagaaaaagaaataaagttagaggtgaatagatggtatatgtaagagctttatgttttggtcatactaagtttattgttaagttacaacaaaaaaattgttaactatcatgtctccagttttgcaggataattttcttttaatgtattccaaaaactgacctcagaatttgatgaagtgttagacaagatgacaaacagagagactgttagtaacgggcagaagtcattagtctcagactcatattcatttgtttgtggttattgattctagtcactcctattcttatctccatccaaaaataggcattaaaccctaatctcttgtggatgtttgctttgtagatttaggagaataagaacatgtgaccatacctggttagccatctcaagatttgttatgagctagttgacttcaagagccagtgagctgggttgtgcaggatacttgttactggataattctacttcagatagatgctctagttgctctgctaaaatcctctgttctgtcaagcctgtcagagccagagtgaaaaaacaaaacaaacaaaaacaacaacaacaaaaccctagtagagtacctgaactctaaattacagagtttaaggactgaaaatgaccttgaggatccagagtaggactctcaaactcacatgttcctggggtagacaggtagcagagtgaatgaattggacaactataagcaatgggggagactgaagagacattcaaatttagaaaattttaaggacattatacctgcctgacaaagaggtgtttttttttgttgttgttgttttttgttttattttctgtctctgatgcttgaatcaggaggacaaagagctctgatgctgattcagctgcaattttgaggacccttgaccctaactatcaggttatctatttctggtttaaggatgatgacctgagttacaggtaggaaaaggcatttaaccaaggagagacagctagtgagggctggagcctggggctctgaggtgtagtctgaggttctttctctacaccatggtgatatctgaaggggaaggcaggaacacctggatttcaatcagggatttaaaaaaaactttctatttttttagagaggtataattaacatacaatcaaatgtactcatcttaagggataacttgatatattcttatgtgtgtgtcctttcatgtcaccaccacccagatcatcccaagattctccttgtgctcttttccaacatcccccacacccctgcaccggaatcacaatttaccagggaaccatggcacttttccttccacttgcagagctggtccgtctgtcactggcccagttcctcccctcacctccctctcctcagattcaattgtaaagagctatagcaaacacaagggcacatgttgcttaatttttttttcccacataacccaacagaatcttgggtttctttaaagtaagctctctaattatgccaatgccattgactcaccaagtaggatgccaggtcccacagggtgtgtccttcacagggttctgagggtactgcttcttgcaatgtcaactgctttatacaaaagcatatttaaggtcacatgatatttgccaagttattaattattcggaggctacttttcctctgaaagaacttcagatgtccgatgtcatgattttattaaatcaaagacccatatttcattgtaatggacatggcactcaaaacctgggaatcgactcattgaaaatgtagccaacacaacactgaaaacaaagcccacctcacaggcaatgcagcttccttaaaaaaaatagctgattcccaggctgaagctgttaagcagatttttatgcagggcttcaagttactaaaaaagcaggattcaatatgcctttctctttgatttgtaggagggggtgggaagtaatgctgctgctctccccttacccccttcagaagggcttttaccatattctgaaagcaatgcttgaaggacccataaatggattttggctgtctcctagtgcagggattaacatagaattatagaagtgtgctgcatggtggttgggaaaatagggaggatgccattctctttttggagggacatggtgctcccgtctcttgcctgtggatgttccctataaagcagcctgtcactgtgaaaaatgcacacactgtaccatctcacagttataaaggttaagtaagcatcttgagcagtgccccactgcttttgtactttccataatgtcagccgataaaggattattgaaaaaggcttgcaaggagataaaaggcttgcaggttgaggttaaacaattgaaattttctgttcccagtgtagtaaattaccaatggcagatttaacgtttgttaattattagagcaaagtactaaggattgttttcttttgcctaattaattacctcatctggagtggaatgttaattcagataaatgattatttcttaatacctctgaagctttccttggaatctcctagaattgccagtcctgaagtgtggtttcctcacattctggggaagataggggataggtgaccaacgtgactactctcttggcctttttcccgtctcagaagatggcaggataacttgtttagacttttggtgatggagttggtttgctgttctagttagtagaacatgagtgtgcttcctggaatcctgtgcctcataaccaagtttttgagttagtctctcgtgtggttttgaatttaacattgaacattctttttacctttggtaattctcaatttggggcacctgccgtgaacattaaagatggtatcctttggaaaggacactctagtttcttaacttgctttttacctttaagttattttacctcctgatgtctgttcagaatgctagaggcaggtttttattctttcttggatctaaactatatcacctctaatagttgtgaatagataatattcaaaaaaggtaaaatcatgactcatgcagatataaaatatccacatgtcaaaaattttacttattttaaatgagggaaccagatagatgttacaacaggtaccaaggagaaatgaaagaaccacaaatttatatggaataaaggaaatgaaaacgaacccacaaatgaacacaaaacttttgggggagggttgttcctctaggggacagaatgtatttgcatagctatagacacttttcagagttgtaaaatcgcccagtcagacacaaaggtaagtgtccctgtaggatgagaccattttctgaaaggagggccattaatctcttttgcttttttttagggtcagaaacttccccttagacagttgtgtatgaggttttaatccagttacttaggatgacattgtatcttcaaagtagattagagatgaattatgtgacttatttttctttttagaaggaagcttaaaggtgacttggggagatgggctggtagatctgggccattggaggcgagctacaacccatgtgaccagttaccctgcacagtctctactcctgataaggcacttattttatgagcacttttcataatgatatgaaaaggcagcgggattctgtctaagattatctggagtgaaagctggaggctgatattaaatggatagtcctgttttcttttggtgctgccaagctgagctgtttaaaatgatgcttggaaaaatgcctcctgagccaggaagttgtctgattagtgaagagatttccgagacgtttggctcagagactaccccatcataccacacatgttcttttccacattcacctgagtcttccaaagatacgaggactcggggtggtgatagggtgtacattcttacatacacatatgtgtatatttgtatatacagtctgtctatccatgggttctgtattagttgattcagctaaccatgcatggaaagtatttgaagaagaaaaaaaggatgtttgattctgtactgaacatgtacagacttttgtccttctcattattccctaaacaatatagtataacaaccatttacataccatttaaattatattaggtattatgtaagtaatgtacagatgatttaaaacatatgggaggatgtgagtaggttatatgcaaattttacaaagggacttgagcattcgtggattttaggatcttgggggatgctggaaccaatcccccacagatacagcgggacaactgtattcatataaatatataggccagagattggctttaggggagtctgcaaagttccataattatatgcatttttcttaggcagtattgtgtctgtcagattctcatagtctccaaaagttttatgattcttcaaaagtttaagaactgcttacagaaaccatgcccccagtaattattctgaatctatgtgttaccacgtgtatgacttagaagaagtctagatgaaggttccacctaattacagaatccactgctgtagccacagctggattgagttatgtggcagccctgccccagagctggggaggctgcgtgtgtgcccctccacacctgagtacatcctgggtgtgctgaaatgaagcccagggagatacaaagcaccataatgccattaaggccagcacccgttgggtaggggagaggctgaccatacagacttctgacttctgcgtttcattccctgctctgaaacctgtccgtctctcaggcttgcaatctgccttcctgtctctctgacagacctgtgacttgggctatggttctgataccaggaaataatgcaggggtgggagtcttagtcccaagcaaaataaatcactgctcccattagacattacaatgtttaaacccaagtacatctgtctgccttcaaaaccaagatttagagcatgtcaagcaggtgccatgcctccaataacacatactttgttccaacatttagtagattactgtgagattttaaattcaaattctcagacattcactttgtttaggaaataactgcaataaagcaaattgtctcctgttctttttttccccctacggtgcagccaagtgagagcaaatcaattcctagtcaattttttgttgctgttttcctccatgctagagaagagatgatgcagctctctcctgttgcagccctgtgctgggtgtggttccctctccttaatttgtcatctgaaagcaattttgttcaattagagattagaattaaatttcagttgtagggcttctgtgcagaggaaatgatgcattaatgaacacacagatgtcatcttgcagccatgatgcttgcagaacagtttcttcaggattcaaataataaaaggggccacagcagcaggagcattgtttactggttggcatactaagtggaggctcacatttatttgcaaaccatttatcattctgtatactgagagggagaacatactttatttaaaatatttgaaataatgactcttaaaatcggataacagaagcattaatgccaggtgccatgcagtaaattgcataatgctgttgggttggcactgacactgtgatttgtgttgctaatgatctatccaaatagatgggagttgagaataaaaagagaatattcctggaaagagacaaggcaactagtgaattaaaagtgtagtgagaaagggaaaaaatgtgtaggatcgtattttacttattggaagacccatctgctcttctgtacacacattatgtaagtttcactctctgtattacaaataacctgcagggtggataggaagttcatatatctgccttcagctgtttttttcactcacagacgtgaatgaacagaaagatttatgtcttgtgtgttggatattataggatggtaggttttttttttttttttaagggcgttgtgtatttagactgtgatattctgtgcactgctttgcttgaagtgagtgatggctgcgactaagaaggcagcaagtggggagtgggagtttggggaggtggaaaagggtttctgtgagacaatattggtttgtctggtctttgggcctgggctacacacatgccctttgacacttatggttaaagtgtttatttccgaatggtgcccagagctatgttcagtgtgtcctgagtcactgttgaatttttaaaatttggtagtctctgtgctgtccagaatttcttagatgtgttttgaatacagagggctctcagtatcaggtggcatccacgctggtcattgatgttgacagggatgaaatctcacttaaaaccctctaatttcctagttcaaggactcttccttattcctcttcccctgttgcaaaaggaccctctgatgttggttaagggttaatagttctgtccttgaaatgttttctttctgcgacatcacatttttcttttgctttatccatatcttgtgccaaggccattctctttcattctcatttcctttttaacccctgtgtgtactgcatcaagtcctattttgctgtctcttcgaatttagagacatcatcagtgcatatcatccattatacaaaaaagccagtaatagcccaatttttatttcctgtccaaatttttctcctcaacttcatatccatatctctcttccagaaattttattagaagcacaatgtatctaggataaaatgtaccctctccctaactcttccttaccttttataatggtgcttacgttttccatgtcttcctacttaaaattgtattcatgtttgtagtcttctccctgacttcactgctcatgagttctacctttttcttgtctgttataagtcctttccttttcatttcttttgctacctgccttgtccagatcttccttacacatcacctgcaagtagctgatcatcctcttaactgatctggtagttaatggtgtcttttgctcccaagcctgcctagtcctctgctcatctacttatttctgcctactactccaaagccttcattggctccccattgcccaaaaatgaattccaaacctcccagtcctggtgattaagtagttccctcccatacccaaacaacccagccctgtcttttactaacttttccttataggtgtgtgttttgttctccctgttctcccctgtatgcctttcaaaaccctgtccttgctaaagcccagcttggatgccttttcttggaaaccttccatgattgcccccctggagtgtactttgttgctctaggtataaatgactactgcacttatgttaaggcacctgtcacatactgtaggtatttaaggacctcctctctctgctggatgatcatcattttgatagcatattccttttgttttcaacagagctttttctattaattttaaatgcaatatactgttgcaagtagtagttggaaaaaatcacagagcaagcaaagttctggaatacaatttttaggtcttcctcaacattcctgtcacagtagatgatgtacacttacagcagaagacgatggttagaaaggtaagagcctagggtctgagtcagcttcaactagaatgtgagaactgagatagaaggaattatttccaccttcccggggattttctagcatagcctatgggttgtggtttgcccagcaacaccttaatctagttgcttatgtttagtaagcatttacagcctgggttagccggctggggttcaagactcttggcctttaggccagtgcttgatgcttctgtcagcctggaaaaaggacccatgtatcactcagtggttctttagccaacttgagcaagtaaagaagtctaggaggcagaggtcttctgccagcttcagcctttaggattgttagggtgatgtggggcctgctctggtgtgtctcgtaaagaggatgaaggagcagtgagaattgtgtagactagcagtatcctttcatctgctttgttgtgagccagcttaggtggtcttttctctgctattaaaggggaattctgactccttgagttgatgagatggagtttgggaggcagataggccttgaggacttggtgggagtttgtaatctgggcggcctggctgaattcatcacaagggtggatttttaaattgccttttttgctcacctactcaaattgagtcactgagcagtatacttgtagatgctttaacaagtagattatattgaatcacatttaataggaagatgactaacacaagggagttgttttatgttttaaaaactgctcacgttcctgaactgcagaagcacctgttctgttactttttaaaatatggtcgtgaatatttttccctttttggtttccccagggcagtgatgttctggttctgaggtctagtacagcatttcctttttggccttttgtccttgcttaaattctcttccaattcttcccttccaatccactgacccaggattagagtactaaaacctcacttgtttttccttatttttgttcatctaacttaagagtgcgtggcaaaaatcttcctttgtttttaactaagctcgttaccttcaccctggtttcataatgtgtcaccctccctctctccccctattttttcctcctaaattaaaccaacaggagtcatttgaaataggcgcagtgccagaattagcaaataaaaatacaggacacatagataaatttgaatctagataaacaaataattattttttagtataagtatgtctcatgcaatatttgagaatacttactctaaaaaatcatataggaaattcagatttagctgggcatcctgtattttatctagtaaccctacataggcatatatttgaaataaaaataaaattttacattaaagaaaacattataaagaagaaaaatttaagtttattgtgtgttaaatattcccaatgctttccttactgaaaaatgtaagactgtggacaaattatgaaacagtttgtgcataagatttataagttagctacctaatgaaaagcttctgttggctattggaatcagccatttatcctaggattcagctttatctctttgctaagaagatgctcctgattttgaggtgagaatatttagtgcaagcggtagaccattgttacatatgatatatcacaagcacctgtgtcaaaaacaaatgttgaagtattcaacaattttttcctcatttaaattgtgcccagctctcttagctcaatttcttctggcataaagattcttaacacaaacaattggatgatgaagacagtaaattcttgattgagcgaagtttttatccaagactagcttccctctgtcacccaggttatatgtggagtacaaactaattatgaagctaaatcttcctcagaccacataagtaagtctactccaaagcttaataaaatgattctgcaatatttgttccatgctttgctttttaccaagcctgtgcatacgttctgatttgattctcctgacagtctatgagagaacagtgatgatttgtctcctcattttataagagataaatttgaaattttgataggtgaaatggcttgcttaagatcaagcaagacttaaatcttgatcttaggccttttgggccattgctctttccactacctgtattgacttttgaatgtaagtgatttgggaattaggcagtttaggagtaattgtaccagtgttcccctctgctagcttggaagatgaagagctgttttcatacctgtgcattgtgctggaagaggtatttgcctttggttcagtgcatacctataatacacattgggtcttcttttgaggaacagctgcctcccctgtacaaacagcctttctgaatgaaggggatcagccaccgttgacctgtgagtttgaagtattgcactgttaatgtttgggcaggatttttttgaacatgtggttgtaccacagagttacgcaagcgaaatattcttggaaatgacattctgcacaaccgtagggagaaatattgggaagctggcaagagagtcaattctatcagtgtttattgagcacctataatgtgcattttgtgaatactggatgatgtggatgagaaaagatgtaagtcctactcaggagcccttcctgccacagtaccttcattagcatctcctgcctatcagtgcttgaaattcctggctcatttttgatatattttatttctgatttgaggcatcgtgtcctttattttgataaaatattatctaaatattttatatcacataaattattaaaataaaatattattttttgtttgttatgtatagtcccctaacaaagtttgaactttttgaggtcaaggatcatatatatatatatatacacacacacactcatgtacagaagaagttcttgaaaaatattggataagcaaataaatttgtggtattcttggggaatcttggattaataaatggatagcatccctcggttgttgtatacctatattcaaaggatccatgactcaatgatggggtaaggaggctaaaagaggcaaagtcaatgactgaattgaacatggcatatcatctcaaattatactgggaaacaacattattgtctacttgttaaccaaatatatgcagttgatatcattcaggccttgcacaagttccttagtgtataatcttggtccttagaatgaagtgagcagcaggtacatattcagagactcatagtttgatggcatgggaactgtatctttggagatataatagaaaaaactgtgccttatctgattaaaaatgatttcctaaaaagtacttggataattcctaattgtcccagttttcataaatgatttggaaaatgctgtttgagactgtgattgttaatatactgtggaagcctattaacttctttttagaattcaaaagcctttaatatatggggcaagagaacatggattgacaaatggataagagtaactaactttattgtaaatcactgttgatatttggtccctgcctttgttcttttgttttactttctttcctcataggactcattaccttttaacatattagtaagaccgggggaatttgttcacttttttccttgatgtataacaaatcatattgcttaagttaaagctaaagtagatatttaggttaaaaattatgtagatatttaagttaaaaatgtgaattgacttaaggaataatattaagagaacaatgtagcaaaaattgtcatatatatacatatctgtgcgtatgtgtgtgtaatatatatatatatatatgtattcacgttatatacagacatacacacagacatatgtaagtaccagggatgaaacaaaaaaaaaaaataaaacaacatgtgttaagtactgtgttagtactaaagatgacagaaaaaagtacaaccctagatccttggccagagatgcttacttgtcttacacttcttacagtcccctctttactacacgacaggttaacttaatcaggacagactgtataagttacagggcccagtgcagaatgaaagcatggagcctgttgtatagaaagtaggacaaaggtgccattaaaggtggtaaaatataaaatatttttcttctaggggatctctctcaactttttatggtgttttaaattagctgtttaatgttgctttaagtgaggaaaaattcaaattttaaattgctagcatgaattttaccattcatggttctgttgtgcaatgccagttttaaatgcagatatgagagcattcaacttgtatgtagaatcactgaatttatacagtttatgttatgcctcataggcacataatgtattttgtttttaccgcacagtggaaacactgcatgaaatgaactcagaggtttttatttcacttgttgatatgcacacatttaaccaacactctctaccttcagattacaatgagtaaggaaggactgaaagggactgtctttccctttcctcctgtgtcattttcagtgtgattggctaatacagggaagtaatatgtgtaagaaaaggtatgttaggatttcttgccattcatgtttgttttagaacactatttccagctttctgcctttaaattgaagttttgatttgaagggaaagtataggctcccaaggttgtctgtctttcctctggcttcgtcgtaaccataacacacttatagggtagtcccccctttatccatggggaatacattccaagacccctagtggatgccggaaaccacagatagtactggcccctgtatatactatgctttttcctatacgtacgtggctgtgataagtttaattagggacagtaagagagctaacaacaataacagagatttaacaacaataactaaaacaacagttattaaccacagtactaaaagctatgtgaatgtggtctctctctcaaaatatcttactgtactctactcaccctttttgtgatctgttgatctgataactgatctgagacggctactaagtgactaatggatgagtagcatctatagcgtggacatgctggacaaagggatgattcatgtttgggtgagacagagcaggacagcacagggcctcatgctattcataatgcctcaaaatttaaaactatgagttgcttatttctggaatttttcatttaatattttcagattgtagttgactatgggtgactgaaattgtgaaactggagataagggggactgctgtactctgatttttactgaactgtcacatattgcaggctcactggagttctatgttactgggacatacaaacactatgtgaatggggcagccaggaattcgctcgcgcctgttgcgtgtattttttctactcatggacatgttccactgtgttatccgacttaacttacaaaacaaagttcaaagataagattatagagcattaaaccaagtgccgagcccttctgagtgcagggccctgagcgattgcacaggtcacacacccatgaagctggctctgaccttaatagataaggaagcacagcagagacataagctgggcctgatgccctgtgttttcacactgaggaaagcatgaattatctcttacgttccttgtttgaaactcaggcttcaaaagtaggaaaggttagaacatcaatccattgtgcctttccaccttttatctgtaacttgctgaaatgttttcttcctcctcctccttttcttgtcatgttggatatgtccttaatatatcagtgtcaagtgttgtgtctgaatgtgaacctgaattctattctaagtgctgaaattaaaacagtgtttctctgtttagtttctaatgtattcggggtactagagtatctaaaacagcattttaagaggctttaacattttttgcctttttttctcccgaattatacaagtcatttttctttttctgatttgttgtctcctgagaaagtaggcctccctttttttttcttgcatgtggcagattagtatcctgtggtccattgcaaccactacagtggttggtaggaagtagaacttgtagaaggtgcagttaaaactactattaaagtagcagggaaccttctttgccctctcagatgaggaccaggaagttgactttcacatttgaggtggcacttgatgtagcctatattcttttttttttttttttttttttttttgagacagagtctcactttgtcaccctggctggagtgcagtggtgtgatcttagctcactgcaaccttagcctgccaggttcaagcgattctcctgcctcagcctcccgagtagctgggattacaggcacgcaccatcacacccagataatttttgtatttttagtagagacagggttttaccatgttggccaggctggtctcgaactcctgacctcagctgatccgcccgcctcagcctcccagagatatagtctatattctaaagagactctcttctaatcaagtggttatcatctgctaatactttgaggaaaaaagattaatgttccaggatttataagttcagagaactagcttaacagagtgcagtgcttcacagatctgtctggctgtggaatcagattgactttaggttgctgtggtagctctgcagcataggagctgggaaatttagtaaccttacttggtggttctcagcccttattggtatggttaaggaactttgaataaacacctgtagagatttgaatttagttgccgttgggtggggctcaggctttttttttttttttttgcatcccagagttagcagtcagggttgagaacactagcttatctcagaacatcaatattctcatttataagatgagagaattagactgtatgagatcgtcgtgagatctaggcagatgaacacagcacttggccagtcaatgtgagtgactgttatcgttaaccacccttactgattctttgctgagattggaagctagattggcattcatttcttaagctggaaacctgtgctgatttgttagaaatgctgcaaggaacagaaatgattatctatcctaagggaatgactcagatcttgttagaataccatgcccaacttctcacctcccagaagagtgtgtcacagaatagctggaattacacctactttatgtatgaagattatccctggaatagatacatctttgaggaagaagttgatttattcatttgtgtaatgtttattgatacttaatacctatcagcacttctagactgtggcctggaggaatccatagattggtaattggttggaaaagtgaatgtaaattataacacagaagaacaagtgttttgttaaggataatggaaactttaaagctaagtagaagatagccaagctgagaggcctgggtgggctagggaagaaggttattactggcagaggaagttgcagttttaaagagacttagaggctggacacagtgggctcatgcctgtaatctcagcaatttgggagaccagggcaggaggatcacatgagcccaggagtttaagagcagccttggcaacatagtgagaccgtgtgtcaaaaaaaaagaacaagagacgtgaagacacacttggcatgactgggaaacttaaagtagtttagcatgtctggagtatacttactccagaggtgggagtccagaagatggtgataagaaagaggttagaaccataagcagggtcccagtcatggaaggctttatttggagattgaaattgattattggatagccattgaacattgtaagcaaggaagtggcatgcttaaacttgcactttggagatgtcacaatcctacaacaggctgaaaggctggagacatggaggccacttgggatgttgttaatggaagtccagatgaggaggtctgaattaaggtagtagcagtgtagtcacagtgaggtggacaacagatggcggagattaagaaggtggaatttgtaggtgtcagccccaggcattgcatctattttttttttccaagttgtggagacggagtttatctctgtcacccaggctggagtgcagtgacgcgatctcggcttactgcaacctttgcctccctggttcaagagattctcatgcctcagcctcccaagtacctgggatcataggcatgcaccaccatgcccagctatttttgtttgtttgttttgtatttttagtacagacggggtttcaccatgtcggccaggctggtcgcgaactcttgacctcaggtgtgagccattacgtccagttgcattgcatctgtttgatgttgggtatctaggatgtacatctgtcaactcgtgatgcctccctgaaccttcgatgattatctattgactataatctacccccaaccctttttttttttccattttcatctttcactgaattcctctgtggatccattgatcacgctttgcatatttattccttctcccccaaccccattcttcctggatgagctttttgctctcttttaaaccattgcacttgactgtctaggcatttgccagtatatcaaataagtatgtatttgaaagtctaggtgagcctttcttaaatactggatgctcagtctaaggtatccattgtgtttatggaattactttctctcctgtgtatctaaatggtactagtttgatacttttctgaagataattgagaaaaagtaactttgatctttttttcttctgtggttcagaagagaaattatttgtttcttgctcctatctgagccagattgcaaatttagtgctaagatttctggcattaagaggattattattattattgttaaattgattgtctcattagattaccaacatgaggctcatgggacttaaaagatttatgcccatatcctggttccatttttgtgtagagcctgtgggatgaaaatggctcacaggtctgtttgtgacacaagtagcttgatagatggcctatggttcatgtgtagaaaatgttggcgactatagatttattttagtatcattttaggaagcacaaaagtggtgtcccaattgaaccttatggagagagcatcattactttccatcacaggttcagactttgggaccccagggctctggaaatggaactctttgaagaggtcagagcctctatgcaccctctcagtcaactcaactgcatgtagaggagggaaagaatgttgttattattcttaatattcttatagtagcgtctaatagtacattagtaaatagttattcacaaatggttgttcctattgcttagcaatttctgatttcagatttgtgttttggatatatgtgcatactgaccttctgccttttaataaatctagaattcatttgatagtacaaattaacaaaaccagttgtaataaaaatattgaattttaactttaaaaaatatgcagtgtggccaggtgtggtggctcatatctgtaatcccagcactttgggaggccgaggtgggcagttcacgcggtcaggagatcgagaccatcctaacgaacacggtgaaaccccgtctctactaaaaatacaaaaaaattagctgggtgtggtggcgtgcgcctgtacctcgggaggcagaggttgcagtgagctgagactgtgccgctgcactccagcctgggtgatggagcgagactctgtctcaaaaaaaaaaaaaaaaaaaaaaaaatatatatatatatatatatatatatatatatatgtatatataatatgtattatatatacataatgtattttatatttatatatattttgagatatatataaaatacattatatatatacataaaatattttgtgtatatatatatatatatatatatatatatatatatatatatatatatatatatatatatattttcagtgttcatataacaaatttcttttgagagctaccaaggaccagacttggtgctgtgggatatttgataggtgtgagacagtcttttcctcagagggtttgtatcctaggagtagggataatgataactgcataagccacctgattgatctggaattggatgcaacttttactacaggaattgacataaggatttagacccttttccagtacattgacctagtagtattaacaggactgtggcaactttgaacttccctaatgagaaaaacatgtgttggtgagcaggtattatcacatcttcccttgcttttctgtttaaatacagtatcctattcagataggcaaatctctgatgttttgttgagtgaagtctatgggccagatcacataatagatgatgtgtttgttggttgcccactgattagcttgggacttgttacctagaggtccatggcccttctgaagtcttcattatgttgttagtttcccaaaatgatccgctgacacttgttctaaatatggtttattttttgcagcttaatgatttacttatttgccaaatactgggatttggtttcagagagcatccttttctacctccttgggtatataggccttgatttataatgtctagttactctgtcaatgaatcagttagtgaccattttgagtgttaagagctttgagtaaagaagtgtgtgaaaagccttctgccaccaggaagcttgcttccctgtgcctagtctaaaccaaaagtcttcaaacttttttgattgtgaaccccagttggacaaatcacttagagtaagcacctcattttaaagttttatatttatactactgtactaatatatagatcagaaacataccgaattagaaagtaataaagaatgagatgcatatttatttatttacttaaacttttattttagattcaagggatacacatgcaggggtgttacctgagtatactgggtgatgctgaggcttggggtatgaatgaccccgtcacccaggtactaagcatagtacctggcagtttttcaactcttgcctcctccctcccacttctgatagtccccagtgtcttttgttgccgtctttatttctatgagtacctagtgtttagttcccacttacgggtgagaacatgcagtatttggttttcctgttactgtggtaattcgcttaggagaaaaacacatttaaatagacattataatgcagtcttacccctcagtggaacatcctacagaccactggtgtagacagaaagtgctagaggggtgcttgggagagagaaatcatccctgaggcacgtagtgaagaatgagttgtgtgcaggacatcaccagagtcatggcaggccgtggagaagatatagttggtaccatcttttggtgtaagcagcagggagccatggatcttcctaggaggagccacaaggtagaagtggccatgccatagatgcctgcatagcatagtgggctggggtagacggtggggggcatgtgtgtaaagagagaatgtgagggagacaggttggtatcctaatcctaatcccacagcagaatagaaaggcaaagaggatggtggtggcaggtagggtgaggaggtagtgaatatgtggacatttcctgcatgaccagaactgctaaggaggaagtgagtcttgaagtctgctggacaaacaatggtttgtagtaggagaaccctaaggtggagggagcggggaggggaaggactggccacatcccaaaaccttattatgtccaattttactgcagctgttttatgactgcaacatttttgttcaggaaatcgtttatttacccccacaccttttcttttagactaaatgacaagaaccagtgctcacatccagggtcaaagctaatctttgaggaggtggaaaacgcctccttgtttcattgtctctcttgaaagtggtgtctccctttcactctcctgcaggagagagatgtccaggtactgcctaagcagccccagtgaaaacggatggttcttgaggcttccagaggtcaatctggcataagaagtaaagaagaagccacatgactcggagaggcagaatttctttccttggacaggatagagcttttaattgaatccaaatcacatctctcatcctgtgaatgctggagagcagtacatttttaactaggaagagcatcaattatgtattagccacgatactaatttaccctgagtgtgtgtcttagagctggctttcatctctgcatagccactgatgtaatgccattgtgtttctatactcaaccagtcgctcttaagatagggtgtcctgctattgaaaagagtagaaagtagggattgctattgctgaggctctttctgtgttcttacagctgagggccctttgggataccaccttagggtgggagagctgttcactcaccgttgtgctttgagatgcagactggggcttgtccttttactctgatgctgctgctttatcagttatttggtattattgtgttccaggataaatctctggaaccctcagttatagatatttgagactttctgtgtgtgtgtgtgtgtgtgtgtgtgtgtgtgtgtgtttgagacagggtcttgctctgtcgcccaggctggagtgcggtggcacgatctcagctcactgcagcttccctccatcctgggctcaagtcatcctcccacttcatcatcccaagtagctgggactacaggcatgtgccaccatgcccggctattttttttttcttttttttttgtagagacgggattttgccatgttgcccaggctgatcctgacctcctgggctcaagtcatccactcacctcagcctcccaaagtggtgggattgcaggcgcgagccactgtgcccagcctgagattttgaacatttgcctccagaaaatgtaggcagtttctgtggctgcttatttcctcgccagtaatatattttgcttgttcctagagtactaaatgtaatgatgaccaaagtggactgagcatttcctagatcttgacactcttctaagcacattatatatattaacttattaaattctcacaaaaatcctatgaggtaaatactattatcatccctatgttacagatgaggaaaatgttaaataacttacctagtgagtgtagcataggctctggtgtaaaaagctgattcaaacacctgccttgccactgtgaatcacggccctcagtcctttcctgtgaaaaattgatttttattttttttgagacaaggtcttaccctgtcactcaggctggagtgcagtggtgtgatcataggttgctgcagccttgacttcccaggcttagacaattctaccatgtcagcatcctgagtaccttttaattttttagagagatgggatttccctatgttgcccagtgtattagtccattcttgcactgctacaaagaactaactgagactgggtaacttataaagaaaagaggtttaattgtctcatggttctgcaggctgtacaagaagcatggttggggaggcttcaggaaatcttcattcatggtggaaggtgaaggggaagcaggcacatcttacgtggcctgggcaggaggaagaaagtgggggtgggggtgccacacacttttaaacaactagatctcgtgagagctcactcagtatcatgagaacagcaagggggaaatccgtccccatcatccagtcacctctcaccaggccttacttccaatactggggattacaattcaacatgagattttgatggggacacaaagccaaaccatatcacccagctgggaaaatggattgttaatagtacctgcatacagaattgtggtgggcatgtgattttggcaggtgataagctcttcattagcattcactaccacagtgaacaccaccatcctcctcctcatcatcataattatctatccagaggatcatgtgagatgcttcaaacccctgactaaggcaatctcaaaggataatttgcctcaggtgtcagaattgtttagctgtacttgcctttccttgcaaatataatggcagaaaaagaggaaaatttagacattttgagccttttcgaagcgggaaatcaggtaagatattttcagatagataatttgttttctccttgtgctcttatcacttccttcctctttctctcccacctctgagaaccctggatgagggtagatgaagtagaggagagggtggtgacaatggtggtaaaagaaaaagtaaccaccaaacatgtacagaaccactccagcatttaattaaagcctgcagccctttgtcagccagaagctcctctcatggtgagagaggcagagagccttgtcactgtctctagaattatttgtataattcagcagctgtttccctcagatgcctaccacacgaggttggattataaagacgtatgagtagaatcgccaaggttcagacacttgtgttcactgttgagctgagagccacttaggctgttcttgtacaaatgcattagattatggttaagcagcttatggacataaaaacacattagaactttacagcactctataaattatagtttttgcagcattcacagccacaatgctaggtaattacattcattaatctactagtaagagcacataaagttgcctcccaaaccttactgtatgtgtcagtactcagctgggaaggagagtttttttcctctcctttttccccgtctttccctgttccattaagccttgtgtgggaagatttttgatgttacattgaggtgttccctaaaagaatccaataaacccattttttttttttaatggttaggctctggcaggaggccttgtaggtaatattttcatgttgagctgcacctagtaactatttttgtatgcatttattttctttttggaaatggacagatgtctcatttggaaagccagcaagttaaagcagttgaaaagagattaatgatagaatcagtggtaaatgctttttcaggacttctttttgcctctctctggtagcagttaacatgatggtccttttaattttggatctatcaggagtacaaagtattgctctcttcccatgccaaactttcctaaagtttccatctttccatatggtgataggaaatgcctccccccacagccctgtctcagaactttctcttatttgcatgtctcataaattacagaaggcagatttaggaagaaatgctggaactttatatggtgctagtatttcaaggagcaaattgtactttcttcgcattatttctcaggttaaatagaccaagtggaccaggcgtggtggctcacacctgtaatcccaacactttgggaggccgaggtgggtggatcacatgaggtcaggaatttgagaccagcctgccaacatggtgaaacctcatctctactaaaaatacaaaattagctgggagtggtggtgcacgcctgtaaccccagctactcaggaggctgaggcaggagaatcgcttgaaactgggagacggaagttgtagtgagctgaaatcaggccactgcactccagcctgggcaacaagagcgaaactctgtctcaaaaaaaaaaaaaaaaaaaaaaaaaaagaccaagtgataggctgggcgtgctggctcatgcctgtaatcccagcactttgggaggctgaggtgaaagaattgattgcttgctcaggagtttgagaccagcctgggcaacataatgagaccccatctcaatgtaataaataagtaaataatttttttaaaaagtgaaaagaaaaaataggccaagtaatacagccatcttaaaaataaaaacaaaaatggaatagagaagtatgttaacctgcaaccccaaggcaacactataagtcctgggtcatgctcagaccacattctaggcttctgctttcagttctgttcacatgaatgagaacatgaatgctagagccacgcaggtctgtgttgagtcctggtattgtcttttcatagctatgtgaccttgggaatattaattaatagtaataaaaataattaatttggactgaactcctaatacatcctaggcattacattaactaatttaatcctaatagctgcttcataagttaggtgatattattcgctccattttatatatgagaaaactgaagcttcacagggtattgtagtaattaaatgaggtattataaataaaatatccagtatgttgcttggcacattcaatgacactcattaaacacaatcttgaggatatatggagaatagatcccaccattgttcctccaatgccaaatgtaaccttttagaatgacagtttccctttttaatgacttaccagtcattaattgtatcagtcaggaagaggaattcctcacatttatttgtaatttatttactgcctgtaccaggaagtatcccaagcactttccacaaatttcattaaactttctattcctgtattccaggagaagaaatggaggctcataagggccaaggcatttgttcatgttcgtaaagccagaaggtgggaaagccagttctcggactcagatgtaaccgccaccaataaagagtagggatagcagtgaagtggtctattttcctggaatgaagcttctatggtgggaagtaatctaagcaactgattaaggagccagctttgtgcacttcaaagcagcctcagcttcggggtggagcatagagttccttttttttttttttttctttagcaggcaggaagatattcttattcccaaagaactgagaaatatttgagactatccatagtactcattggtgctgtaaggttagataactgctgagaagaaaactgattgctctgtgtaaatcagtatgctgatgagggaatgataaaactgcagggtagtaccagcgtcagcatcttgtttccaacccagctcttctctctcttgacaaaacagctgtcattttggattaatgttgaaatcaccagaatctgctggtcatcagagcagggccgatgccatctttgggatgaagtgtgctggcaacaagatagaaactggacatgggaaaaaggaaagtctccctcaaacatgctgccatccaaggcccagtttaaaccacaggctcaatttttgctcccaaactgatttcccgactaacccatctgctcatgcacacaccctcccaacctcacacagcaggcctggcctttatcatttcaggtcctgcagagctgttctctctcactgtggtactgatgccagttttaacagccgccatgtgtattgactcctctaccgattacaaatatatacgcgtttgccagtttgtttagtgagtggttttcataggctgtgatggggatttcactttcatgaatataatttgctgagcctgtggtgacatcaataaatccttctgggatggggaatggttgatttccctacatccagatgacatcctccagcccacttccttatgggaccaacagccaatgtcataacacatgcttctttgtgagagcatggaaggaaattgtttaaagtgtgtcatctgtgggcacagtttctaaggtagatacctgtgaggatgtataggcatgctttagacatggacagaatgagttatgtacttagtaactcaaaactctgctgagctcattgtggacagctcttacagataaactaaaatgcagcttcttaaaaaatgagaggacatttgcagaaagcattcttactgctttcagcaaatctatgtgccttatgtttttatatagcagtcattttctcaaatcagacatccctattgcctattagataaacacagaaagcatagattatgagtttaaaagtatcgacagcatttcaagtgctatcagagaacatttaattcagtttaattttgtgataaatctcacgtttaatcctctggttaccctgtaatcatgtctctattgatcttttctgaatgactgcctgcagtttaataaactttgccattaacccagagcttctaaaaggagagattgattccattatcaaatctgatagaaccaataagtacctaaacatcactaaatctatctataggaagctttggcctagagacaagcctgtggcttgtttaagaaactaggtaaaaatctggatatctttgcatgacctaattgcctcacagcatctgattcccttgtgcaaactgacactgcctttcatctttcaagtcaatgtagtagccaactgaaaggacagtctcttttcttgcctcaaccgtaattgtagggtctaatttattctcactgcagatatagcttgaggagtttatttggtctatgtctcaggtcagtgggtatatcttaagcacttttctgtgtctctgaaaacctgcaggatagtttgttttatttttacctatatgatgccaagggaaagaaaattctgtctggataaatcctgaaatagaagactgggggtgaagattgagagagagggaaggcaagtacagagtcatagctgtgtgaacaagctctaagacttggaaaactttccatgaaacccatatatgtttctcatgtagtgataggttatttgcaatatgtgttgaacaggaatttctactttttgtgccgcgagtatttatagctttcatcattattcattaatatttattgagtcacataggcagaacatatggaattcagggtctagagtatatttacagcttcttatttttttaaggtcagaaaggtgtcattccctgccacttttcacctcttaaataaatcggtgaaggttgtcaattttacagaaaagccaaagcttttattttctgtctagatttttattgacaatgtgaatttttcagaaggagttcggctatttgacttaggaggcatagcctttccctaattacacttcggtggggaagtggaggtgcacagaaggatttttataatgagacaatactaaactgtaatttaaaatttccttccaacaaaagaccctaatcttggcacttagaaataaatctgtaatgacgtggtgttaggcagtggaagcaggattagagccaagggactctgggtgtgttgccagttgctgattttctcactttggaaagtcacttgtttacccagccttagtttcctcatgtataaaataaaactgatggtgcctgcttagagagctattagagaattcaatgaggtgattattttaaaagatactgtaaactttttccaatgctgagttgttgtgcagacattaatggttatgaaaaagataaattagtcctcgctttatattcagaaatggtctgacctttcagtaaattatgtttagttcttaaatcaaaacccagttaggacaagagagcttgaagagtacgtatacataagagaagtctcacagagatatttgaaaggctggaaaatgtgctctggaggcaaaccctccactgaattgatgaattctaagttacatctgttgatattttttgtgtgctaaatagcctcccagtatggtaacattagagaggctgaaggaacctaagaggaggaccctacatttataggtattgaggtagattggtctctgcccttgagaagccaatcaaaattaggttgagaaaggatgtagcaattgttcgtggaatactaataggcatatatgcacttgttcatgttgattctctatgtcactgctctgtaagagaaggaatgcctgcacatcttcaataggaagttgacaacagtttctggaaagttggaagaaagttacagaattattcctttagtagtaattattccatagttctctagaaacatgacaaaacctcttgaaaaacttgagtcataaaaggactgcctcacatatatacacacacttcctgatatgctgtgtaaaactgcgtttatattcagagccacataacacaaattttgccagaagttgctttttataccactgaatagctctaaactttaaattgtctttcataaaattgtttcttgtctgctgagtggacagaatgtctctctcttccccacccttcatatcattttgttttcctaaatgggccactctgtgaagtagttctttacttctagccaccacccctgcctctagaacaatgcaaccaaccttaaccaaagtcacatatcaagagttctctgctgcctgttaatgcagatttgacttctttgtgtgtgtgtgtgtgtgtgtgtgtgtgtgtgtgtgtgtgtgtgtgtcagggtctcattctgtcaccgaggctagaatgcattggtgtgatcatggctcactgcaggctcagtcagtcctcctgcctcagcctcctgagtagctgggactacaggcatacgccaccacacccagctaatttaaaaaatatttttctggagactgggtctcactctgttgcccaggctggtcttgaactcctgggcttaagccagtccacctgccttggcctcccaaagtgttggcattaaaggcatgagccaccgtgcatagccagatttgacatcttaaaagccagagctagacatacttattgattgtcttcctggggccaggtgcagtggctcacgcctgtaatcccagcactttgggaagccgaggcgggtgggtcacttgaggtcaggagttggagaccagcctggccaacatggtgaaaccccgtctctactaaaaaatacaaaaaattagccgggcatggtgatgtatgcctgtaatcccagctacatgggaggctgagacaggagaatcatgtgaacccgggaggtggaggttgcagtgagctgagattgtgccattgcactccagcctgggtaatagagcaagacttcatcaaaaaaaaaaaaaaaaaaaaagtaatggaaactcagagaaggttgctgaagggaagctagaaggcctcctccaggacagagaagtaatcattttacacttatcacttacggtaactacaatagaatcagtgagctagttgctgaatacttctagagacattgttcacttaaagtgaaggtgtgatagtatgtgaatacctggggaagagaagaaagcgaaacatttttaggaaagaaaaggaaagtatgtgacttattactaatcaggatcaatttgaagatctgaatagattttcactggctaatcagagttattctgtggaatatctgcaacctctgcaaccacttttgatttttctgtgaatagtgaggtactgagatccagtaaattataatttggccttgatatcaagccatgaaaaagatgtttagaactaacattcattggcctctttcatttttttttctcttggggttaataaggcgatttatgttatttctaggcatctgttcatcccctctttagcatataggggaatagaaatggtttatccgggatatggatgtggtaatgtgtcttagtctgtttttgtgttgctacaaaggaatacctgaggctaggtgcagtggctcatgcctctaatcccaacacttggggaggccaaggcgggaggatcgcttgaggccagagttagagaccaacctgagaaacatagcaagaccttgtctctacaaaaaagtaaaaataaaaacaagaaaaaggaatactagatgctagtaatttataaggaaaggaggtttatttcactcatggttctgcagactgtacaagaagaatggtgctggcatctgcttggcttatggtggagttctcatgtggcttccactcatgatggacggcaaaggggagtcagtgtgtgcagaggtcgcatgatgagagaggaaacaagaggatggggggaggtaccagtctctttttaacaaccagctcgtgtgggaactaacagagtaagaacctctcttagttctattagagttcgacatgagggagggcattaatctatttatgaaggatccaatcccatgacccaaatagctcctcttaggccccacctccaacattggggatatatatatatatatatatatatatatatatgtatggttttttaaattattatttttttggagacagtctcactctgtcacccaggctggagtgcagtggtgcgatctcggctcactgcaacttctacctcctgggttcaagcgattctcctgcctcagcctcccgagtagctgggactacacctccacgcctggctaattttttgtattttagtagagacggggttttaccatattgcccaggctggtctcgaactcctgagctcaggcaatccacctgccttggcctcccaaagtgctaggattacaggcatgagccaccaggcccacccattggggatatttcaacatgagttttggaggggacaaataaactataacagaaataattagataatgtgtttgaaagtcttggatggaagtccgagaggggaagagtgatggagtagtacaattcatagcatggcccaacagcttcagaatgagaggacattcagggcatcctaatttcacaagttcattctcctttaagtttttgtttttagaaatgggctcttgctttgttgcctagggttctcaaactcctgggctcaagcagttgtctagcctcagtctcccaagtagctgggactgcagccatgcactaccaggtccagttctaattcattcttttataaacaggttactgtgtgtcctctactctgttctctgctaggaattctggcatgatgaagtcatagccattgtccttatggaggtaattctgagtattaccaggaagatccagttaccaatattttgatacactgtaataagtacattaattcttttcctatcttttgcatacagtgcttaatcaaaaaatgaataatggttgtttcaacttactttaccatcagcagtgtgcagtggttcccatttttccacaccctcactgacaagtacctcttgtctttttgataatacccgtcctaacaggtgcaagatgacatctcattgtggttttgatttgcatattccagatgactaatgagcacattttcatgtacttgttggctatttgtatgtcttcttcggaaaaatgtctagtcagattttttttaaaaagaacatattacatgtaaaaagaataatggttaattaaagcaagtatcattagaattacacatcctctcaaatgtgtgcgtgtgttactttagtggattagatttaagtgggagaaaaagcaatcgaaatttgagtgttctgcttgtctttcttcagttagcataccaggcttctgcccttggagaggcctgagaattgtgtggtgctagtttctcttctggctgccattacactatcttctgttgtatggttctttttgcctttttggactcgtcctttgtgtacgttattgccctaagccctcactgatgagattttctgcctcagtcatgctgtgctcagctttcagaatgttgttgttacggaggagttaattttttttttaaggtttccttttcgtcatgctgtatttctcagattatctggagggactgtaatccaattttaggaatccttcagggctgagagcctaaactgttttaagcaatagcatctggttgccagggactcaactactttgagcgtgttaaggtctaacggcagccaactctcaattatctgtgggaatgggagactcctgggatgttttcaattcacagagtgtgcaaaaatctcacttaaacggatagtcgtgacctcatcccacagctgagtttaggagagcttctcagtgtgtggttttgttttctttttgttttgttctcttctcacctttgacagtggcactgcagcattgacaggtgccttttatatgttgaatttatctgtacctgatctatttttttaaaccttgtccctctcatctttatttagattccatatgtgtatcattatatacattaagtatgttttaataaactgcctcaattcttttacattttaggagcagtaaaatttatttatattttctttctttgcttattggctaacgtgctcatgggaggggatgtagccaaacagtaatcaggctaccagatagaaagataagaaaactttacaaaaggttagcctctgaataataattgagaactggctgttaaaaatgaaaaaaaaaaaaaaatacgaactctaccttgtcactgaaaatgaggtgaaggccaggcagtgctcctcagtcaagacattcgtgttcacaactgagttgtctccagtggaaatttcatggctactttatggcctaaagccagtgctcccagacgtggtcatcccttggttttaggattctaaaagatgagtttcttttaatgaaaactgaatgtaatctagttgttagggataattatatgccagttgtgcatgacggcaagggcccctggtttttaaaaaccagctttatggaggtataatttacattccagtaaactgcacaaactaacaatatacaatttgatgagttttgacatgtgtatatacccatgaaaccactgccacaatcaagacagcgaacatgttcaccccaaaagtttccttatgtccctttataatcccttcttcctatctctcccaggaagccactagcctgcttgctgttgctatcaattagttcatatttcctaggattttatataaatgggatcatacataatataatcttttccgtctgatttctttcacttggcatacttattttgagacgtattcatgccacctgtatcaggaggttatttctttttattgctgagtagtattccattgattggttacaaccacagtttgtttatccattcatctattgatgtacatttgggttgtttgcagttttagaagcattgcacatctgctaggagcattcatgtgtagctcttcatgtagacatgtactttaatttctcttagggaaatacctaggagtagaacggttggatcatatggtcggtgtacttagaacttttaaagaaactactaaactttcttccaaagtggttgtgctgtttcatattctcaccagtagtgtatgtatgagcatcctctgcatccttgcccactctcggtagggtcattctttcttatttcagccattttatatgtatgtagtggtatctcattgtggttttaagttgtatttccctaatgactactgatgttaactattgttttatgtattcattcactttccagacagatatctttttttttttttttttttttttttttttttttttttgagatggagtatctctctgtcatccaggctggagtgcagtgacacaatctcggctcactgcaacctttgccctctgggttcaagcgattctcctgcctcagcctccgagtagctgggattacaggtgcatgccaccatgcccagctaatttttttgtatttttagtagagacagggtttcacccgttagtcaggatggtctcgatctcctgccttgtgatccatctgccctggcctcccaaagtgctgggattacaggcatgagctgccacacctggccccagatatcttctttagcaaagtatctgaatcttttgcttatttaaaaaattgggttgtttccttttttagttttgagaattttttttttttttttttttaagatggaatcttgctctgtcgcccaggctggagtgcagtggtgcaatctcggctcactgcaacctccacctcctgggttaaagcgattctcctgctcagcctcctgagtagctgggactataggcgcgtaccaccacacctagctaatttttgtattgaccaggctggtctcgaactcccgacctcaggcaatttgcctgccttggcctcctaaagtgctgggattacaggtgtgagccatcacacctggcccaagaatttattaaattaatatattctgtatacaaaacttatcagatacacattttaaaaaatatttttccattctgtggcttatctatttatgtatcttttactctcctggtaactcacagaacagtcactttattttcttgacagtatcttttgaagagcaaaattttaattcttgaagtgtaatttatcaatttattcttttatggattatgcctttggtgtcatagtaagaaatcttagcttaacccaagattacaagagttttctcttagaaattttatggttttaggttttacattcaggtttataatatagtttgtgttagttttttctatttagattgaagtgtggattaaaattttgcatatgattacctattctatcaccatttgtttaaaaaacttatttctctgtagaatagcttttgcctgaaaatcagttgttgatatatgtgtgggtctctttctggactattctgttcctttgatctgtttttctatctttatgccaatatagtgatgcaattttaatgtggtgtgaaagatggcactacagagcacctgacttgctcctcctctaacctactttactataatagttcactgattagcctgtttccctggataagcagcctgagtttaggaattctttcttagatatttccaacagatggcaatgtgtatgcacatagtaggtgttttgatatttgtttttaaaagatgtgaatcttagggattaatgtttgaatgccatcctggatgccttgtacattcctacagatagtagtcttctctactttctaaaaagtttaggctctgaaaatctgttcataaagtccatttgctcaaaagtccaaagttggggactgttgtgaacatatctatctagttactagttttctaatttttcatttcttatcactggagactcattattggtagaatcagtgtttgtaaaaccattcaaaaacaagtacaaatggtatacaataaaccagcaagggacttgacagaccaaaatgacaggacacagccattatgtcattgtgtcattggggacaggcaaagcacttttttctttttctcctggcttgttattttctttaaggtctctaagatcagataactaacagaagaggctcagtttaaattgcaagcccctcacatacatatacatgcatttgggtgcatgcagacacatataccacaaatactttgtaagtgatggactgccctcaggttagtttgcttggaaaaatcaggcggagactttctataacccacttcatgcaaggcagacaaattgtgccctcattttctattgtctctggcttcatctgtaatcagcaaatggagccctgcagcttacatagtgtttcatctgctatttgttactctcccttagtttgcacaacactgaaccatctcattttgaaattcaagagtggcgaggaggcctttggtggaagattgtaatttgggagaagggaaagtcaagagcaagatcgcctattttgaagaaggcggggtgttgaaggaaattgcctttgtcagtctctgagcctctccatatatgtgctactgtgaccctgccctccatcaccagtgacctaaaaatcacataatttcaactattctccaaacctattcacatctgttgtgcatggcttgtacacttaccccctctattgacagccaatatgtctaaatctttttgcctctcagccagcctcttgttggtggctccctggctttcttgccttctttcctgcttcttctatgactgtcaaatgaatgccttaaagcgttttttttttttttttttttttttttaacagatttctttcttatccttctgccctcctgcctttctctcctagtgcttgtgtaagggaggcagttttttttatctttaccctgttagggtctctagctgaggctgagtattaaattgatgtaaaatagattaacagaagaaaagcatatggattttgacacatatataggagcccccacaggaaagtgaagacccaaaaagtggcaaatcttgaatccttatttagtaggttgaacagagtggccgttgtggaaaagtaactaaaataaatgatgtggctaaaggaagataagagttagtaagatctgttggtacaaatttttctggactccccatgtctagaaacgagaaaatttcttctttcctactatagggagatcatctttcacatgagagttttttcccatctcaggtgtttctggtgataatgtttcttttctcctatctcttttgtttctatttttcaagtgcctttagctttaaaataatccttaggcctaaatagcatgttttggggtggcgtgttctgccactcttcatttgctcatgctttccttgcagaatatggactacaatcatcttattttcaaaaaattcttcaggtaattctgatggacagtttctcttgtgaaccactatcctagatcatggtagacgaatgaatcaacaggcctttgaaaattgccattcattgatcccaaaaagtttttttatataccagataatttccctccccatattatagcaatactagagactgcccaggtttccttaaggaagttcttaaattagtgctactggttggttggtggtggaggaaagcattggtgggtgtatatttacaaacaattacacaggcatgtagtcatgtacacaactcttgtgactgttgataagatgattagtttatgatcagtctttgtctttgattcttaatgcttataatggatagtttttgtcatttttctccaagacagtctgaaaaaattaaatagttattttactttataaatggtaagcagtcagtacctgtttatagagggaatgaacaaagagtggtctggtttattcaggatttgtaccaaaaaatctatatagtaatttataaataaaggtagatctttgaaaaaaataaagataatctctagtctctgaaaatataaacctgttacataataaaaagttgttatagactcttcatttcttcttacctcttaagccaccacctctagacacactttgatcctctctctctcttcttccccccccccgagtggaaaatctcaatattaattggagctaagatgattgtactactgctgctaagacttcagcaggtctcttacaagctaatgtcacggcatggggtccatttgctctgtgtagctattctgcagtgcagtgagaattccttgattaatatgctacatgaaaataaaatggatttggaaaaaattatagcatactctcataaatattaattcacatttgtatggaattacacataattttcaatatactttggaagcaccttcagtatgaaagatttggtctccaaagagaatggcataatttttttaaaagcacagtggatacattattaagcatcatttgtttattaatctgatcctctacatgcatatgatgcagggcagtaggtgggttgtgtgacaaagaaaggagctttataccctgtggggagtttttatattacacttagaagtggtacaatttaatcacattatatagaagcagcccatgatggaactcacctggctccctctgctagtgttgccattattcctgagtgtctctttatggcagctattttggttaaatgtgagactaaacacagaacatttttgagctgagcagatgcctggcatagctgactgaggttgtggacactggacaaaggaattcaattcagcagccattcattgaacatttactatgtgttaggcatagcatgcaaggctgtgaaatcaatggccatgtgcgcttgctttgatctcgacttgtcccctgaaacacttttcaccacatcctcattgcctcaggagagctacctctccgatggcagagggttaatcgtctgcagtggtagcagctggaagttaggccagaagctgcttatttgccttgtggactgttatctttgatatcttcttactcttaaggataaggcctttccccttttctggggtttcttgctgtttgctgtgatccttcgtgtataccagcagtgcacactagattccttggtttcctgcttctatcaccctttctggcttgctacactgtatgttagagacagcttagactattttaaagtcagtattgtgctttataggtttggatgttttaactagttgactcctttatttatgtatttattgactaatacattggccacctactatttgcctggtttatgtgaagtacttatgtgaagcactgggattactgagatgaactacttagtccctcccctctttcacattctttcaagagattatgcacccagctgcctcaaggcctttgcacaagctgttctctctgttcagcctttcagatctaggtcaaatagcagtcattttctcagctctaaccctctcctctggactatatcatttcccttagttttagcacccataacctatcctttagcgttgttaactcagtttgcaatgatatatttgtgtgatttgattagtatttgtcctgtaaattctaggctctatgagggtggtgacttttccccacaccattatcatcctaaacataggtcagtgctacattggtacttggcatgtactgggcacacaaaacataattgttgaatgagtgaagacctgagaatagagtactttgtattacaagaaaggtctccctgagtgggcaacactgctaagagtcactgaactagaaaagggaggagtgtgtaagagaggccttttgaggccaaggcaaatcagtgtaaaggcctgcgttagtttgtccaggctgcattagcaaaatgtcataaactgagtagcttataaacaagaaacatttatttctcacagttctggaggctgggaagtccaaggtggaggcaccagcagattctgtgtctggtgagagcttgtttctcatggatggtacctgttctcacatggtagaggggcaaatagactcccttaggccctttataagggcactaatccccttcatgagggttccaccctcatgatccagtcaactcccaaagtcccccatctcctggccaacatggtgaaaccccgtctctactaaaaatacaaaaaaaaaaaaaaacaaaaaaaatggctgggtatggtggcaggcatctgtaaccccagctactcgggaggctgaggcagggaatcgcttgaactggggaggcggaggttacagtgagccaaggtcgtgctgttgcactccaacctgggcaacaagagcgaactctgtctcagaaaaaaaatatattctggggagacacaaacattcagatcataacaaggctcaaggtctcagactaataggaatggctgatttggggagagatgtcagggagtaccatgcatgtaaagttgggagtgctgggatattgcagcagaacagtgagaaaattggatgtgaaagggaggaaagagagcggtattttaaggagaaatgagtaaaaggaaatttctattttggttttgttttatttttaaatgtacatttagatagtaaaaaatttaattgttcatttaaaaataactaaaataatataattggattgtttgaaatacaaaggatacatgtttgaggtaatggataccccatttaccctgatgtgattattacacattgcatgcttgtatcaaaacatcttatgtaagtcataaatatatatgccgactatgtaccccagaaatgaaaaaatttttaaaaagttcatttaggactgcagaaactgaggaagtgtggtaaggcttcatgagggggattttctgtgtaagaggattagatccactagtttccaaataactgagtgccaaaacattttcattttattgcttagtgtgtgcatcatttctcacagggcagaggatatttgcatgtatgtggtttgtttgatgttctgagagcccattttgcacgtggtctcagagttgtagtgacttactccacttctgataatgaataatgtcagtgtccggacactaaaagcccagtctgttggaaccttggtgtgtactgagctgcctggaggcacagaactcttatcaggtcatgtggcctgaaatgcttacctgtagtttctacagatgcagttccccattcaaggacattgatttcccatttcctacccacctcccctcatccccaaccacacacaggaataaattaaaagttgctgttgatcttggtgataatattgttgttacattttgcaaagaaaatggaaataaaggatgcttagaggaacatgtaaaaaaatataatgcattaaggaaacattttaatcatatgaatagacagttctttcttgctggctcacatccacctggacctgataaattcagttgggtgctatttcttttgaattgagcatgcacttagtgctcattttctgaaacataattgatgtaccaacttgggaaatgagtgtattgcacttccttggggaaggtcattgtgtgctggacccagcaccaaatcgaacagaaagctgctatcccagggagcagtgaaatcacttttgatgcatatacttgtgttttgtttagttttctgcccagtaataatagaaaggatatatatatttgtgatggcattaaggattcaggaaaattgagaagccatgtttcttagttttgggtcttctcatatcccactttcctatccctctcccacttagtagtaacaccctttagtatttagcctatattttgggtgtgaccctagatacctttgtaaccaccacttccctttccttctcttcttttctacagaaagatgtagcacttaagcctcaggaacgtgtggagaaacgccagacgcccctgaccaagaagaaacgagaagcacttaccaatggcttgtcctttcattcaaagaagagcagactcagccacccacaccactacagctcagatcgagaaaatgaccgcaatctctgccagcaccttgggaagagaaagaaaatgccgaaggcactcagacaggtgaggaagcttgggttcgctctttcctgtggcggcaaaatcccttccttaggtgcttcctccactgtggtttttcgtaacaggtggagaagatatccttggtgggatgctgaagtggttgtccaacaaagctgtgtgcgtgcctttaaaagaatctaaaacccaatctcagctctttctatgaggatttgaaacttcagcatggtgccctttcagtcagatgtgctttatgcaacaaagcttgatgctaagtggtactggtatttagggcagacctgtcttaacagttgtcaagatggactggcttgcaggggagagatctttgcaattaggataaatggaacaggtggatttcatcacatacattgtgcatctcatggttctaaggtgctaaaatgattgcctgtgtgtgagaaatgccttgctaagatttatattttccggggaagctcagatattgtggcatctgggagggcaatggcaaaaaatgaatttgccttttggtgtcttagttgttctccataggctataattcaagactatctttgtgatctgttgattgtatgaacgtctgataatgaggcttactggcctgttaataattaggtttcaatgatccacaagaaagtatggctcttggcatttgggaagcctttctgcctgtggaaatccccacatgagatggattaataatgagatatgaagctgtttatagcagtttttctgcacaaatccagaggcttcagtgcctgtcaagttagttacctgtgtcctgggtgtgttttatttatttttggcaggaccattgggtaggattgactatcactgaagaaagcagaggaaggaattgtggtgtacagagcaggtgctgctaattagaggtggaataggtaatttttggtttgcagatgtttctctgcagaggcagggagatctgggatcaaacaaaacaatggttcccaaaccacacagatcttgagaatcatataatgagagctactaaacctaaatttctggcccctctttaggacctaatgacatttgtagttttagaaagtttcctatttgaaaacagtcagcctggttggaagtcactcttacaaagaatcaagagtgtatttgggtgatggtttttagttaaaagattggaaagatcaaaagcctcaatatgatgtagtgggcagtttggtgtcagaattctgccttatacgtagtgaagcatataatcctggtaaaacatctggggtgatgggtttcagatggacccagaaggcttccaaggtaatgcctaaatctgacaaccagcacagtgtttccaaaggtacacttgtgtcctgaaacgccagactggagttataatagtaattattaacatttacctaatgcatactatgctacattcagtgagggagtttttatagtataacctataatttgtacaacaaccctgcctagtaggtaatatcatggttacttaacagctatggaaacgagggctcaaagagataaagtgacttgtctgaggccttgtcaatgagggaaggagccagggtttagacccagatatctctagttccgtggtttgttctgttttccatatttagatgaagttttatttatttttttcttgatagggagttggggagagggaggaaagcctaagttctataaaaggtgatgttcctgtggtatttgtgactcctaactcatgcctctgtgtgagatatgtgagaaaagtaattaatctcagtggagagagattgcaatgtaaccacccccctctccctcaggcccccgccccagcagggtaagaaggaagccttcttactctgagttaacaccaagctgcggatcctcatccttgaatctttttcttctagacgtgatctgacttttctattctgtgtcctcagaattattctttgtatttctttctacttcttcgagactttcaaggtcctctggtgacagagttttatgatcggaaaagaagactaagacgtaacacatcttaaatttgagtagcttttggtcttaatggccaactctcttgtactaatggtatttgaaatcaaagctatctttgttttaggtaacatatttgaaaagcaagtattttgactctttatgaatcatggagaaggaaagcatgaattgtatctttggccctatgtaaaacttttaaaaacaaggagtattttcttaccttcagtgttgatgccaaaatatgttatccaatcaagtgttatatttctagtaagaaggaatgcagaaggtgataattgagataaggccataatacttctcatttttaatattcttagaatcacttgtgctattatgaaatcccaaacaagtcaccatctggtaacagcccatctggaaaatgaagggcttggacttgaatgtttcttaggctcctccctctgggtcccatagttttttaaatttatgaataacacaaatacagtgttgtaaaggtctgtaaaggagtctgtaggtctgaaggtaatgccgttttggagtcagtctgtaactgataggctctgtgaagacatttatttatttttaatgtttttttttctttaaaattttgttttcatgtaatatgaagacatttaaaggagaagggtaagatgcatttatagtaggagggaggggagtggtccattgtgtgtcagtccagacaactgccatctgttatgtgatcattggtaaaaggtgacacatgagtgtttaatgaccatagtagatgttcaaaaagcttgtctgaagaatactcgtgattgctttcctatcatcctagatgcctgtaaatatcacaattactttatcgcctgcgtttgcctcttatcaggtaaagaaactgaatctgaccatcttagctgggaggggaccttgagatgagagtgagctttgaggagcatttctacattaatggattgtcatttagtgcctgttattgagaactacagatgaaatagggaagaggcgagaacttagtctttatttctgacttggttagaatgaattaggtttgcatcttattaggaaatggtacttcctgagcagacaacttaatgcacagctttcctgtaattatgggaagatgttactccttagtagagaggaaagaataggatttttttttctgagactccgttgaaggcaactgatctttttactcggagggtgcaattataatacttttataggaaagatgtatagttctaaaaccaaactgcttattctttcacttgcctggttgtaaaacccaagttcttgtgatgtttttccatactaccaaaagaaagcttttaaactgacacttatttgttggattatgtttttaagtataaatacatactgccttagaagatgctgaggtggcacctgtcttggcaaatggttgcactttttgatatgagaaatttgaatacttttcttacttcccaaaggggttaaaattatgaagaaatcaataaattacctcttatacaactcttatacaaaatagcgcatgtctttctgacctctgtaaatgaactatttgttcatgatgtaagcacttagacatgatataaaaaaagttttatcatttacttacaaggacatggtactttttttttctcaatggagatttgggggtgggaaaagcaaaagaggttgcacatggcctctccttaaggagctttattctctaattgggagaccaagtcacaatgaaaccactcaggaacacaaggaagtcaggtgtcgctaaaccgataagccaaattataacttcctgagaagcactttgggaaaacttaacccttcccagggcattgagtttaatttcagtatatctgacttctagaccatggagaattcttaaaaaatttaggactttgtagtttaaaacacacagagagcaaaagggttttaaaaatagagtaccaatgatgaaaagttgatgagcattcagagaactctcagatttggctctgactggatttctaaatctccatttagtccattagtctgtcctttctctgtagtatcaactgagccagaggaaataggcttaagtgagctagaaggcatttttaggttatatgaactcttctaacagacaccaagatgaatcatcaaaataaatcctgtggtctccctccttaactgaattttaggtgccaaaaagccattcatcttagggcagaatttcctaaagaaagaggcaacctgttgagattgctttagtcacaggagaacatcattttagaggaaaatggaggaatttgtgaatatttcaggagcctgttagtagactctaaccttgctggtaaggatggcttatgtgggaatgtcttatgtggtttaaaaatctttatacaagttgatctgggtaggtatttctttttaggaataaaaatttgctcttctctctctgaaaatccagtatggtgggagatttgtagttgacattgtaaactgtagacaccaaaagtgtctactgctttctaggaagaagaggaatccatcccagtgccaggcatttaaaattagagtgattactagaactctgcatggttgcatctgcttcatgtattgacattgtaccttggtcttccttggagtaagtgatagtggtgctatagacttaagagcccaggtgactgagccaccctctcttcccacctgtcctgatggaacagtctatcccagcccatgctctttcctgttgagagtgtttgctaccagaggctggtcccttatttcagcacgacttagacttactgcttttgtctgaagagctttctctaaatttgttactagtagaaattaacttgcaaaggaggatttataatggaaaactttgattaaacggatccagttcaagtctcgtttctgaagatctgctaattagttttggatggaaatctaggccaaaaatcacacaggtatttatccagcttgactctagagcctacaggtttctggaaatcagagcatttgagacacgaatgtaatttgggattttactgtcataatgaaaagacatgaactttgctatgtgctctttcatacatacttttgttataatatttagatgtctgctggtaccttgaactagtattaagaatgtcagttaaaccgtttctacctcatacttcaaaatttcaagtttaccatgttaattgggatttcatttgctttcgaaaaattttgtagtcatgtgaaggttacaagctaaggtatcaaataaaattctttatatttttttcctttttatgaatttaagttgcatactactttttccccttgcctaaagtatagaaataagaaaaactgtaaggaaagatggagggaataaaagattggcttatgatctctctttggaatattgattgacttgaataagagtgagatgctagttttaacatcaggtaattgaagaaccccaatctaggcttgtctgtgttcaggaattactcacgtattgtattggaagtattggtttgtaactgggattggtaaacctgacactaatataataatgagttatatgaaaggtgttttgcttttgttttatcttgagcatttggaaacaggtttattcgtgtttttcattttgtgtcttttgactctatactttgttgctgtgagccctgaatgttgggaatagtgagcataaacatcacttaacttcagtgagatacatctttggaatgttatgaccagtaataattttatcctaaatgacatttgtaattttaaataaaaatttagtaaaaattgactatgaaaaggacatagcatatgtattaggattctctggagagcaagtaccagtagaatatatatgtgggtagataagaggggattcattcggggaatttgttcacatgattatgggggctgagaggtcccataacaagccatctgcaagatggagaccctgggattcacagtatggctcagaccaagtctgaaggcctgagactggggtagtcctcaagtccaaagcctagagagcctagagtttagatgatcaagggcaggaaattatatcccagctctaggagagagagagagaccatttcgcctttcctctgtttttgttttatctggacacccggctgattgcatggtgcctgcccacatggagggcagatccttccctacttagttcactgagactcacatgccaatctcctctggaaacaccctcacaaacacacccaaaggtaatgctgtaccagttctctaggtattctttaatccagtcaagttgataccctaaattaaccaacacagcacattaactaccacctcataaaataaaacctgcagagagaaaataagctgaatgggaaaaggaactgcaatgaaaagaatgggccataattcagcttgggtgatcctgatacctacaggagttgttccataaaacagtgaccttttatatttcccaaagtaagaaaattttatatgtgtatttgtgcatgcagaactttattaagggccatttaaatcccatatattgatagaggagttaagaaagataaagtgacaggagtgattctcaactctggctcccataaatttctacaatgtcagtgattgaagaatgagggagcacatctttcctttaataaggcctagccagtacacttttggtagttgatgagggtaggacagaactccctttctttatttgaaactgtgtatttttgtgctgattaaattttacatttttccctcttgtgatgatataaagttatctgcatgtggccagatctcagctaaagaacatgaaataagcctctgtacattctgcattctaatctctgttcacagcaatcttgtatccacacaagtctgtacatgacaggtaatgagtgggaagtgggaggagatgggtgtctgtgtggtttgcactggtggtggtggggaactgagcagatggttgtgatagccacatgctgcgtgattcccgtgggagttgatggtggtgacaggcgactcacaatgtgctatttacagtttgggtttgcagtctttcggtgacatctgaatgctctttagcaactgctttcattactgcctttcgaggagctgttaattgaaaatgaaattgtgggtgggctttaagacaggcagacgcaggcaattctgtgtggtaaatgttgcttgagaactgttggatgtcttcatgcccaatttgtaattcattttctaagactgtaaaagccaaaggtgcatttggagattcagttatgtatatacataggcagagttgaatgtcacaccttgcccaaagggtcaaacatacagttattggtatgggtgctgtggttcacgcctgtaatctcagcactttgggaggctaaggtgggaggattgctttgagcacaggaattcaagaccagcctgggcaatatgatgagaccttgtctctagagaaataaaaaaattagctgggcatggtgacgcatgcctgttgtcccagtttcttgggatgctgaagtgggaggattgcaagggcccaggaagttaaggctgcagtgagccatgttcacgcaactgcaccccagcctgggcaacagagcgaggtcctgtctccaaaaaagaaaaccacacaaaacacctatttgtctggaaaccaacctaggggaatgcttggcaatcccagctgcctgctcatgtcttacctttgtgtagttctctttaaatgtatacaactgtgtgaggttcttatgtaaaatctgctgacatcttgtagtgttctctgtgagtttatcgtaggacttcatcctcctttcttcctttagctcttcataaagttactatgcaggagtaaatggttatttgttctcttgaactttgggatacatttttccttccgtatccaaggaggattctttccaggactccccatggatactaaaagctgtggatgttcaagttccttaaataaaatgttatagtatttttatgtaaccaacacacatcctctcacaaactttaaatcatctctaaattatttataatacctagtacagtgtaaaagctatgcaatttgttattatattgcattgtttaggcaataattacaagacaaagagcctgtgcatgttcagtatataagcaaccattgtaggccacatttttggtctgccattggttggatccatggatacagagggccaactgtatcatattcaagttcttacatataactttgtttcttgtaaacattttcatatgatacaactctgttaaaggcagttggagcccagaggcaaacaagagaagaaggaagagagagggtggattttattggactttgacagtggttgatgatcttgattctcttatggctgcccccagctgcaggattgtgatttgtttcttatcttcagagttgtttgctaaagcattagtagcattactgaaatggtagcttttgtaaatgtttatatgttgaattgttttattgcccatagctttgcacagaaatcttgtgctgaacaaggaatgacctccctcttggaagtgctgttaactctctttttaattaaatatgaatatagatacaatataactgcatttttttagttttcccttgaacatttcagtgaatactatctgggacaaaaccgtgctgaattatacgctttcactactatcactctttgctcttagagagcccccgaggcttggggtgaggagacacaccccttgctgtacttaaccctcagtcccattagacctgctttgccacaggaacccagctgttttaatgcatttgagttgctgttgggtcctaatgatgtttaaaagaacctgtcttggtattctaaatgaactctggagcattgcctattgatgcaagtgttgatgattttatatcaggcagatataactttgttatttactctggggctttttacacctaggggtgtgcatcctcacaccagtgctcacaaagacacacacaggagcagaaaccaaaatagctcacaaatgtgggcaagtcctgtgggggaccaccttatgtctctcaggaggcctgatgagctgtgccatgtggccttctggaacattatacctgcattcattgatcacagctctgcagaagctgccacttctcctatgtgcctgcctgcagtgacgctgatgtagcaggtcattctgtaatcactgtttgcacctgcatttgctcaggaagtgtttgctcatacatcttgaaatcatgtattacaaacctggacaggtcctaattgctggtgatggttctgagaggttgagattggctataattagatggagaagcaattagctacatattctgagtagggaacatacagaataatgtttctcaaagggtggtctttgaacccctatgtcagagcaactgtggatcttttgttaaaatgcagattcccaggtaatcaccttggcatagtccattgggtgggggtcagggtgtggcaacaaggaactggagttccttcagtgactccagtacaggtgctgcaggagccatatttttaaataaactgtacttattttttattttcaattaaaaattgcaatattgttagcaaaacttgggaagaatcataaaattgtaacaacatatcttgcggaaattaattttatcaataattggatcatatttttgttctgtacatttactaattgagttatcttccaaaatgtattggcaagaaagaaatgtttctgccagatgatgtagacattatataacaaaaaatgatgttttcaaaatagctactttttctaggtgtttactagaatggacctgatagaataattgtattctagtattctctccttaggcccactggctcactcaaataatagctgtttataaagatgctaaccggagttttttatttttcatttttttaaagttctaatttcttgttttttcccatctgtagacaatgatgatgagctcttaaggtttatacattttttgaacccttcaaattacaaaagttggtgatatttggtactgggggtcaagtgtgaaagaaatctgaaaatattgcccatatcagtggagactaaaggccatttgttattttcttcattaccagcaaagcttcagtttaataaaaatattataattgaatttacgattttgattccacaaattcaaaaagaaatattttcctttctaaagccaaacagaataaaaattctcataagaatttttgtttaaatagcaaaacctattcttaggatttaacaattgcctgaggtttgtcaacagtaggtagcattctttttttatatattgctatgaggccaaaaatgctattttcctggagattagtgcaaaataatctaccgaatagttgctaatgaaattatcatatgagaaagattattaataatgacttttgattttaaaaaatactatcatcaaattttcctaagaaatgatgatgagaaaagcagttttgaaatacaaagctgggtggtagtgggcctggtgtgcactgctggaaggttgcatggtactttgtgaaacttcagcagcccacttgcataatttatcattacctgtcccctacctctctctacttaattctgaatctgtatttctcagataaacatggcagtaggaaggatagggaaaggtgttgaggggatgtgattatatggatgtttttgaaggggagtatattggtgtcatgggatccttgggatgtcatcttgccagctggaatcctctgtggcaggggtaccttctctctgagtattgctcatgctcactgggcactgggcttgttctgcccagttggcccagcaggctgcacttggctcatgctactggcccagatcccacacctgccaagggcgagccaggcgtagagtggcaaggggtgtgtgggtgagtatattagttcttttccacgctgccaatagacacatacccaagactgggcaatttataaaaaaagaggtttaatggacttacacttccacatggctggggaggcctcacaatcatggcagaaggcaatgagtagcaggtcacatcttacgtggatggtggcaggcaaatagagcatttgtgcagggaaacacctgtttttattttattattttattttttatttctttgagacggagtcttgctatgtcacccaggctggagtgtagtggtgtgatctcagctcactgcaacctctgcctcctggtttaagcgatcctcctgcctcagcctaccaagtagctgggactacaggcacctgccaccacgcccagcgaatttttgtatttttagtagaggcagggtttcactttgttgaccaggctagtcttgaactcctgacctcgtgatccgcccgcctcggcctctcaaagtgctgggattacaggcgtgagccactgcacctggcctgaaactcctgtttttaaaaccatcagatctcttgagagttactcattatcacgagaacagcatgggaaagacccccatgattcatttgcctcccactgggttcttcccatgacatgtgggaattctgggagttacaattcaagatcagatttgggtggggctacagccaagccatatcagtgagtgagcctggggtatggccactgctcacagccaggcatgcctgctgctgcggcagggtgggcagccccaggcaccagaacaggtgctggctccatgcaaggctgtggctggacaagatgtactgcatgtggcttccactgtgggcacccctgtctggatgagggcaacaaggtggcacccagaagcttggagataccaggaaccacagagccccaaagagggtgtcacagccctgcctcagggagcccctaggtctgggctccctaaagggccgcagctcttctctccttctcattaactgcaacgtggcgagcaggggggaaagtgtgtttcagccctgtttgtgttacagctcatcagtgctgccattcaacaggtctcgagttcatgtcccatgcctaggaagaatgaggtacagcagacaactggagtgtgagcaaggcagagaggagctttatttgatccacagaacagctcccaggagacctcaagtgggtaactcctttccacaggcaggtcatccctatgagtgtccagctctcagtggagaggcgagccgcagtggtagctcctttctgcagctggtagtccgatgtctgtttgagcctggctgagtctcgggtttttatgtgcttagaagggaagaagtacatgttgattggtccatgggcaggcctggaaaaagcaccatccgattggccaaatggtcatcaatgaagtcttcactctgggcggcagactccaccgggaactggcaccctggccgctaggcttcaggttgtccctggcttgaaggtggaatttcactggggacctgtccctttctgccctgaaacctgtctgcctcccaccatcaatgtgccatccatggcactcaggctgttgatgccaagggacacctgtaggcccacgctgagccaccttcagtcctaccttggcctccctcttgtgctcatgggtgcccaaaatctggagggggtgctgaggtggcagggggctggcgtgtcaatgccacccgagtgcatgcatgcctggccaggttgtgacagcactcaggcttagcctcaattttcctctgaaatcagagtgggctccaggtatggggagaagccaggtatggggagaggccaggtagcgagagtaggcacttccaagactgctcgggcaggggcacttccccaggcgcctgagagctcagggatgcctgggtctggagccacagctgggcagctgcatgtgtgcccaggagcatgaatctccctctctgccaactcagtggagggtggggctcctgcctgttcctggccccagccggctcctcagagcatacagccccggctgcagccagcatcttggcagcggctgctccagacaggctgccactgccatcactgggaccatgtagggagtatattagggctgccccatggttctccagatagactaaggagacaaattgacatagtacagtattagaaggaaagaatatggagtttaaaaaccgttttcatggtcattctgcccctgctcttctcttccccctttcaaactgagcagacccatatttctcctttcatctctgtccttgagcctaccttcagctctttggctttcattttactccctccttccacccagtgtcttttgctagcttcttgacccagccaggattgcatgggacatcacttagatctgctctcagagtcacaaaatgcctttgcttcctgtttccttgttccttttactgtgctggttcttttcggtaaacttttagatttatcatctctagattagtgcagcattatttagctcattgctattgtactctggtttaaaaaatttcagtgaccatccacagccatctaaataagattgaagcctcttagtataggacattttaggccctgactaatcctgctgcaatgtaccttcccagttgcctttcccactctctgtaaacaccaagctgcaactacaactgctatttggatgaaccctgtgttttctccacattcctgtgcctgtgctttggctattttctttgtttagaatattcttttttgacatatttgtcttccattgactagttcagacccacttcttccttgaagtttttatgatctttttccttgtaagtaattgcattgtcttcccaactcttatgatcctttgtttataacaagggtcaccccagaatttatcagctaatttaggacattactgggaatgaaagggggaaccattaataattaccttggaacaataagcattaatcaggacttcctgaaaaactgggatatatagtcactctgtaattcacttttggcctttttcataccatactctgttttgagttggaggtatacattttcttctttccactgaaatgttgagctcctcgaggacctcactgtgtgacacagcaaggggcctaggcttatgtcacatattgggaaacaacacccttaaaaccactgctatcctttactcgaggatacccttctcatatttatagtttccattcatgtctctttccagtcttttctccatatgctagccagagtgatcttttaaaaatatacatatgatcatattattcccacaagtaaatcctctcaactgcttctcagggtattcagattgaaaatcagactcccatcatctgcagtgcccagttatccagtgctgtttcttcagcttcatgtcatgcttcccttgcttactggctccagctcccgaccttccattccctcccacatgccaagttccttcgtaccctggacaccttatgctatcctctttggaagaaatggttccccctctgttttttgaatgatgagatccttctagtcctttaggcttgaactgaaatgtcatctttcataggggcttttctcgaccatatggtttatttaactcaggatctgccatttgtcttctgtgttttgcactcacctttttaacttcctaacaccacatttataattatagatttttctttctatgtccttccttatgtctgcaccttctgctgcactccaagctctactgaggagagatatcacctccaccacagtgtttgtagcacattgcctggcacacagaaggtggcactcaataattaaagttgagtggtttgaataatttttgcaatggatgacattgctaattccacactcctgttacattccaactttaattggctacaaaaaaaagcacacacacagacacagacacacacacacagacacacacacacacacacacacacacacacacacacacaaacaatccagaccccaatacagtatgactgttgtcttctctctctggggatatgcaatgtaaaataagatactgatgagcgcatgctgcacaccaagcaaaaatttatcccaagcaacccctgcgccctgcgtggaccgtgtctgctgttctcccatggaatctatcagcagtttgtcttcccagggttgtagcctgtcaggatggtagaattgctagtgcagccaggaaaagctgacctaggaaaaccatagccttccatctttttagaggtaatccaaaagagactagacaagcagaaagacggagaggaaagttggtgggagtgaggtgaaattcactgagtactcttttatatgcaaatatttgtgtggggctctacttttttaccatgagtacaaactctttttagtatcaatgcatgaatagcgtgtcttttcactgaaaaattattgtcccacgtgccctcggtttaaaatgttttgatcttagaaaacagtttatttccttttaaagtggcccaattaattcattttccacatatttgctcattgagcaaacatcaactgaacatcgtttgtgtgcaaaccttatacaagaaactctgacataacagggaggatatgtttaatgataactctgcccatgatgtgtttatggcttgctagatccattctgacccacctattgtgaagagttcatggagagctcttaacaacaagtgaggctgaggctggcagattaaatgcagttcaaagggagacaaggttgaacatctcctagagagggaataccttcagagatacatattaaagttctttaaaattgtttctttcttattgtgccatttttgttgacctcccttctgtccttttaagaaacttttgagaaaaatgcattattctaccgaaagcatcggcaaatgttggaaatagtattttgtgtatcagttttcttggctgcttatttttaaaaataaaggcttaaataaggttcgcacatttttcactcaggtgcaatttactgggaattacctggcgcattggttttatgcttaatatttacagattattaaaatctcagtggctttcaaactgcatggaccaagaaaataggtgtattttctagaaatggttttgcttatggacactgacccactttgaaacgacttactcttggaactcttagtacaggaaagtcttatgtttctgtctagaggtggaactgtttatgataaatagaaatagctttccttttctatcatttctgttttcttggaagtagattatttttgatgcaagtagaccttcagaatttgaatagaaatttttatttatttatttatttattgagacggagtctcactctatcaccaaggctggtgtgcagtggtgtgatcttggctcactgtaccctctgccccccgggcttaagtgatccttccacctcagcctcctgagtagctgggactacaggcgcacaccaccacacctagctaattttttgaagagatggggttttgccgtggtgcccaggctggtctcgagctcttgagctcaagcaattctcttgccttggcctcccaaagtgctgggattacaggcgtgagccaccgtgcctggccttttgaataaaaatttagacttcagatttatatagtgagtatactgatgggagattgaacaattacgtgatctcaggagtagattatagagctgtttctaatttactatcaagttatttttttcccaaaagataatttataaactgcttttttgtttgtggaaatcctgtttgttaggaagtgttacaaatggtagtttcccagtgaatttatcaaaatgctgtttattcaataacattcactcctccaaggatactactcactgtcccttgacattcattcattaaatatttattgttcatgtactgctatggacagacataattttgggtgcttatattagtgaacaaaataatgaatacatctgccctagtggaagttacattctcttcatatattaaattctcttagtagtatacagcttccatttaaatgtttaacccagacctttcttctcaacttctagattcataaactcagctccttatcagagttttgctgcctagatcattcacaaacatttcaaactcagcatatctcactttgaaatctataatggtggtccccaaattgctcttcctcctcaatttccttccttactgtgtgcaccatctgctaagcatccaagccataaatctgttcatactagaaacctgcaagtcaaactcctcttcccctcttccccccattcttacatcctatagatttttatcctatgtatttcttatctgaccctctctcttcaatgttttctatccttcctgcgagtgcagtagttcaggttctctttctcttggaggtgtgatgactagcttctcatctgacttctcagcctctaatcttgccactgttaaattctgctcctcaaattcctccattattgtgttcttgacagcatgcaaattgaatcgtgtcatttgtttcaagagttttcattgactttacttataggttaatttcaactttctttatatggtatagaagcccacacatttttttgttttgttttgttttagagaggatctcactctcttgcccaggctggagtgtagtggtgtgatcatagctcactgcagcctccacctcatgggttcaaaatgtccttctgcctcagcctcccaagtagctgggactaaaggcatgtgccaccacacctggctaattgtgtgggtttttttttctttctttctttagagatggaggactcactgtgttttctaggctggtgcccacacattttaatgcctttcagagcattccctttttttttctttttttttttttttggtgcttcctaatcccatgcccctatcacatcagacttaatctattttctataatgtcttccttcacccactcctacaaatctgaattttttttttccttcagtgagtctgatcttagttacatgtgagaaatgtagtcctactaaatcagaaatggactatactacctcttagaataacatctcttgaaagggatcccctatagctttaaggggcctgctggttttttgttaacatgggtgaattgtatagtggtaaaatctgagattttagtgcacccatcacctagtaatgtaggttataactacatattgtagtagttacaatatattgttttttgtccctcactcccctctcactctgccctcttctgagtctccagtgtctgttatactactctgtatgcctttgcatacccatagcttagctcccacttataagtgagaacatagggtatttggttttacattcctgagtcacttcacttagaataatggtcttcatttccaaggacacctttgttgttgttgttgttgttgttgttgttgttgttgttgcgacggagtctcgctctgtcgcccaggctggagtgcagtggcgcgatctcggctcactgcaacctccacctcctgggttcaaacgattcttctgcctcagcctccctagtagctgggactacaggtgcccgccaccacacctggctaatttttgtatttttagtagagacagggtttcaccatgttggccaggatggtcttgatttcctgacctcgtgatccacctgcctcggcctcccaaagtgctgggattacaggcttgagccaccatgcccagccccaaggacacatttttaaactaagaaaatgttcagtttgttagaatttaatgtggcatagggaaaggaaaatgaattttagaggaccagtcttttacaaaagattactgcaaattttggtggtttcgttcaaaaacgtaaaaaagatcaatttcttttttcataatggtagttgctggacccttgtattggtgtggccattggagattacagaagccttttgttactggaaataattttcaggcctcagagttgtaagtcaagaattgcctatactgaaccctttggagtcttttcattgttacgaggtaactttgcttatgtgtgaattaatgcttaggctttcaaagcaagaaaaactagacatgatatgaactttgtcattctgctaagttaatactgaaatgaaaacttttactgatacaaagacatttctgttaccagtaaattgtgtagactttgtgaggattttgagatgtgatttatattggcttattttttaaaaagctggcttaaaaagtgaccacaagtgtgctaaaaggtttatttgaggtaaccacagtattatagttcccctggcataattattccgtattttgtttccatgagtcaaggcacaaagcaaggataatcataatgattgtaggaaacagcgcttagagctgggatcctaggattttaatactaggatcttttacttgttgcagcttccacattcctttttgaaaagctttttttaaacaatattttttagggcacaggcgaactattttagcagaatgaagcagtaatttaagaaaaatctttatattcctgtccatttccacattctttctgaaaggctactcttgggggtagaaatacagctgtggatgaaaagattgaggtaaggaatacttttctcttaaattcttgtagcttgggtcattaactattgtcatatatgtcgacctagttcatggcagccagaggagacaaggtataaaattgactgggttgtgattcagagggggaaacaatggaaaatatattgaacacttttacattactgagaccccttctacacttttttcctctttggttttagactgtataaagtattgtgttggtactgtagatacagcgtgtggctattgatattgatataagaaaatctgttaaggttcctctttcagcagttatggggatcttcattcagagcaataagatcatttctcctaggtgttacatgttggcagactgaagaagacaaagacgtcttgtcttcacattgttttatggccacgactttgaattcatttgatcacttaagaggtatcgcagacactgtagctaattagaaggaagggggcagttttattgtgaatatgttcagtgaagaagatagcagtgtttgtattgcacaggctgtatgaacgtgtattttgttggggagagagagactgagaatctggattcttgggttaaagtttctaccttgctgctggcactttgtccttaaccaagttattgctgctctttgaccctcagtttctgtgattgtaccagaatgcagatgttgtattcttctaacactgtgaagatgttatacatgctggagtacttaaaattccctcttccttaaaattgagaaaaaaaagtagattaaaaaaactaggaactacctggactttgataatattaatattttagataaaccagcactgaagtatgtgatacctacaaagaacaacacctcaagagtttctgctttgtggtaatgactcactttggtaaaattatgctgtgcacatggttattagactactgtagataccagtgggtacattagattgaaaaacgtaaatgaagtggtcttatgtatacaattttttgcagttgccttttgttgggaagagattaatatgagatagtgtaacttttttgtttggggtgggcgggggtgggcatgcctattggtggtgatctgaggattgtaactttagatcttttacattgaaattatagaaatttgattgttatggataattcatggtgaaggaatgtaatgaaattattattattattatttttaatgactaacccatgttcctagatgtattcatttttggcttagctctcctctcctctcctctcctgtcctctctctttctttcttttatttttttttagagagggggtcttgctttgtcactcaggttgaagtgcagtggtacaatctcactgcagtctgaacctcctggctcaagcaatcctcccgtttcagtcccctaagcagctggtactacaggtatgcaccaccatgcccggctgtttttgtattttcgggggaggcagggtttttccatgtttcccaggcttgtctcaaactcctgagctcagagaatctacctgccatggcctcccaaagtgcttggattacaggtgtaagccactgtacctggcctgcttttcagtttttcagtaagtaaattgtgaggcatatatgttgattcttctggctttggaaaatccttccctataccctatttatgtagactgaatgaaattgataagatacagtattttcttcctagactgttcaacactggcgtgaaatggttcttgtgtaggactccttgccctcttccaggtagctctctttattcagtacatgttttacatgcattctctgtgtttcaaacctgagagatgtcagaggaatataagagatggtccctattttccagggcttcacctctgggttaattactttgggacagtttaaagtaaataaactgtaaaaaaatactcttggaaaagttggtgaatgatacgtgcttaatttttcactaatctccctcgtggtttttataatgccatgtgtttttcttgggagggtttccttacagctgtatttgtgatcttgggctagaatttatgagctgccaccatgaaggtctgcctctggctttggcatcagagatggcgagttgtgtggtttgttttcttattgttaatgtgagaatttttcctaatcaaaataaatgcctatgtgtttttcctgactttcttgttggattgactaaggaagttgtgtgaattataaaaatttcttcctgaaatgaaggacaaaatttccaaagcaggatgcattgagattgtctgaagaaatgtatgtcttctggttttagtatttagacttgaagtttttttttttttttttttttttttaaccgtaataactaggaaaagtagaaaagttaaaagaaacaaaaaacatcacggtgggaaatagaaggagaaaaccagacatttatgaaaaccattctggatctcacagatgctattaagattagtaaacgttggccgagcatggtggctcacgcctgtaattccagcactttgagaggcagaggcaggcagatcacctgaggtcagaagtttgagaccagcctggccaacatggtaaaactccccatctctactaaaaaatacaaaaattagccaggcttggtggtgtgtgcctataatcccagctacttgggaggcctaggcaggagaattgcttgaacccaggaggcagtgagccgagatcacaccactgcactgtagcctgtgcaacagagcgagactctgtctttaaaaaaaaaaaaaaaaaaaaaggccgggcatggtaggtcatgcctgtaatcccagcattttgggaggctgaggcaggcagatcacctgagggcaggagtttgagaccagcctgaccattatggagaaaccccgtctctactaaaaatacaaaattagtgggcatggtggcacatgcctgtaatcccagctgcttgggaggctgaggcaggagaatctcttgaacctgggaggcagaggttgcagtgagccgagatcacgccattgcactccagcctgggcaacaagagtgaaactctgtctcaaaaaaagaaaaaagaaaaaaaaattagtaaatgttgactagtctcagggatatttgagctgcactcagtaggctactttgcatttgtaaaattctcacacatcaaattgcatcatctttggctttttgatttcatgcacgcagtctgtgaaaggctaagccaggtatgtggttacatataaacttactaccaactagcgctgtcctttttctactccttaagaggtttattggggcaataaactgttggcattattactcacctagcataagctgatcctttctttgactgtttttaaggaagatgttgttttatctgctaaaacaggtagcacgagattgacttcaccaaagcctcttctaagactttagaaatggcttaagcttcgctgctttcttagcacttttactgtataggccctggtatgtggtattgatacatacagtaagtataaatgtgagaagagaaaccacattttcatgctcttaagtgatccatgctgttttcacttctcagggtgatttttggttgtagccaactcagaaactctcaatttaatttgagattgtgtgaattgctttcctagtctgtacaccagaaagaatgcttctctccttacacatttcgacacttcttagtgaagatcatttacttatagagtgtatgcattatattagcatatggcctgggtaacttcagacttgttaacatagcgtgggaaaggttactgaaagcatgaggaggcagtatattatctctcagttgattttgtacaccattttgaatattttctgtacattccctttcctctagtgttggtttcttatacttatagtaaagggaaactgatgttgatattgttcaaaaaagaaatgaagtgaatttttgtatttttaaagaataaattaacatgctttaaagtgcttaaccagttgttacaatatcagttatcacagattggtatgcgttggtccatgttatgtatttgcctgaatcaaccctaagactggttggcttatttctgccttttcttttccaaaaggtatacttgacatgaagtagactgtgcctgtttgattttaagttttgaatatggtgggaggtatagattaaagttaatttcttttgcatatggatattcaatttttctgaaggcatttttgaaaaagctgtccattctccacctttgcattgcctttgtacttttgtaaacaatcagttgtccatgtatgtgtgagtttatttctatactctctattctgttcctttgatctatttgtctatctttatgcctatactatactgtctttattactgtagcttgctttgtagtaagttttgaagtgagataatgttacatagttttggctttttaagattcttttcactagcgtatgacttttagaatcagcttgtcaggttctataaagaatctggccaagatgttggttgagattatattgatcgtgtgatcaatttggggagaattgacagtttaaaatattgagttttcaactctcgaacaaggtctatctctctatttagatcttacttatttccttcagcaatattttgtacttttcagtatataagcctttcatatattttgtcagatttattcctatgtgtttcatatttttgatgcagtattaaatggtggtgttttttaactttagtttccagttcactatcaatatgtagaaattcactgatttttgtatattcacttgcattctgcaaccttgctaaactcacttattagttctagtagttttttttgtaggtcttactggattttctacatggatgatcatatttttagtgaatagaagcagcttatttctttcctcctaatctgggtatcttctctgtctttttcttgtctgatttctctgtcaggaacttacaggatcatgtttaatagaagagacaagactggacactcctgcccttttcctgattttagggggaaagacagaatcttttgccattaattctgagcttagctatacgtttttcatagtgccctttattaggttgagaatgttccattctaagtttgtcagaattttaatcaagaatgcatgttatattttgtcaaacaccttttttttgtctatcaagatgatcatatgatttttctttttttgtttattaatatagtaatacattgattggtttttaaatgtgaaaccaaaatgctttccttggtaaactctatttagtcatgatatattaacttctaaatagattgttggatttgatttgttaaaaatgttttaaagaatttttacacctgtgttcatgaataaaaattggtctgtagttttcttttgatctatttgtctggttttattatcagagtgatgctggcctcataggaaaggtagggaaatattcccttttcctcagtttcttagaagagtttgtgtagaattgttattatttcttttgtcttttcttttctttctttctttcttttcttttttttttttctttttttgagacagagttttgctcttgttgcccaggctgaagtgcaatggcgcaaactcagctcactgcaacctctgcttcctgggttcaagcgattctcctacctcagcctcctgagtagctgggattataggcatgcgccaccacgcccagctaattttgtatttttagtagagatgaggtttctccctgttggtcaggctggtctcaaactcctgacctcaggtgatccgtctgcctctgcctcccaaagtgctgggattacaggcatgagccaccaggcccggcctgttatttctttcttaaatgataggtagaatttgtcagtgaatccatctgggcctagagttttctttctgtggaaaggttttaaatgaaatattcatgttctttactaaatattgaactatttatgttatccatttcttcttgagtcagctttggtaatttatgtcttttcaaggaattttttcattttatcaaagttgttgaatttattggcataaaattcatataatattccttcattatccttttatatctatagaatctatggcaattctatatctgttgatagcctcctttcctcccctcttctctctctgtcatatcagtatgactgggagtttattaattttattgatcttcttgaagaacaagctttattttcattgatttttctctgttgttttatatttcattgatttccttctttctgcttactttagttttactttgcttatttttctggcttttaaaagtaggagctgagtttgttgatttaagatctttcttctcttctaatatagccttttgatgctataaatttacccccaaatattactttagcagcaccccaaatattctgatctgtggtattttcattttcattcagtttagagtactttctgatttcccttgtgacttctaattgaaacactccaaatattttaggggttttccagggatctttctagtattggtttattacattaaatcagtcaattaattaattaagagacaggatctcaccctgtcatccaggctggagtgcagtggcgtgatcatagctcattgcacccttgaattcctggtttcaagtgatcctctcatatcagcctggcttttaaaaatcttttgtagagatagtgtcttactatgttgcccagcatggtcttgaatccttgctctcaagcagttttccctccttggcctcccaaagtgttgggataacaggtatgagctactgaacctggcctggaattggtttcttatttaactccattgtgatttaagacagacaaacactttaactgggtatggtggtgcgcctatagtcccagctgcttaggagatggaggtaggaggatcacttgagctagtagctgagtttagcctgggcaacatagtgagaccttgtctctctaaaaacaaaaaacaaaacacacctagaaacaacattgcttgtatgacttgtatccttttaaatttattggcacaattttatggcccagaatatggtctttctttgtagatgttccctgagcacttgagaggaacgtaattttcttctgtagttggtaggaatgttctataaatgccagtcagcccaagttggtttatagtgttgctcagttttattatatccttacggattttttgcctgcttgttctatcaagagaggtatattgatgtctctggctataattgtggttttgtttctttgttcctattgtcctgtgctattttgaggctttgttatttggtacataaacatttagggttatgtggtattgattgattgatccctttattattatgagatgaccacctctatccctggtaatagtctttgctctgaaatctatctgtctgtctgtctgtctatctatctatctatctatctatctatctatctatctatctatctgcctgcctacctacctacctatatctgtcagtcatgtatctcactttattatctcttttaattggagtattttccattcaaatgttaggtttgagactttcatgttgccatttgttttttgttagtcgcattttttttccttaccctctttccctgcagccttgagaatgaataaagtatttaagatttcattttatgtcttttgttcccatattagctacaattattttcctcttttttttgtggttgcattagggaaatactatatatacactatatataataaagatatataaatatatataaaatatatataaagatatataagatatatagtatatataagatatatcatgtatatatagtatatacatataaagatatatataaagatatgtaagatatatagcatatataatatatagtatatatctatcatatctttatatatataaagatatataacatatatattatatatatacagtattttccctaaagcaccacgaaaaacaaggaaataaaaaattgtagctaataagggagcaaaagagataaaatgatatgttaaatactttattcgtccacaaggccgcaagaaagagggtaaggaaaaaaatgcaactaatgaaaaacaaatggcaacatgaaagtctcaaacttaacatttgaatggaaaatactccaatatatttatatatatatatatatatacatactatatatatctttaatttacagtggtctaccttcacatgatgttatatcacttcatgaataatacaagaatattatatttactcttctatttacttacatttacgcctttatagcctttatactgtcgatgacatgagttttacttttgtatttgttaaaaaggctacaaaacattgttactatttctgcttaaacagtgaattatcttttaaggatattttaaataattaaaaaaaaaatcttgtatatatccccatgttttcacaggatccttagggtgtcacttcgtcagccagaaacctctgtggccagcgttgcctctgcttcagtttttctcattcctgctgggctcattccacccactctgcccgacaggctgcgctcagcttgtgctaccaacctcggtcctacgccaagggtgagccacatgcagagtggcaaggattgtgtgagcaagtgagcgcagggtctggccactgcacacagccaggcttaacggctgctgcagtggggagggcagctccaggtgcccgcacaggtaccggccccatgtgaggctgtggctggaccagatgtaccacaagtggcttccactgtgggcaccaatgtctctggatgaggggaatgcagtggcacctgaaagtgcagagaccgccaggaaccacagagccccaaagaggggtattaccgggctacctgaagggctgcaggtcttctctccttttcattgcctgtggtggtggggtgttatcccatttgtgttacagctgtcttagtcttgccatctggcaggtcccaagttcttgtctcacatccaggaagaatgggttatgtggacaattgtagggtgatcaaggcagaaaggaactttattgagtgacagaccagctctcagtggagacctgaagtgagtagctcctatctgcaggcaggtagtcccagtgagtccctgagtctggctgagtccagggtttttatgggctcagaatttaggaagtgtgtgctgattggtccatgggcagccatgggtgggcctggaaaaagcaccattctagtggccaaaaggcatcaaggaacttctcactcggggttatggactccactcagaactggcagcccagcccacagacttcatgccatccctgccttgaaggtgggatttcactgcggacccaccctttcctgccttgggacctgtctgcctcctgccgtgatcaacatgctgtccacagtaaggctgtctgtgccaggaggcacctgcaggcctatactgagctgccctcagcagctccagcctccctcctgtgcttacacccaatgtctggaggggcctgaggtagcagggggctggtataccagcatgaccctgagtgtgcacatatgccgctaagtcataacagtgcccagattggccacaactttgctccatgctgcattaggcaccgagagagcagggagaggccagagaagcaggagcaggcacttctgagcctgcagggcttcccgagcccccaagaacacatggatgcttgggtctgtagccacatctaggcagctgcagctgcagctgcacctgggagtgtgggttcctgtcccgccaactctgtaaggtgcagggctcctgctaggatcacctgttcctggcccttgctggttctaagtgaacaggccttccccactgcagcgggtgtcctcgcagtggccaatccagacgggccaccattgccaccatcaatgtggttaccatttcttatgcccttcatttctctgggtagatcctatttacatctgagcgtttttcttttgcctgaaggccttcttttaacatttcttactgagagaatttactgatgatgaaatcattcagcttttgtatgcctgaaaacatcttcactttgcctttgttttcaaaatttttttctgggaatataattttagttggacagttactttttcttttagtaatttaaaagtgttgctctactgttttctcttagtgtttgccatgacaaaatttgtgtcactcttagtttctggtaatgtaacttgtctttttttttgactgcttttaagtgttttctctctagtgctgcttttgagcatttggttacattgtgccttaccctagtttccttcatgtttcttgtgctttaggtttgttgagcttctttgatctaggattcatcatttttatgaagtttggaaattttgggttattatttctttaaggttttttccccttctcttctgctttaccttttcagggactccaattaaccagatactagatagtttgaactcttcctagagtttcctgtgctactttgatttttcttcattcttttttctctttgcatttcagtttggatagttgctgtgtctcaggttcaccagtcttttcttctgctatgtcaaatctgttgttagtcctattcaatgtgtttttcatctccgacagcagtttcatttctaaagatttggttacagtgtttttaaaaatacttacaagtctctatttaactgtttgaacttttggaatacaggtacaatgattgtttcagtgtccttgtttgcaattaacctcagtgccacttctgggttgttttcactttattgattattctactcattatgggtcatgcttttctgcctcattgtgtaactggtgatctttggatgccagacattgtgaattttaccttgttggatgctaggtattttggtatttctataagtcgccttgagctttgttctgggatgcagtaaagttacttagaaaaactttgatcacctggagttttgttattggcatttgttaagggaaatctggaaaagagcttagtctaggccttggttattcctcattacttttgcaagacctttttgagtattcaatctaatcatctgtgaagtatgagttttttagtctctctcatgggaacaggcactgttcagagtcctgtgcgagtcccaagaaatgttctctataattcttttgggtgtttctttccccagccttgagtagcgtccccctgctttcgagccagtctgtactgtgttgcaggtgaaccctctgtagatctccagggctctctctctgtgtaattctcttctctctagtcctctatcctatgaaccccagctgccttgatgtcctcagactcaactctgtctcctcaattcatcgagttggcctggttctgccccagtttcatctcctggtattgcaccctggaaactctccagacaataaggtgggtcagttatagggctctcatttgtttcctgcatctcagagattactgtcattagttacttcatgtctggtatcttgaaaaccattgttcatatatttttctgagtattttttgttgtttcaggcaggagactgtatctagtcactgtttctccatcttgaccagaagtggttctcccatatttcatttaacaacatcatgaaatctctttcagccaagctcaagaccataatttgtccttctctgccttctcttttgacccaatgccttgttctttcagtcttgtcagttcttacttcctagtatatttgacattcttttgtacttaatggtaaaaatctttaggtaaacatcatcattattaacttacactaaaaaatagtaaaatcattggaatggagggaatattgtcagaatagttataagttttggtgccctatcccagtgccatctttaaggtgagtattcagggaatatttcttatacatcttaattcagtgtaaaatttgcatgttttatatgttgatagagcagaattatttcaggatgagtatatttgtttagatcttttaaaaaatgtatctttagggaggtttgtgcttttccagactgagccagaatgctcgtactgcattttggatttacacacacacacacacacacacacacacacacacactacttttttactttccagtttcccctgttacttggtgtgctgcttgaaaccagacttgccattcttacatctccagaacctcataccatgcctggcatagtggcactcaattaaggtctgatgatttgtactgagtaagctatagttttaggcttggagcattgttaaggctttgcatagaatctctgcattatacagaatcttaactgtctctacattacagtataatccacatctgcatctttgcagcttgctattatacatctttggtttgctgtgaaagagctgtcagagaatgagctctttattgcttagaattactagttaactattgttttgccattgatcagaatgtctcctttttctgttctgctgtattcattgtggtattttgttgtaatcagagatagtcttggaggtgcaagacttattggatctccgtttgtgccattgtcgcaacatcactgacttggtgaggatcagtcaggggtttcttccttctgtttttgtcatggcagtcttactttttgaaacatttgtcaccttctctgatcctgcctcctgcttttccccatctgcactctgacctatactgttttagaaggaaaagataataaaggtcagattttataaaactctgttcaagaaatactgcataaagggctcttcaagataaaagactaccccgcttgtcaggcagcctgctaatttgagagtgctgacgacttaccttgatgaggcaatcttcgaattgatgactctttttaattaattgtcttttcattgataaaacagaattgctttgttttccttttactgcccatctcttcctcacaaaatatgtttcctctccgaacacacaaactgtgttttcagaatctcccctgagtctggaggtctggacagtagtgtgtttgtgtgcttgtgtgtgtatatgtgtgcacacacatgcacagcttgtgtgcatggtatctgtgatttctgtgtgtgcttatatttttcactattttggattcatccagttctataaagacatacttgcttgctttgcatggttctggctccctctgcagccccaaatggaaaagtgctttgttgtcttttgttgctgaaaaatccagctctcggccttctttctttgagtagagcatcccagctggtatacaagtatagattggatttcagatttagcaatgcattgtgttttgacaaagcttattgaagatggaagtcatttttcaggagcgctctaagaggtgagaaaatggcaagggagggtggggaggaaagggagaaaatgcagaagaggcagacacaattgcaacattgatttggtaaatagaaagttaatgtagctacaggtattgacagtaaactttggctaagatattggagaattgcagattggaaggctagagctatttcagaatttccagggccattttattggattatacaccttagaaccttaacacacagcttctgttgattagtacagtttggcctccagtgtgagtttggctttgaacactcagtgtgactttggctagggcttggcacctgtggacttcagcttctactttagtaaaatgaatgagttagaacaaataattgttacattcaaatccagatttatgagtgtacgatagtggcttcacattatttgttttaagttaccgttgagaatttggttctcagtaatctagagctactattttagcagaattatacatgggatgcagaatagaagcttttaagcaacagtcaaccagattggtctataataactccaggataaatacaagaagaatttctggacacattttgccccagtgaagtaaaattatttacattcaaggatggatttggaaatgcaggtatttttctgttgatctgcacgttggttacactggtgtgttcagtgtgtaattacacttccatgcagttatttttgtttttgtgttagatttcaataaactattattttttctaacagatcttaaactttaatgcttctttagagtactaatcaaagtactgttacataagtaatggctcatgtgtgcgcacaggtgtctgctctgtgaagtagtccatttcaaattataccacattaaattgtgtctgctttaaagggttaaaataagtacatgtatatatttagatatataagatgacttctatttaatagataattagaatgtttatgtaatagatttatgctttcagagatttcatattcacaaagtaagttttggaaccttgaaacatggataggtcagtgtcatttggtttcttttttcttcgtttaatccttttcaggacttcggctccctgtgagttgttaatgtatagtgtttatgaatccaaataacattcattaactttcttggaaggtcacagttatgttggttctgttcgaaataagtactataaattttttagaataaaaaaggaaagtattacagtgagttttgctatccacttgccactttcctttcccttcctttttttgttttttgttttttgttttttggtagggagggaggtctccctgtgttgtttaggttggtctcaaactcttggcctcaagcagtcctcccacctcagcctcccaaaatgttgggattacaggtgtgagccattgcacttggccctttcccatttttgtgcttgactagtataagtgtcatttttgttttcttgaaacctttgttctttcccatgtgaatacacataggatgacaatagtcacaaaactctttccgtacttagaagactaaaaccagaaattgttgcttgaacatgtaatggataattgttaaaattctgcactggtttgtactgttctcgaatttttatgtaaaggtctagtttagagatttattatttttattgtttagacttaaaaggaaaacagttagctgcggaatctagtttttatcctggagcgaaactcatataaccttgttgattttagtgggaattagaaagttcagactctttttttagaggtctcccaaaattgtttccactctatgttgaaaggaactctaatctacagaagtggaggtgacagtaaggagggcaggggatgctcttcccaaaggagtttctacaatgcagctgagttagagtgcagtagaaagagcgagatctcatagtggcatgttcctgtcacagcatgtgtatagcagtcacagactctgaacccaaagactgtatttctagttggagcagacattgactcctttttctgggctgaaaacagtgaagtgtattggttttggtagcttgggttataagaaacctaaattagtttgaagtggaattatcctgatgaaagggcagttgaaagcccttgacactggacagaggattgtctagtgtctaatcttggctcaaaatgcaccagacataatgagagtcattatgaactgctgatctcctacccctcccctcagcagaccctattagacttgcaaaaatagcaaacactgtgtgtgtttggcatggtgcctgctgtgtagtagaggaagaaagcgtaccttgtttgcaccacaaccagatactggtgcatcatgttacagctctgcttggttctgagctcctctgttcaatctcgtcttgacagatgctgtcgttgccaccccttagcaagacaaatgcagccactctgcaggagttggcttttgcccagctgtgcttgccagggccccaaactgatgtgcgtgtgtacctgtggaaaggtaacaggctgtgggtgtgttatcctctgccattatgtgcattaccttttgagtttttgccattcccgaaggaaaagttacggttttgtttgttcagataaatctgaaccctcaatttctcttactgcttttttcacaacagatgttgttaggcacccactaaagatccccaggaagggtccctgccccatataagctcactttctctgtaggtagaaagaaatgcaaacagtcacataatcacaaccttaatagctatgtgtataaaggactctgggaaaaaaggacggaggggatctttggaggtgcatgccaggagagagttgtctcatacgagctatgaaggttaagtattgcttaggaggtgtagatatatgtgttgccagggtccaaggtgaaaaaggagaagtggtttgaaatgagcttggtgaacctaggtttgggcctggttttgaaggctactggcaatagggaatcatcatagaattttaaactaggtgagtagccttttcaaaatttttttaggaagcattattctggtttcagtctggagaataagattatataaaaagtgctgagagttggaaaagtgccagcctattatgttgggagaaggaagcatggagaggttttagatgtgaccattagttcagatagagtagtgaagggagataggacttaaccaacaggaagagaaattaaagagagtaagaaaggaaggtctaaggttttcagctaatactccccaggcatagtatttatagggaaacagggaaggtagatttcagtttggggcagactggatttaaaatacctgcggaatatgtaggtattaatgagtaaatttcagtgtgaagtttgtacccagagttgagaatagagcaggctgggcacatagggttctgggataattgatgttacaaattagagtctggtttagcggttagagccatgagaccctctaatccaagtttgatgtcccatggcagtttgatgcaggatgggaccaacattatagacctactgttacctgctaaaaaaggcatttagtatatttcactcctgagtccagaaagccatttaccaagagcatatctgaatttgtgcggcagggaataatataacaatgagttctgtgtattcacaatttaggaattaatttcacaagaccacaggttggaaattcttgtcctctaatgggattgagcctttgtggaaagagtgtcacctgtattttcctcatctcagtagatgaagtagttactgtttctttcccacattcagccaatagcatacattttgtagaaagcaactaaagtttttcctccaaagctttaggcctcttctctttcagttcctcttggtaagacctggcctgtattggtcagtctgcctgttctttctacttggcttacaccatctgcccattgggacctacagattttttttgttttgttttgttttgtttttgagacagagtctctctctgtcgcccaggctggagtgcagtggcgtgatctcggctcattgcaagctccacctcctgggttcacgccattctcctgcctcagcctcccgagtagctgggactacaggtgcccgccaccacacccggctaattttttgtatttttggtagagatggggtttcaccctgttagccaggatggtctcgatctcctgacctcgtaatccaccagcctaggcctcccaaagtgctgggattacaggcgtgagccactgtgcctggctgggacatacagatattttttggctgcttataagtttttgttctcctaggggatttctgggacacttaaatatgattatatccatcagtgaatgaacaatccatagagttgacatcagtggtaaatacagtaatgtgagagtctaaaacgtgagccaaagttccatttaaaagatctaaatgcaaattatctcactaaacttgagaattattgatcatctctgtccctttctcctttttctctcccttttctttccgtcgttcctccctctcttttccctttaccctcttctcttcctttccccgctccctgttctctcttctctttcccccttttttcttcccctccatcttactttcccttctctctcttctcatttgatataactgacagatttgagcagaactgtgaggctcttaggagctgtgtgtgatgtggagtggccagatgactttatgtgagtatgcacgagggactgtaaagaggctgtccagaggccagcctccctccaggttgttcctaaccctggagagtcatcatatgttatttctcatctcagactgccacagaattgaggagggagattgaaggcagctcattaaaccactttggccacagataagagtgttaagagattaagaagtagatttatctgggggaggggtttggtcccggatgaagccttttcctgccgtcggaaaccaaagatttccttgtctcttttgttctgatccatggaatggtgtggcttagctgcctctaaatctgttttggcaaggttgtttgtaaggagacatggcagggtctgtctggagggaacagaaaagagagtacatattgaatgtagatgcttgaaactagatcatagtttacctaattgcagaccttgaagaaactcttggggccacttggatgggggtgcttctggaagtttgtctctgggggtatgtgagtatggacctcttccacactgagaagagggcagagcccagtcatcagttttcatgtccctgagtacaatattaggcttctttttattattatcattatttcaactggtaacaatgtttcccctcaggaaatgtctttacctctctgaagagaagaccgtgatgccagctgttagtttgagaaatgctgcagggtcctctcctacctgctgtttctgtgctctttccatgtgttgtggtgaagcccctacctctccagccatggggccttgttcttcatcatttgttcctatcttcagtttgggatgtggcaaggagaggcagagtgcactagagaaatctgatactgtaatgtgctaggagacagcatgatgagaggttttgggtgggaagtccatgctaaacatcttaaatgcttcagaaacttctttacagaattctctgcctttaggattctcctgttcaataaatatatttttcaccactttagaaataatcttcttaaagcccttccttgaactcatgcatctgtaatgactgcccatgaccagcagtactacattgtggaatgcaagacctaattagtctaagcatgaaagaccttttagtttcatcagctaagcccccttgtcctcccaggcattcctctttccaggtgctgtctccttctgcagcttcccgtaggcctcttcccactgctctttctgctcttctataaaactccacatttaatgcctacaccttaccaaactccaggaaacttccttgactcttgcgggctatatggatctctacttattttagtttttgctgttgcaggaggaaagtatgatttttaaaatacaataatccttttgtatgtctacagaagaatgtggtttggtgagttttacatttgatgcatgattgtatccaccattgtgagattataaataaatctcaagacatgaccttgccctgaacccaaaactaaacatgaatgaaactatagaaataactggataacctctggtacatagagggtcggtgttacagggagataagcagtacaccctaacctagggaagtgcaatgagcagagaggggatggagtatgtaggtggagaagtggctaagtgtcttagatagacaaggtggaaccaaagtacatagagcctggaagctgcagaaaagaacgtaggctaagaaacaagatcaattataggtggttgagtaggtgagtaagacagaaatgtgtgaggtgattggaagggactgctacgataagccagctgtgcttacaatggtgaagataaggaatggtgacttgggaagatgtattggagaaaaatgatagggcctgctgactgagcagctcaagctttatgggaactgctgatcatgtttttaactgctatagatatatttgatttaagtaaatcaatttgtaaagatttagatttcataatgatatcttagaccatatttgcacagcaagtgaaacttaaatactcttgtatccctatcacatcatgttatctttaacatgtgtatcaactttcttacctataaatgctggtgacacctcccagttttctaggcttaatttgtagagggctcaacatgtgaacaatgaatttggtgcaccattcaagaagtaaaattcaatcatttttttctcctattcatttctaaggataggaatctttgccttatagaaatattttaaaggagcccccttaaatgtcacactctctttaggcttaaactattcttatttccaaaatgtaacatcagaagttcagaaattctttctacttaggttctctgtgccccacacaacctcacatttttgcctgagtctccccagtcttgctgcaggagctggggtagcttcagcccacttacatcctgccaggggataaacttgataccttttgctttcatgaaacactatctgtgtgaagtgagctctttgatccacagtcttttatgctgaagctaagggaggattaaggaacacctctgagttgatgaatatttgatgaggtttatataatttaaaattacactcttgttaaccctttcactcaatggagagagaagagaaacttgtataatcgtggttcctacttaggcataaggtactgtgtcttctctgggtgcatcctccttatctatgtagagcagagcatgggaacttagtaaatgtcaattgatgattggcattttttacagcttcatagagagaaatatctctttgcttcattataaccatactgagtgagatgctgaagtggaattgggatcacacagtatctgtgtatttgacattgcatgtataatggtgaacaaggcagatattccactcatcataacaacaacagtagtaatcataccaccaggaagcattctttcagtgcttactgtatgcaaggctctattctaaactcttttcatccattttaattcttagaacaaacttataaggtagatgctattattatcatttctattttataggtaacacaacccaggcacaaagagactaactcccacaaggtttcacaacttacaaatagcagagtcaggatttgaacctgggcaggcagttctcagagcctgcgttcctaacttctggctggacccctcatggtgagaagggcagagagttgacaaatcctctgaagtatggtgagttctgtaggagtctgcaacagggcgaattaacctagggaagaggaaggctgggaaggctttcctgagaaaatgtcttttgggatgaaacatgaaggatgagtaggtgctctctaggtgagggctcatggacaaaactattccaacatgtgtagtggccacaggctggacagaataaaataggtgatttggaggaacaacagagagaagcccattaggggtagagaaagtgagagagtgtgtgtcatggagtgatgccacaggggccaaatcatgaagtcctccgtaggtcccacttccaggatgtgggtcatggaaatataaagggctaaggacaaacggagcattcaaggggtagaaccatgggtataacatgatgagatgtaagctttaacgtgtttctcactagtgatgtgtctaagtcatagagggagacagtagaggacaagagtgcagtcaggcagctgatgctgtaatccaggtgaaggaggatggcagcctggaccaaggtagtagaggtaaggatggatagaagcttaggagcttattaggatgcagataataggagttctggatgtgggagatgagggtgagggaggaaccagtaacaatgcctatgttaacagtcagaagaaggttacaatgtaaccagactggaacatgaacaaattatctgcagtggagcttatttgctcaaaagaaggatcctgcaagagaacatggatggcttgtgtcatccaaatatggatggctttgcccagttagagaataattcctgctgagagaatacacatgcacgcaagcatgtacacacgcacacacatttgttgtagagggttataccctcccaagttaaggtaatttcataattgaggtcgaccctctcgatgtggtaccattgataagccccagcactacagttcagctaccaacactgagtttctcattgagtcaaagcgtgggatgatctgacagcgtcagcagcactgcacaacagtgggagggacggatgaatgccacatctataaggaattgccacttggattcaagaggaaaaggggtaattatccacatgggtaacaatttcagtttcatttctcccttgagctaactctattcacctcaaacgtctttcctgtctagagaaccaccaaaagtgtcattctgattaccatttgtaactaggtgttttctgcttaacatttggaactgggtggggtgagataaattccaagaagatgggaagtttttatattgcagtttatactacagcagcagctccagtctgccctacagaccttctagattttttttttttttttggctgtgtgacaggtgcctgtggagtttatattttgatatttgatcaaactttttaaacctgagcttgtagtaaccattatagtcgtcatgcttgagaatgtgtatttgctagtagtatagagttaacctcagtttatgggggcagggattactttgtgaggaattaaatgtggtgtttgaaaaactgggaagtgaagatcttctgcaacacaggagtttctaaaggaaaaacaattgggccagactggatgaactggttagattaaatgctatcttcctgactcagggttattatttttggttgcttattttatttttaattgttgaagatttattgtaccatgctttgctcaggacagtgtgtaaggtatttagggaaagacctgaaagagacaggaagcatgagcccttccatcaggcacctgaataactgatggtggacatattgagaatacgtagaaaatttgtatcttatggtcatattgcacttcagacttttcacaatgcccttgtatctctgttacttgattctagttttcttggctcagcatgcacagttgttttctttacttgtttatggtctgtctctcccacttaaatatcaggtccttgagagcagatacttgttctcagctacagcccagcacctagatcaatacctgacatattgtgggcactcagtaaatcttaggaggataaatgaacaaaaaacctatcttctgaatatcagtgataatcatataaaacaggcttggtatgctaccatttatgtacttctgattttgtgttttgacaggttttcacctaaggtttgtagtagttggttttcctcagagaagtttttgggctatttttctttttaagaaagggtgagtgatgtcattatgaagttgaagctataggactaatcatatacttgccctgcatctatggtgacttttttttctactggaaagaaagcccgctattaaataattattacttccaggtctgagggagactgtccagcatctgcaagagttttgctaggatgcagggctttgttcccccactgggctgtgattccatccatggagtaagctgcattgtggtagcaagtcatcttgacagtggcaagtatagcatatttcaactggtgatttctgcatgatttgcatgaatttctgtatgacaggagtcacaacaaaactgttacgtgacttgtgtctaaagctatcagtcagctggagctgtgaaaatcagtttgcatgtgtcaacaatttaatcttctaatatgcttgccaatagaaaactgacactagaattatttttctgtatttactgactagaaagatatggttatcaagtgcactgattgaaaaatctttaaattccagtctttaaatcgggaccatatgtgtgttctttccctagccaaatctatttgtgcattcacccacacatgtgtatacatatacacacacagtacagttacattgatatgtgtttgcgttatatatgtatgtattcacacagagcatgcatatgcctcatgcatattcatgagctttaaatgtgcttatagattaagatataaggatgttggggaagtttccctatctgttaactgagaataatactactgcctaccttccaagcaccttgtaagaattaaattagttaatataagtaaagttcttagaacaaggcctggaacatagtatgtttcctataaatattagcttttattattttagagtatgtcttcattctgtcagcttcaaatgggcttcaaaatttagcttcagaggcagtatggcaaagcctcagaattattgcataattcatttgatgaatttactgttattctaaaatgcctgcaaacaatttatatgtcatgcaggaaatattggtatttgtatttctaaatcaaagccatttattaaataccttagtcatattgattcctgttatagtaaattacttctctttctatgtcatcattatctcctagggtctatcagggagatattttcagtgaatttgtctttcattatcagactaaaactaacttcactgaaaacatcttcatttgggatttgaaagagaacaaattttccatttactaagaaaaaaataggtgtttgtgtattggtataaaaataggtatgtatgtaagtgatcaaatagaaaataatgcaaagggacatagaagaatttgggaatggaggtaacatacacctagaaaaacagtgacaagggcacatactattttgaagcaggttttagcaggtaatgatggtactcactgtgggaggaaggtgtgaatcatcagtcaaaacgagtgtacaaactggtgatatgaaatgctgcttaacagttgttttaaataattagatttttgttggggataaatagttcattccagacaaaagtactagggactctatagctcatctaacttcatagattaaaatgaaggcccagataattaaagtgaagacctcagagttagttaatggaagtgcaagtttcaaaaccaggctgcgatgtgggggagacagtgtcctccatgacagctctttaacagatggcatagaaactcgacttgtgaccttgaggggctcacttcagctctctaagaataattccagcccagagctacaccatatatagagtctgtagactattcctaataaaatggttttcttgtcttagagaagagaaactcagcacatacctactttgagtcaggtttgggcatgctcgaaaagggggcagcgtttttagatggagactgctggagtagactcagggtctctttcagcatggctgcctgtgtgatttgattcatgtgcactttaaaaacctgttttatctaagtgtaagactgtagaagacatatatatttagggtattgcattgatttttggaaaccatttgtgtagggtacagtatctttgaatttcactatagtaaccgagttacaaaatgggccactgggtctgctgggctgagaaccatcaaactgaatggtcagcaactttgttcatgcttcatctactttttcttttcaatcatttggggacagataatcttttggtcgctttttagactaactttgagattcagaggggcagtgtattcttggctaaaactttttgtacgaggcacactttcttttaaggtttgtgattttacccttacgtatcagatttcatggtatccaaatgcaaacatgtatttaacagttggtagggatgggagagtttgaggacagcaaagcagcctactttgatgaaagggtcagatagattttaggatctgcaccctttcttagcatcctaagcattttgagaagcagttgtatgtaggtaaaaacaaacaaacaaacaacttggtagttggtgtcagctgaactgctttttactgaatctctgctgtactagctgtgtggctctgaggcttacttccctagtctgcaaagtaaaggtaatgatacctgtttcacaatttaaaaaatagatttattgaaatatatttcacataccataaaattccactaatttaaaatatatagttcagtgattttagtatattcacagagatgcagccatcaccacaagcaattttagaacattttatcacccatgaaagaaatcctgaacccaaaagggccatttcctccctaacttccctaactctaggcaaccactgatctactttctgtctgtgtggattcacctgttttggacatttcatataaatggaattatataatatgttgtgttttatgactgccttcattcacttagcataatgttttcaatattcatgttgtagcatgtatcagtacttcattctcctcaccccccagctttatattaaagtataattggcaaaaaagtacatatttaagatgtataatgtgatgatttgatatatgtatatattgtgaaataattagcataatcaggttaattaaacaccttaatccaaatccattgccttgcatagttaccattttttgttgttgttgtttgtttttttgggtttttttttggtgatgggaacactaagaatctactcttctagtaaatatcaggaatacaatacaacattattaacagtaatcaccgtgactgtacattagatcttgagaaagtacttattttcacaaagtttgtaccctttgatcacatcttcccatttcccttgtccttgcccttggcaaccaccattctactctctgtttttatgagttggatttttttgttttgttttgttttcaagatgggctcttactctgtcacccaggctggagtgctgtggctcacggcagccttgacttcctgggctcaagcaatcttcccacctcagcctcctgagtagctgggattataggctcgtgcccaccatgtctggctggctgattttttattcttatttttattagtgacagggtcacactatattggttaggctggtctcaaactccaggcctcaagtgatcctctcatctctgcctcccaaagtgctgggattataggcgtgagctaccacacacagccgaatttgatttttttgaattctacatgtaaatgagatcatacagtgtttgtatttttatgtctgacttctttcacttagcatatgtcttccaggttcacccaagttgttacaaactgcagggtttccaatggtgtgtagtaaaggggatccttgtatcgtgttgataggaatataaattgggacagcattatggagaaccgtgtagaagttcctcaaaaaattaaatatagaactgccgtaggctttatcaaatctgcttctcagtatatatctaaaggaaatgtagtccatgtctcaaatagctatctgcactaccatgttcattatggcattattcataatagtcaagacgtggaaacaaccttaagtgtccattgatggatgaatggataaagaaaatgtgatgtgatacacacacacacacacacacacacacacacacacacacacacacacacacgcacgcacacagagacaccctctgttatatgtgtgtattgtattatggaatattatttagccataaataatgaagttcactaatttttattgccaaatcatactccattttatgaatatatcacattttgtttatccattcatcagttgatgggcatcatatttttgtgacagtgaaataagacgaagtatataaagtgctttatgatgtcttgaatatagaagcaacgtgtgttttgttgtttcttttcgtctggttggtagatttctggtgaattatcagccgcccctcttgccttgtgaggcaaggaaagcagtcttattgagtagaccatctgtctgccagttctctcatgttagtcctcaactcatggaaaatcctggtgggcactcgtttgatactagaattcacactgcttttttcagcagccagaagtgtttgagtgttaccagcagtgcttgttgtcgttacagatgctccgtacaaaactgtaaatgctgggtttaaagggattgagggagggagccattgcggcttacacagatgtcaactaatctagtgttgatcctcattctgaacctgagcattgacaccaatatcaagctgtggggtagttatgttgtgtgcaaggcttggagggaaatagtgctttggcagttcagtgcttgccgacttcacaaaacacagaaaattgctgagggcttatgtgacagaaagttcatgttacacatatgggcatcttggcgagaaaagccactgatcgtctcagtgtaaggatttggaatttcaaaatcctaaatgattactaaatgacaagtaaaatcttgattgagatagatcgttgctaacgtccaaagagattatctaaaagcattgatttttattttgttggctgtggaaataccgtggaattcatttattaaaagtagtatgtctaagtttctacttattttagatactgtaatataaaattataaacaaggcccaattgttgttacccactaggcagatttttttattatccaagtttctgtttcgggccatgaaacaagttaaaatcaaaactttcgctggttgccattttaaagataaatttgttatataggctttctaagcttggttgccttgctccacaaagacaaaacattaataatagcttacatgtattgagcagtgaatctgtgctaggctttgtgttaaccactgtatatttggattatctcattgatctaaggtaggtacggttgttattcccttcttataggttaggaaactgaggctcagagagattaagtaacttgcccaatgttacacagcttgtaagtggcatttctgtttaaagcttcccattttataaagttttgtgtttttaaatatgctttagaattttaagtttttactctgttattatttcgcgaagtcctatgtctacatacacatcaaagcaattctgtggttcttagggaattatttaataaatgaaatagccatagactgtaattacattatgagtggcatcttttagctgtgcccagcggtagcccagttgctaatctttatcccttgagtagtcaagtagataagaagtggataagcaagtggagtggtggccactcaagcaggcctccaccagaataattccaaataacttcacacagtgaattgcaacccactcaatccacttcactggatagcattgctcaaaagatattcttttactcttttatctaccttgttggcaagcatccccaagaggtcttatgcctgtggcctacagatcaaagatattttctcaaatactgggaactttgctgctagttagaattaagcaaataaaaacatacacctccagaatgtaagcaaactagtttaaaacactccagccattgtattacttatgctttaaaagtttccccacaaaacctcattaatcatataaatattttgacaaacagaaaggggacagagcagacttattattttccatcttgtatgaatggctagacttttcatctgtgctcttatcctaacatgtctttaactcttctgtgctaagatttttatttaaaaacaaggaaattgagactcagtgagatgaactgctttatatcactgtggtaagatgtgttaatagcatttgaaaaggaaaagccaaaattttctttcatttatttatttatttatttatttatttatttatttatttatttattttgagacagagtttcactcttgtcacccaggctggagtgcaatggcatgatcttggctcactgcaacctccacctcccgggttcaagtgattctcttgcctcagcctcccaagtagctgggactacaggcatgtgccaccacacctggctaatttttgtaatttttagtagagattgggtttcaccatgttggccaggctggtctcgagctcctgaccttaagtaatccgcctgccttggcctcccaaaatgctagaattacagacatgagccaccacgcccagcctatttcttgatttttattagtcacctagccttattgtaatttgcacttatctaccattagaacatcataaacccaagtgatgaacagaatggatgtaacttagtgcgtgtatgtaatgcatatgatgtaacatacataaagacaaatggaaaatgcctgcaagatagtttccctgttgtctcatgcctcagcagtaatgaaacatatactgagtgcttattgtgggtcagttactgtgttaaatgtttgtcacgaatcatcccatccagttctcacaatcaacctgtcatgtaggtgctatttttgtccacatttttatagataaggtggctgagacttagaaaaagctaacaccacttgcctgtggtcatagagctagcaattagcaaagccattgcttctaaccagtgtgcattttgccttgcacaataaactacattaaaagatttactttagtttttctacctcccaattgaagccactatcagatatatagtctaaacttagatttgattctgtttagaaacacttaatgttcctaatgttatcaggaaatttgctgttcattttttcaagatctgagtagaatgtcacattctccatgaactttccatgatgctcttcttccaaatgtttctgtagcacctggttgtagcctggctcttaggattcccctgtctgtgctctggacttctttagaagcaccttgtctggttcagttactgcctttgtttgtattgctggcacattcctttgtgcttggtgcatagtagataattaatagatatttgttaaattgaactggatgcttaataaatgtttggatctaattatgatcttaactctggtgtgtacttcaggtacttcaggaaggtcattgcagcattagatgactatggagaccctcagtgttttagactgagatgacttgccattcctacaagagatcaattgaatgaataattggggctgatttttccctaagtattgcttagaacatatactgttttttttctcctcaaaaattgccagttatattgccatactggacaaaataaaactgttagctatatatctatatctatacctatataaattttaaaaacgtagcacaaagtttctgcaccatactttgtgagcagctctgtgtattccaaggctcagaaaatcagactttcaaagctaaattttaccaatatatatcccattgaaatttgcatgagcaagcagaaataatgtggatgttggagttaggtaaatgaatcaaatcctggttcagccactttctaggtatgtgattttgggcaagatatttaatttttttcaacatagtttttttatttttaaaatggaaaagttatgcactggcagatttggaggatgaaataatatgttgggagacagtgtgttaagttacttctcaaaaagttctattataattataggttgctaatttttggcatattttcattttaaaacttttattctaatttcattcttaaacagtgtaagcatattcacagtagcttttctgatcaccttatacccaagcactgccacatgacttctggtccagtgttccaagtgaaggccaagtaatgtcaaggtatgctgtatacggattttctaggagtgtgaataaagaagaggaatggagccatccatggatggcaaagtcatgccgttgcaataagtactacatttacatatttagtacagatcccatcttagaaagggtggatttggtcgggtgcggtggcttacgtctgtgtgatttcagcactttgggaggctgaggtgagcagatcgcttgagcccaggagtttgagaccagccaggacaacatagcaagacctgtctctctctttctctctttttttttaaaggctccctgctcatgaggaatggggagagggaagaaagggtggatttggagaaggttatagcagtgagtatggctgtaaatttgcaaggaataactttttttatttccaacagtgattgctttagataaatattttattgtagatttcaatattgttgcaattgtatttgactcagcaaaaatagtttttataatttgtcaacagaacttctttaaaatggcttcctaagttgtttcagctaattatgaggtatggtgatctcaacctccttccaaccactggtccactcttgagtcttcaggcttttttttttgcttcaagagtagcattgtaagtttttagtcttcagagaacaggaagaattctagtttctcagttcttgttctgatcaggattgtattttcttttcgtcagtttgtgctctgaaactgcagggccaggcagagtccatgctacctgataaagcatctggaaccatggaaaactgagggtggatatgatgagcctctctaataccagagatagtggacagaagccatccgttttgcatttggcttttttgaggactcagtaaatccacacagagaattagctaaggctgtttgagaaacagcctgtgggataatgaacacttttatgctttttaaaatgaccacggggagcctcatcagaagaggcgattccaggattccaagatggcagctgggtttttcattgttcctgtgggacttgcactgtgaagtgtgattgtagctgatttttcctttcaacaggaattcattaggggtatccattagctaatgaactattgatataagaaaaaaggtcagttattttagagaggaaaaatgtggctttaactctcgattatttgtgtgttgggtccatttgaaggcttcttcccctggctcaaaatctggaaaactgatttgaaagaccttcagttttatttagaaagaaggaaaaacagattatttcagttactttatgttttgtgatttttactcgatttacctaaagagaaagtgctcagatttaaattctaggtaccttcgttgctaattattttttactgcacttttatggccattttttatttctaaggattgaacccttttttttgtagttttctctcaagggctaatatttatatttttttgcttccaaaaactgttaaagtctgaaagtgtaaatttatatttgtggtgtttactttgtcctttaaatgtttttgtgtacccatactttttgtcataaagatggaaaaatgatattaaattaaccaaatgaaagtaattaatgctgaacattcactaaattattaagatgttaatgtgattccaaatgcagatagttcatgggcagcagcatgtgtcctgggactccccctcaaaggttggcaaggtttgggcaattttgagggagggagttaattcttaagtagtaagctttttcgtttacctctactatttataagctaatatgcaggatcattgtaaattagtgaaaagtgcattccattgaactagtagttgtaatactgggttaaatatctaagttgtgtgactttgggcatgagtttctgcctctgtgggtcttatttttccctgttatcagaactgtagcattggactagatcatgtttccttgtgtgttttttggaaaatgtgacaatatactaggacctacatgaagtcacagtataaacacccaagggacacaacaggcatatcttcctgcctttcatatctattcacttgaggcttttggtaagacattaattttatacttaagcaaacatattaaagactgaaaggaactcatatatcttcatatagtgttaaagatattaacacaaaaatgaaagaaatattgtccatacagcaggccacagatagatatcccttgttttgtgatcagtcttttctgctatggagggcactttggacacatttgaggatcactgcattagatgacaggaaatgtgtttcttcctatgctcaagttgtgtagccatgacatttgaggatatttacattttgaatttccctcctccctcccctaaattagtggcatgttctagagaagggttcatgtgctttatttacataaaacctatctcaatgttgtttgataagaatctgttaagagatcttgtcctaaaaggatggcacttagtgttggaactggagaatggtggggtgtgaggagttaaagtaattccctaagcacactagacacgcctgatgcccctttcaagccagtctgcttccacgtggtgattctttctgattcccattatcactgtgtccccctcacccctgccatttagcctagattctggcagaatggaaatccacgtttctgaatttagtatgatttttttttctttccttctattctcagcaacaataagtactcttgatggcagctgctgtattaagcccaagagcttaaaagattaaagaaaccactaacagcagtaaggaggaagtttaagggcctgtttttctgaaggtttgtgttttcattctgatggttgagtagaaaattacaaacaggttgtgttcggcagctggaatgctctccaacatctggggagacccagccttctgtttatttcccattcattggaagggtggccagccagtagcagaaactgcaggcagagatactagaactctttgggtacataagccgttagaaattctttttttgtagaaatttcttcatagaaataccttgttctctattttttcataagcttgactgagcacttaacttcaggtcagttgctgaggaagaggtctgaaggtaatattagtacccccccaactactttcagctggaaacaagagttgtttgggcccttactgagttcctactttagagtcaagggctggccttcccctgcatctgtctgcatatacctcacagctgagcagataacatatttgtgcagctattcccttatgatttcctctctattagagagaggtggagcctatgacagactgcagagtgtttgctccattcttccccaccccgtagctttactgaggtatagttgataattaaagtatttacatatatttaaggtatatagcttgattatgagatatataagtatacattgtgaatattcaaaatcaaactaatcaatcactccacatagttaccgcttttctttttatagtgagaatacttagtatctaccttcttagcaaattttatttatgccacatagtgactatagttaacaatattatatactcaaacccagttattttaatttttaatttttttagagctaggatctcgctctgttgctcaggttagagtgcagtggtgctatcatagctcactgcaacctcaaactcctgggctcaagcagtcccgccatctcagcctcccaagtagttaggactacaggtatataccgccatgcctggcctaatttttatttttagagatgaagtctagctttgttgcccagactggaatgcagtggcatgatcatagctcactgtaggctcgaactcctgggcttaagtgattctcctgccttggccccccagttgctgcgagaatggtgccttgttctcaaaaccattttgtaaaaagtaatgtgctggccaaataaaacagaacgccagtttgttatttttggacagcttcattattttgtacatgggaaaagagaagttcgaagttttgccttatgcaaggtcataaagctggtcagtggcccaaccaggtttagaacctttatctttggggctatttgagaaattcaagtgatcccagttcaatcattagtggcatttgtggtcttcagtctgcactgagcaagggtttcatgtttggtgtctaatattttaggattattagagctaatctagcctttggagaagccaaatggattttgggggttgtctgtaagaacccatcatgatggctggaacagctcttaagtggaacttctacataaatcaacttgcatttgttctgtaacaccatgtgaattttcctgaatttccaagtaaatatattttgcatattgcttacaaattgcttaggctgtcttcatgaataatgaaagctgtgctgtaggaagctggatattaagaaggggtgtttttaaaaacagtatttcatttcttttgcttatattttctgtagcctcaagggtgtgttcagaggtggtagggagggagggtgctgttaaggtttctcaacacctgtgttcctttacagaccattatctcttctgctatcaaagaggacttgccagttaggtcaggatgcataaacctctggacagtgccttctcctatgcttatctttgctatatgtcttgttgtgtgtttagcttccataacaaggttctctacttctccagtttaagaagaaatcatctgttgtgctgaacctctattcatctcagtagggaaggcaccagcttcaagaggctgagaagagacccagagccagcaaatgagacatggggttttattaggggcttacatacaggggagagagtccagtggtggcagactggacaacatactggcaccgctcagtggcagagggctgggcaggaaaactgcagccgctttgcaaacagcatgcagtttatatagcattttcaattaacaccctccccttaacaactttcacctggcaacttgcatgccaacccaaagtttagggcctcaattccctgtatggcccatgttccgtggcatgggcagggggctcagatgttcctcctagacaaggaatgaatctctggattggccactgtgggactccctagctcgacacacacattcaggtgcatctgccatacagtgtcattttaagggtatgctcaagttattgctctcagaggtgtttaccctactattatcatttgacaataatacctatatgtgacgtacattgtctagtgacagtcctgatttccagtagctcccacaacaacttcataagtatcatagccccactttttaggtaaagaaagcagaggtttggggattgtgtcttccctagtcgacacaccttgacagtgtagaaccagcattcagaggcaaatctcacttaggcctggtgttctttccaacatgcctcagctgctgctttgccttctctttctcccttcacctggcattttgaccacactaattgtgctggcatctcattccagggagtatgggatgagatgccagcactagagtatggctttcaaaacattttttgtcccagctcacagttacaaatacagtttatgtcatcaagtatacatacatatgcacatgctcaaatgcacatacatacctgtgcttacatgtactcatataaaactgaaagtttaattatatatgcagtaaactctaatatttccttttctgttttacactgttaatacatactcacctgtaaccgttattactcactaaattggttttacaatcaagatcacctgcggttgaaacagtgctatagagtggaaatctttacggtgagttatgtgctctctcccctcaaccccttacgagatttttaggataatccatgggagcacgaaaaaaacggttgaaattatattttgatttatttccatcttaaggaagagattaaatgttgctgttacttaatatccgagttgacagtgcagcatcactcgggctgtgaaacagtcagtccagtgctctgtagagtgtggcaggtcctgaaggaagagtgggagttcctaaagtggcacactccttcagcctttcgttgtgtgatgtgctccagtttgtatggctcataaagcatgttagtaggttatattatttacttttggcaaagagaacaagtggttttatttttatttttcttttgagacagggtctcattccattgtccaggctgtaatgcagtggtgtgatcacaactcactgcagcctcaacctcctgggcacaggtgatcctcctacctcagccttccaagtagctggaaatataggtgtggatcaccacgcctgactaagttttttctttttgttctttctttttttttttttttttggagagacggggttttgccaggctggcctcaaactcctgctgaagcaattcgcctgccttggcccccagaagttctggtattacatgtgggagccaccgcaactggcagagagcaagtgatttttaagagtttcatcaaagaaactgtggaatgagagaacataaacacagggcaacagcaggaaaatgacagagttgacttttttgttttaatgagctccttatcaaccgcatcgctgggtacaaacagcgactatatagtcatatctagtagggagtcagacaaaaaattgaagctattttaacaagtgagaacttaggtttatatccatgattgttaatgatttaccttgtcctgaatggatgttgtaccctgagatattagctaatatcattatgttggataaaatattaaaagttgtattcattttatctttgtgtcattccttatgtttatttgtatattttatgatatatgtgatatatctgtgccttatagttacatatatattggggaatatgttagaatttttttgtactgataaagattcctaattaaaaacatttggagaccatttctattctggaggactaagtaattattaatgggtatcttggggtctagatgaagagaaggaaaaggtgaggacacaggaagggagtgaaacagggagggtgtttgtgtacaaattagataacaaccctcccaagtggattcagttccaggggcacatggtttggtgagtggcctgtgccttcgtgcaggttataaaaagtctcccctttctcctggcatagcagctctacactagggcacatggtttggcaaatgggttgtgggctggaattcagcaccctttcagcccttcatccttctgcaagtgtagcctacacaagtaagtatatgtaacagccctggtggtgaggtactgaaaataaataaataaaagggcgaaggacaggcattcatggatgtagtgagcagcaacagctagtcctcactcttttattcattcattcattccttcaccagagtatttatagaacacctgctgtgtgccagccatcttcaacagcaggagttggcaaactatagcccaccggccaatcccgacctggtatctttttttgtaaatcgggttttattggaacatacctgtaccccttggtttatgtatcttctgtggctgcttcttagctataatggcatagttgaataattatgacagagactgtatggcctgcaaaacctaaagtatttactttctggccctttactgaaaacaggcgtgaacctctactctagaatataaatcaggacttgcttctggtgccactgcatgataacttagccatggactgtttggcttctatctcatgttccctacttgcaagaaaatacttccatcagggccaagtggaggtgcagtagagcaggggcagagctaaaagcaacacagctgggcacatttacttcttaggtctctacacaaaccatgtagtgtaaggaggagacaaagggctaggagtccagagactgacactgtgtggccttctctctgggcctgtttcagatagtcactctgcaactacaagatggcactggattagtgattctcagacgtttttctgcaccaaaatcacctaaaaggctggtttaaccgactgctaggctccacctccaaggtgtctgagtcggtaggcctgaggaaggcctgagaatgtacatttttaacaagtcctcaggtaatgcaggtaggcagtatgactggattgtttttgtggttgcctgcctctttttggcattggaaaggggaaagccagagtattccttgaggaatgacatttggagagaaccaaattttagatgcttctgtgatatgtacaccagagctattctggactagattgtaaattctcacatttcacctatgcaaaaggaaatactttctggtctcctattagtaatcagttgtctcaaattttgcccgttacctctggaaattctggaccctcaagtgatcagtcttttaaggcagtgtggaagaacagcacctattatggcagttgatttttcatggtctctaccctgtccttcctaatataactgctattctttaccttcctgtttttcaaaactctcgtattgttcctgttgtgttttttctaaatattttcttggttacaataaagtgctaatatttaaagagcttttgggagcctgctggtgccagaaactattcaagttacttacagaatactctcattcagttctctcaaaaatccttggggaagttttatttttctcattttacaaatgagcagtaattacaaatttggagtcagagaagctaagtaatatgtgatctggacaatttcaatatctatgtatatcaaaaaccaagcttcctaggtctttgacctcctctccagtatccctcaccttcacctgctaagtatccattctcattttggatctcggactttgttatcacctaggattcgcccaggatttcactttctcggatcatgaccttccacatcatactgtcactgcatctcaggagtctgtttcttggaaaagctttacgtctcttatcctttttcttttccaacagaaatacctttctgaactatttctctctcttaaacctcttttaaaatctgcacacttcatactaaattgtattgattatgcttctagttccctagtacataataacctttggaaaaattgttttgtcttactaattgtttctatagaactctgtactgcacctggtgtatagaaggcactccataaataatggtttaactgagctagagaatatatggccagggtctgagtccgagtctgtcttgcttcacagtatggctgctatagtcaggtctgccacagctctaggcctatttttttttaatctgtctggatgaagaaggaattgtttagtaggtgatgtcatttgtgggatgctttgtctatttctgcgtatccagcatgcttttagtgatttttcattttgtcagactgcattttctcttttcaactagagttcaaacaaaataattttagataacatcctaagaacatttggaaacatgacatttcaggtctattttccctctttgccttaaaaaagtatatacagctataattactaattgctgcgctctaagtagagacagatgatacatatgtttgtgacaattttccagagggagagctaagtaaccaggctcatttttccataatgtgaatgttattcacaaactattaccataattgatgcaccaaaccactgtagagtaaataatgtgttgtgtgtgggaagcaagctagtagtcaatgaatattaaagaacaaaacctcattttaaaagagaaactgtaattaaaatcattctgaattcatgctgcacaaccagttaaaataacttggctgccatttatctgtgtaattctgtgtataaagggagtaggtatatgatttgttatatagaagtaagtatttacatgcacatttttatgaaaagacacaatatcgaacttcagaatcagtcgttttccaaaaacatttgttggagagatgaacatgcagagttaatcagtgaaatatatattgacaggaaagatcaccatttccgttatcttatcttttgcttttctaggtgttttatgtctacctggaatgtcgtgtccctttccgtggacctaatcagcttctgtattttctccaaagcttccttttcatcagaagttgttcttgtccacttttaatccctcttactgctttctaggtgctcatcaacttctgtgtgtggtatattgatttgcacttttgggatttgttgttttataagaggaggtcataagtcatttcttgtgtgtatcattagtcttctcaacgagactgcctaggatttcagtctcagattattctatgtgtgtgttgggcgtgtatgtatgtgtatcattccttccggtgtaccttgtggagaatggtttgctgtccatgtgttcgctaactcctcagtatgtattgttggttacctgttttcatgcaccagatactgcattatttttgtaaaatctttacattttgtgtttggctaccagtgtctccacagagtcttgaatgtaactggtaaggatcagatctgttggtgtagagtttttgatggaacactcaatcagcaatctgtagtatggcttatgtaaaatgtataactccctctatctctgataagttctgaagtctaaggggaaagtgcttccctgtctcttgaatttgagtgttttgggtgagtccattttatagatagacaaggtgattgtatcagagcttacttttatattttaaaatggatcatagtgtacctattcttaggaaccttttaggaaaatctctttaacattgatcctgttgttagttgtaatctcagtatattctgataatttcctttgaatatgtaactgttcctttcatactgtgggcatctgttgtcttctctttttatagcaatgaaagtatgaacagattccaatgtgggttcttagctcaaaattctctggctctaatgtcaggccaatttatttagctagtttatacaactggacatatttctataatagaaaaatgactaaatgtttcttaacatattgtttacagagatagagcccatgttgtaaggctatgtaactcttcctctcaaaagaagattattggttttagcatgttttcctccctttaatttaatcttaagcaggtgaacctttttgagggctttttggaaagctctgaggaaaaaaaataagaaaactcatacaacctcaaggaattctaagtatcaaggagcacctctgtgaaggtgattggttcaagcattgaacactattttctatccttccacacatggcagggcattattcatgtatccagctctgtgatagcttgtttttgcttgccctgatgatacgtatggcaagggaggaatattatccaggagtggacactgtagagaggggaaggaaccttggaactgacctttatagaggcggttctcatcctcaactcttcttccttacaagatggcttggtatcccttgagatcattctcccaccttcaaaatcctggatgggcctcttgcctggttcccttaaggactctaaaccacttagcttggagctggtgccatttaattctgttcttggcagtgggccctggcttctttcctgctaggccctgtacctcttaggagcagagaagaggtcagatgcagataatacaggcatgatttctgcctcctgaaatgctcagatgatatgcacttctccgtccccctaaagatttaaggaagtacacatttatcatgggatgtaatgagtaggaaagagcatggggctttctttttctgctgaatagcagattgtaagatagaaacagttttgtttacaattcagctctatctttgtactttgcattgcagttgaagttatttttagctttactgttaagctaaacgtctgagttgtttcatttgcaaattctttctttgagggtcaggggaggcttttgtaaaatgttcaggtctgagagaattttgagttaggtaaaggtgagtgtgtgcatgcatgcatgtatgtgtatgtgtgtgtgtgtgtgtgcacagctcgtgcataaatgcctgtgtgcttgcttgggtagggactaggagggctgaaaaagagagagaaagtcattcttagcagaagaaaagcacgtacaaagggtggaagacgtacggtttttgacagatgaatgaatccttctaaaggttttgtaagagctgtgaccagctctgtttgctgagaaaagggaaagtccttgagcacccatcatacctcttcagactctcttaaaaagcattcagatgttctgccagaggaaatgatgtgttccaactacagctgcagtggagggttctttttgtgcagctgaagcaattcctccacatagattgtcccattttaacagtaaactgtctgtttaaaacaaaacaaaaaaggtgggtgggaaatggaaggagaaggagtttatgccaggaaatgaaaataagttgctgcagaagcctgttttggttgtggtttcagagttaaggataagttattaataataataataagagcccacttgatagtttgttatatctctgtgtgtgtttttatgaacttttaattttccagaaaacattaaagataaattagagaacacactcctgttggaggaggtgaccatcttgcagctaccaaaccatagaatctttcaccacttaacaccttccaaggaaccgggtagacttctggtgtcctctctggtcctcttcccttccttataggatgtcaggctttggacttaatcagaggataattaaggctctatcatagcaggtgaagtttctgagtggaagtctaagaagtgatgtttctataagtgtctttagctgactgagctactaagcagaggttaggaggttgtgatgtaatttaaagtgacattgtggttaccttttatcaagctcaattgtgagcctggagctatgttaactgcttcacagctatgagcctatttaattcttacaggaatcctcattttaagataggtttgattaccctccgtttacagatggggaacttgaggtagagagataagtggttagtttgcaattacacccagcatttggcatggctgggattggaaccaggggccttcagtcttcaaagctcttacatgtaaccactgagtgatgcattgtactctctcctgtaaagtagccttttctccctgctgccactggttcatttccttttccttttttaagatgctttaaaaagaacaaaaaccaataacgtacctcctaaattgaggttgatctccctccttcctatccaataagtaatgttctagactcatgcaaatattagatatttgggagaaaaaatgaatagaacatgtccctcctctctttagctctaagaaaatttgtgtgttcttattaattcctactgttccactatcctaccatattacctgatacatataatacagttacagtcttctcagggagactcttctatgcagtggcatgctggagccaggaaagcttgtaaacccagctcagacatggaccagctgtgagaccttggtgaagtcactttaccctccgggctttacttcttttatcactgtagtgtttgatccaggtcagttcgcagcctggaaggcacagccttttccaggacactaaatagggcacatgtgctacccatttgcgtgcacactatccttaggcatttgttgaagagatggttaataaaatataaactcattaaaaagcattactaaattcttacattttgtgtttctttgatcagtgaatgactgctaaaatttagtacgttatcaatggggaatttgttatctctttttgcataaaaggggtcctcggttttcgtgaagtttaaagtccctccccaggtagaatatccataaagcctatgaatgagtcttaactacttgattacccagattctagctttttggaatctttcattaccttacttttttcccttctcggtgagcttttggacttaggacaaacggggaacgatcacaaggaaatggattgacatctctactctttcacaatctttcctgaagacatgatttttttttgctatcatgtctctaagtacagttggtcagttgtcactctgtcaccttaccttccaaccccataattcctgtgaaaccctggacacctcactctttttgcagaccatgagctcctctggcctcactcctttccttgtccagcttgcagtacttgagtaatcccctcacccctcaccaccttccttattagtacccccagttccctgaagctcttgtcctgcccatttcctcccagcagcatgtcactcatctgccctcatgagcctgtgttccccttacaagaatcacatctctatctgtactgttattatagatcagtgaacttcaacatctgatagctttttcagtgttgcccatcagtgcatttaccgagttgctttttctatccttttggtgatagttccaaatgctccccactgtccccacggctataatgataggaaacattaatacaaaacttggttgtgttggagaaagtgtgctaagaactttacatgcattgtctcatctccgttcttgctaaaggatctaacttttccttccaaccatccagcaactactagcgaggcatcaactgtgtctatgcatggtgccaagccacagactgtagctatgattgatgcagattgggtgcttgctctcaagagacctctaattcagagggagatgcacagaagtaaacaggcagcaataacattgtccgataagtgctaatgaggggagaagttcaatacgctatagatgcccccaacccagacttagggttgaggataaggaaaacttgcaggaagttacagctcagtgccaatctaaaggacgagagactatgagggaggaacataagggcattctggacaaaaagaatacctggctgctggaaagatttcagggaattgagaggggccagtaggaacagagccattcttctcagagaaattagaggtcttatttttggtgtgaattccatagactctcttttctacctcctctgtgatctgtatcctcacttggttactaactggaattagaatcccctgcaatccttcactgtatgcagatctcgtaagacacactttctgtcaatctcagtgtgaagttttactatgcacttgtatagctgctccactgaaatactattagactgttaaggtgagtgtagaggacaatgcttcttcaaaattattacagggaagtttataataatggtgactgacttgaggtaggggtagggtttttcaggagggtctttcagtggtaatcacgcctaaaattttgaatgcttaaatgaagctgctgcttagctcaatgataagtaatagcagcttctttttccatgaggacatttattaaatgatgttttaggtctcagcaaatgttacgccttcagacaccttggctcaggaaagcctgatgtgcctccagtgaaggatttgtaggtccacatcttcgatgcttctgcaacacagagttagggaaatgaaacagtgggtcatacatgctcctgatccattgccaacagcaaagggacttgagcccccacataccttttgacccttctggtcatgataaagccacccactagctataatgctatagtcagcagtagaaataagagggagcacaaagcaactgaatggtaaaatatttcagacctttttggaccactttggaagatggaagctgataacatcatacatccaaattcctctgcattgctgtctctctctttacaggtggggaatagtttacagcaatcagtagaatctacttttgattccaaatgggtcttaattattttgtatttgggaaatattttttacttggcaatagagatgtgccataatattatttaatattttggaaatcactgtttcccatgtgcctgaacatctcgagcacatttaccctgagcgtggcagtgcctgggtgtctcacatccatgtatgctcaaaccatgctccttgatttcacccctttctctctgtttctttcatctcgtaaactgagtgctgatgccatttcacactttttcttggaagtttaatgagttagtagtagtataacaaaaataaaaatattttctttacgtttctgaaaagaaatatgtctataaagcgtcaatcatttttccaagctgttagttcctgctgctgagtactaggagctgttctgtcagcaagaccacgtaagggggaatagtaagagaaagctgtcccaattttctttctctggtacaaaaggttagaagatgttgtttcagctggagaacttaagatggattcttattcactatttgctaaagagactggactgtttttagtgtgataattttctgtaggcgtggagaaaggtcacctcctgatcttgttttggagatcatggggttaaatctgtggcagtgtccttttcctagacacagcctcttgtcaaaataatgtttggccaggtgttaatctgtgtcctgaggggagtgctggaattcattattcatcccgtgggagtaggggtcagaggagaaggttgtccttctgggaggtaccaggggacatagcctgcctcctgcctttactgacatgtgccatttgtgaggagggcagttgaagtccatttgaggaattctcttgtcagccggccaacacagaaacacagagggagtgggagggagggagaggcaggcagcttggcaaggcagtcctggagtgcagtttccggagcaagatcacacacagtgttttaggagctcagggaaggtgtgcaggaacataaaggggaagggggccaggtttgaaagagtggatttttcctattttttccaccttttattcctcctgtctttgaatacttgtcatcctttggaaaactcagcatcggaaagaagcctttgctgacacactgctttttctccagcgctatattgtgggttttttgtttttgctcttttcatttttcttttcctctgagggcaggaggtgagacaatgatcaagtcaagctggttctatgttaagttcaagtatgcagagaaggtaagtcaatatggtttcttttcccaggggaaacctgccacctccctccagtcttgtcatgttgatgggctcctctggccacttggggaagtgaatgaagctgagaagttgtatttgtgaatgtatttcctttggcttaatgatccttggatgaagcacaagctctttgcttgcaatctgacgttgccgctgaccaagtggaagcaatcttcagactctgttccggaggcatgatttagagtttaaagaggggaaataatgaaactacaataacaggaaaggcaggatattctgctttagattgaatagagaattttcaaggtattatttgttacaaaggtagatatatttttggttctgaaacaaattgacagtcacttcctattacctgttggcttagaatttttttcctctttcagttaactaactgcttactcatttgtagtcttacttggttgtagaaagaatccccataaggttgtctgaccatatatgagatgatctctttactgtctgtcaggggattatattttatgaatgaattttggttgtacctaaaattttgatgttaaacagttccactgtattttaacataccatttctggacttttaggggaaaagtgtactttctaatacatcttcacttaccggggctgtttgacatctttttggttccacatccatatgtgtcacttactctgttgggaatttacaggattagaaatgaggtttccaggagaggatatagctcagaggtagagcattggactgcagatcaagaaatgagatttccaggaggatcctaacgtgtgcctcccttttgaaatcttccctccttgatttgattgttgaaaacgttggcatattgattgtagagttaagctgaggctctatagaatggaactgtgatgtggcaagatggaaaattgtgcgactgtctttatactccttatgattatatgcataagcacattaaatatgcctcttccattcacctagtttaaaaaaaaagttagaacattttcaactcctttttactgcattttttttttctgtgtggacttgtttctgctgtgtttttaagacagcaaaattactctttctttacccatgttgaaattacaggatttttatttaaaatatccattttttattttaaactcacttgcattgttaactattaaagctattataagtaaaatattatctattcatgcacaggattgggaaagattgtggtttgggatttttttttctcagtagattactttcctttgagaagccgaccatccattgtttgctgttatgaattttgataactgaaaactgtactctgccttcttatgctttcccttttatcttgaatgttctgtcatgggaacctgaaactcaagagttaaggcacgtaaataaactaatgtgaaaaggggaaaagcatttccagaaatgattgtcataaaaagaaaaagaaggagaacgttaagttaattgcttcatttgaattaccatgctgctattcctttagcaaccaaacaagcagagaatgcttccatatggcaaggcacaagtgtaatgtaaagctaagtaatgtaaggctctatacctaattgaaggatattcgtcttgattttatgaggatagaagaaaaagagaaatctcattcttgttcttggcatggttatggtgctcaagatctcagtgattctctgcagaacttttgttctttcacaatgattcaatttaaaaattttcattggagatttttgttttccaaaactcatcaagatggattgagttttaacctagagagataataagtcttagtgtaaacacagggacagcattgataacaaaacaaactaaaaccatcttttttgtattcctctaaaaagccattcttacaaaggctttttgatttggaatttccctcactatctttaaaaggacaaaaaaagaaattcctctcttgattgtcaactactgaccattttgatttgatataagcttgtaattgttggaaagatatttctgctgtgatgtttgtccaaaactataagaaaatacatcacacaatctcttcaatatccatctcctagtttatcatttaggaagatgatttaatcagtcttcagtagtgagaaagaaaaattaagaatggcaagtaacgcatgaccaaaaacattggcataagagaatactgttcacttgtgatcactggaatcatgatccctttcaaaaattaaaatatataataaaacaaacactgtttttttaaccaccaccacactaacacacatgttcctctgtaagaatttccatctaaattatttatgagttgtctctttcttgaattagattggtgcctagctatctttctttctaaaagagtgcttacttcaattaatttcatcctataccccctttctctttttattctacatattctccctgagcaatttcctttttggtgtgtttttctatgtcctataagtgatgattccaaaagctctatatctagcataatatctttcttgagtttctgaggtatatatttaattggttaggtagatatctgtcctgaagttcaacagattcctcaaatgcagcatttctaaagtatagttaatttcttcttccttaaccaaggattttcttcctcttacatctcctagcacagctaaggcatccctatccagccagtcatctttgttcccaaaggagctgttttagttctgttcttatcatctcccttctggcttattagaggagcctcctaatcgatctccctgccacattcatggtgcttccagtgctccaaaaccctgctagaggtatcttaaaaggtcagtctgagtctgttttgctgcttgttaatggttcccctctcccatctaagcattctcactacatctccctcaacagtgctagcccttgaccttgtatatacataatacaccttattgtaatttcttattcacctgcgtcttctatagtaacatatgatcctagagatacagaattacattgtgtttttgattttgatttttctatccagaatccctgcacgtaatagatatttattccctgttgggtgttgtggctcatccttataatcccagcactttgggaggccaaggcgggagaatcccttgatcccaggagttcaagacaaacctgagcaacatagcaagacctcattatctgcaaaattaaaaattaaaaaattagctggtgtggtagcgtgtgtctgtggtctcagctacttgggaggctgaggtgggaggttcacctgagcctgggaggtcgaggctgcagtgggctatgatcccaccactgcactttagcttgggcgacagagcaagaccctgtctcaaaaaaccatttttcccccctaaatgctactgagtaaatctgtgactttttcccaggagtctggccgacctgagtttgaattctgcttctgccatttactggtagtatatgaccttgggcaatatattgaaactcaattgaattgttttctcatctattaaatgaggagtattatcacctaatgtatttttcagttaaacttcttattttgagataatggtagtacgtaataatagtacaatatgcagttttaagaaataaaatgtaaagatcccatatgccctttacctagtttcctcaatggtaacatattgtaaaaccatagtaaaatatcacaacaaggatattgacatcagtacagtgaaaatacagaacaaccacatcaccaaaagtctctctcctgatggcctttgatagccatgcctctttccttctaccttcacaacccccatcattaactcctgatatgcaatcacttttctccatttttataattttgtcgtctcaagaatgttatataaatggaatcatacaggatgcagctttttggaattttctgtttttactcagcataatgttttagagattcgttcaagttgtatgctattagtttctgagtagtattctatggtatgggtgtaccatagtttatttaatcattcttctgttgatggacatctgagttgttttcctagaagtactatgaacatttgtttataggttttgttgtgaacataagttttcttttctctaggataattgtccaagagtgcagttgctgggtagtatgtatagtatttgcgtggttaatttttaagaagccaccaaactgtcttcctggctgactctactattgcatattctctttagtgcactgtattagcgattccgtttacttgcgcattcaccagcatgcaatgatgttggtggtgtttctggttttttattttagccattctattggtgtgtactgatggtgtccagtgatgggttttaatttgcgtttccctaatggctaataatgttgaacatcttttcatttgcttatttgtcatttgagtatcttcttttgttaaatgtctcttgctctttaaatgtcttttgcccattttctaattggatttaaaaatttttactgttgagtttttcacagttcctaatattttctagacagtaagtctttattgggtatgtggtttgcacatattttcttctaatttatagcttgtctattcatcctctttcagagtcttcctcagagtagaagttttaaactttgatgcagtccagtgtatggatcctttcctttatattcttgcttttattgtcaagtcttaaaactctttgcttatcctttgatcctgaagatttttcttttccttttttcctaaaagctttatatttcatatttaagtccatgatccattttgagataaattttttataagatatgaaacttaggtcaaagtttttctttgtgtgtgtgtgcgtgcatgtgtgtgtgtgtgtgtgtgtgtgtgtgtgcacgttcctgtatatgtccagttgttttagcaccacttatggaaaagactattctttctccattaaattgttcttgtacctttgtccaaaatcagtttactgtacttaaatgggtctgttttgggtttctctattcctcaattgatttaatgtctgttcctctaccaagatcaaaaagtcttgattactgtagctattctttttcaaaattgcttaagataaaatagtacctgtgttttttcatataaattttataataacctcatctgtgtttacagaaaatctttccggtgttttgataagaattgtgttaaaccaggatattggttttgggaattttttttttaagtactttgttgagtctttctcttcatgaagaggtttgtctctccgtttatttagatcttgtttgatctcttttatcattttgtagttttcagcatacaagtcctatatgaattagatttataactatcacttttggggggcacttgaaatggtattgtatttctaatttagattttacatgcatattgttagtatacagaatacaacttattttcaaatgttgttttttgtatcctgtaaccttgataaatggagttattagtttgaggaacttatttgtagttctttgaaattttctgtatagacaattatgtcatttgcaaatgaggacagatttatttcttcctatctgatatctatgctttttaaatttccttttcttggctaattgcactgagtagaacttctcatgcggtgtgaactaagagtggtgagagtgaatatccttgtcttgttcctgatatttggggaaaaatgcattcagtcttttgctgtttagtacaatgttagctgtaggatttttctctatgttctttatcaaattgaagtagttcctttctattcctagttttctgagattttttttatcatgaatggatgtagaattttgccaaatgctttttctgtgttaattgatataattattaggtttttcttttatagcctattaatacggtagagtacattgcttgattttcagatattgaaccattcttgcaagcctggaaaaagttctatttagtcaatgtgtataattctttgtatgtatcgctcaattttatttacttatattttgttaaggacttttgcatctgtacttacgagaaatactggtctgtaattttctttttgtaatggttttattatgaggatattactggctccataaaatgatttaaaagtgttcactccttatttgtttgctggaagagattatgtataattggttttcattcttctttaaacattgtgtggaattctgtagtggaaacccatctgggtctggaaacgtcttttttagatattgttaatttaagaaattaaattttcttaatttaagttattgggctacttaaattactgtttttcatatttggtgggttctggtagtttttctttgtaaggaagtggtccacttcatctaagttgtcaaatttaagtgtgcagaactgttgatagtattctttattgacttcttgatgtctgtatagttatattccttgtttcatccctgatattgataataatgtctgtgtcttttttctgtgtcagtcatactagatgtttgtcaattttattgatttttttcaaagaacaagttttgtgttccattgatttttctctcttgttttcctgttttcaacttatttttttctattctgttatcttaattatttcttccatctgcaagctagaaaaccaggaaagctggagagtgtagttcagtctgactctgaaggcctgagaatgaggggtccagtggcgtaaatctcttttcaagactgaaggcctgagaaccacaagggctgatgttccatctccaagggcaggagatttggatgtcccagctcaaacagagagtaaatttctccttcctctgcctttttgttctgtttgggtctcaatggattgaatgaggtccacgtgcccaaatagggcatcttctttaataagtctaccaattcaaatgctattctcttccagaaacatactcacagacataccaaaaaataatgttttaccagctctttaagttgacacataaatttaacaatcacatgtatctttttttaatttttgctgcctatattgttttatttaaagagagtttcttatggatagcatagagttgattcatttttacaagttactgtatcattgctctttcttctgtcctagtgacttaagatcctttcttttagctatttttttttaaaaatagaacttcctttagccattcttttagggtagttctcccagtaactatttatttatttatttatttttatatgaggttgtcttgattacctgttgcttactgaggaatgtttgcacttgatgtagaattttggttgacagtttcttttgtctttttctttctttcttttctttttctttcaagccattgaaaaatgttgttctctttcttctggccttcagggtttctcatgagacatccactatccttcttttgtctagatgtcatgacttctttctccctggctgcttccagatttttttgctatctttagcaaagtttaactatgatgtgtcttggtgtgggtatctttgagcttattctgttttgtattatcatagctttttgaatctgtaggtgttgtttttgccaaatttgagaattttcacccatcatttcttcatgtacttttaaagccctattttccttttcctctctctctgggactctgaagacacaattgttagatctttggttataatcccacagatacctgatactctgttttttgttgttgttttgtttgtttgttttgtttttcagtctctttttttctcttttgtttagatgagtaattttagttgttctttcagttcactgattctttactctcctccacctggtcttgagcccatccgttgaatttttttaattgttttttttttatttttatttttttgaggtggagtctgctcggtcccccaggctggagtacagtggcatgatctcggctcactgcaacctctgcctcctgggttcaagcaattctcgggtctcagcctcccaagtagctgggattacatgcgtgcgctaccatgcccagctaatttttgtatttttagtagagacagggtttcaccatgttggccaggctggtcttgaactcctgacctcaggtgatccgcccaccaaagtgctctgattacaggcttgaaccatctcgcccagctgatttttaaaaaaaatgcattttactctggtaaagatgtatttaatgaaatttaccatgttaacggttattaagtatacagttcaatactgttaaatatattcacattgctgtgaaacacatatccagaagttttccatcttgcaaatctgaaactctttacccattgaacaactccattttccttgctcctctcagcccctggtagccaccagtctactttctgtttctctgaatttgactactgtggataccttatgaatatggaatatacagtatttatctttttggcactggcttatttcacttcataatatcctcaagtttcatccatgttgtagcatgtgacaagattccttcctttctaaggctatataatattccattgtatgaatatacggcatactgtttgtccattcatccattggacatttgagttgcttccacctcttggctattgtgaatagtgatgctataagaccctgcttttagttctttttggtatgtatgtagaagtgggattgttggatcatatggtagttctgtgttaaattttttgaggaacctccatagtgttttctatagcagttgcaccattttacaatcccaccattagtgcacaagtgttctaatttctccacatcctcttcaatacttgttctctgtttttcttgatagtagcaatctcaatagatctgaggggataatgcatttctctaatgattagtgatgttgagaatctttgttggctacctgtgtattatctttggagaaatttctattcaaactttttttcattttttaatcagttatttgtttttcattgtttggttgcagaagttctttacatattctggattttaaccttttttcgggcatatggtttggaaacattttttcccattccataggtttctttttcactctgttgattgtgtcctttgatgaacaaaagtttttaagtttgatgtagttccatctgtctgtttttgcttttgttacctgtgcttttgttgtcacatccaagaaagattgtcaaatccaatgtcatgaagcttttcctcaatgttttcttctagcagttttgtgattttatacttttatgtcttacatttaggtctttatccatgttgagttaatttttgtatatggtgtaaagggtccagttttattcttttgcatgtgagcgtccagttttcccacaccatttgttgaataaactatctttctccattgaacggctttgacacctttgtcaaagattgtttaaccatgtatgtgaaggtttatttctgggcttgatattatattccattggtctgtttatctgtcttcgtgccagtaccacactgttttggttaccacagttttgtaatatattttgaaatcagaaagtttaagtcctttaactttgttctttttctaaattgtttggtgatttggagtcctttgagattacatatgaattttaggatgcatttttctatttctgctaaaattgccattgggattttgatagagattgtatttatggatcatttgtggtactatggacattttaacaacagtaggtataacaatattaaagcccatggtcaaccacaaacatggaatgcctttccatttatttgtagctcttttatttcagcagtgttttgtattttgggagcagtgttggaagtctggactccagtacttgtctttacagtttccctcttttctgattctttggctaaagacaacaaacttttctaggggcttgttttggtatgtgtcattgacattactgggtttctgttttttcaactccaaatctgatgacatcatatatcatatcggatatatgagacctataaaatgaaaactcctggagaactcaccaccatgtcatttttgggggcccccaggttttaagccagtacgtcatcttcttttcacttttcagagtctgtttatatttattttatgtataatgttgagggattttagttgtacttagtgtggataatagggaaaagtatgtctactccattttcttggaagcagaagttccctaagatgcttttaaaacagtggttaaataacataatgttgagagtatttgcatggtgcaaggcctgagtgctcaatagagggtgataattgccttttattatcttcatctttctcctatttgaagtatcagtcacactttgctatagaggcagctccagtttaagtttaccttgctttagataaattgtattatcactaacacatacatttgcatcttcataccctttattgcaattccatcaagatgtagattccagaaacaacattgtcttttcagtatttttctttttccaggcaattttgacaatgcatttttgtaataagactggaattactaattctggttttattgaaaaactgttagccatttcagccagaagaagatcatggaggaaacaataaattttcttcatgagctattcaatccaacgagatactgaattaagtgcaggaaatcagtacactttttgtttgataagaagtgttcctctgaaaaaccattcttagatcattataaatattattggttggatgcagtggctcatgcctgtaatcccagcactttgggaggccaaggcaggatgattgcttgagctcaggagtttgacaccagcctaggcaacatggtgaaaccctgtctttataaaaaataaaaaaataaaaatttagctgggtgtagtggtatgtgtctatggtcccagctaattgggaggctaaagtgggaggatctcatgagctcaggagattgaggctgcaatgagccatgattgcacctctgtattccagcctggacggacagggcaagaccctgtctgtctcaaagaaacaacacacacacacacacacacacacacacacacacacacacacgcacacacgcacacacacacgcacacacacccattaccagtcttcctgggaattttattctatatctgtctataagtttaaagttatgtactctagcttagcctttaacttcagagttaatttgaaatttatttaaaaactatttttggaaatttacataatcatgatgactgcatgtaaactgttagtaatattttatagagtttccttgggttttctgttagaatgaagtaataaatttgtgtcagaaaactatttgggaaatttagaagaaatttaagctaaggaacataagctgtggagcatggccctaagaatccttttattctcatttgataaacagtagaatccagacagggaagaaccttattttctctgcctttgctagttggtggaggaaaacttgctgtttgagacaagtaggacttgatctttctatcctgtacttttttcatcatcctcaaagagggcttatttcagtggatagaccattcatagttttgacagctcaaataacccttaaggatgagcaacaactgaaaagttccaagggctttatttccaatggaaggatttcaattacagtcattttttcaagttagtacaaggaggtaaatggaatcacagtttcaaatgttaaatttgaagactacaccattaccagtgtattttggaaataaaagatgcagccaatctaaatcaaagacatgattccagattacctcataagagtatgaggaagactacaggcagcaattgagccacttgatatggaagagtatgcagtgcatcaaatgtgactttcattaagccgtgttacccttgtttgctactgagggcaggaggcatccttttcaacagcctgtaatagcttcttgttgaaaggctgcctgctatacagatgcagcagcagagagagaaaagagggatacagattcacatattcgccttgttttttaaatgccatttttgccatttttggagttggtttccagtgcttagaatagctgtaagtatatagtagttatttactgtatgtttttgtgtgagtaagtaagagaaggaattaatgaattaggctttataaactggaagtttttgttgtgcacacattaagctaagcttctatcccttctcttctccacatggtaccaccagacttttccccacttcaccccctcatctaccattttttgttttgtgtttttgtttgtttgttttttgagatggagtctctcactctgtcgcccaggctggaatgcagtgatgccactgggttccagtgatcctccagcctcagcctcctgagcagctgggattacaggcacctgccaccatgcccagctaattacatcaaccttttaaaacttatttttctctctagaatttgtttgtgtgcacttaaagagtaagtgggaggatctcaagacagtacagaaagagttggacatctagttcagttttgcagagggagtgcagagaaacttccttggagttatataattgatttttggaacctcatttgtaggatagttgtgtggagaaaggcattcaaattgcattcactgtacttcttaggccaaggtagatctggttatgtacatacttgttatttggtagaatactgcttatgttggcattatcttttccatactacatttatgaactggaaacagttaaagcttgaaactgttaaaaaaaaaaagtgtacgcttacattgtatgtattagaagtcatatgattacacatcctcatcctctcaccagtcctttcatgtagagcagcggtttgcatctttggctatacattggaactaccttgggaattaaaaaaaaaattgatgtccaagtatcaactctggagattctgattcagttgatctgggatgaagccttggcgtcaatttttttaaaaagatccccaggagtttacaatgtgcagtgagggctcgttttagaatggtatattgatttgtgttccaattgttctttcttgcataaatcacatctgtaattcattgaccacagttgtctatgaggcttattaaaaatggtataacaacttacacatacatgaataattggaatgcagaatcattttaacttccctttcccagtctttctatagtcagtttgtatttaattcaacaattgttttttgagaggcccacatttattaaatgtttatcttgtccagcttaatttctctagaaacaaaatctcaccttcattttgtacttatcactggtttacatgtggtaaataaaattagcagaaacaggtttgggtatggtccactgtggtacacgggtgtcttatagagatgagtattcattggctatgaaatgttcagtaagttttacaaaggaaacgaagatcatcagttgatctagctggtcagttggggtcagttaaaagagcattattgtaaaagatttgtggtttgcctgattttagatcagttaacattcacccatgagaaggtaggatgtatgtcatttttattttataagtgaatatgtaactgtatttttttattttgtatttaaatttttattcaatatttcaaattaattaatttctaatgttaatacctaatatacatagatataatcaatatgatcactgttatctctagagtgaagacagtttcttgccaacaatttttatatcccattataaccatccagatgagttcattatgggctttcagtacacactatcagcgcttaagagtcttgagttcattctggtctttgattatcacatgtcttgaaatacacaccacattagatttgtaaataaattgtagaaaaatcttaagactgaaatttagatattaacaaacattatttcctcttgagatatgctaacagacatcagagcattagtaggtcactaaagagtgaagatgagtcagacccatcaaaatacatatactcgttctaccacttgatatgtacacacttcgagttggtaatttattcccagttgtttgtgacggttgcatttgtgcttatcttctcttagtttcacaagggtagctaatcatgagtttttgtctgtttttgctgaactttacctactgtcttattaatcttgtttatatcagtgtgagtttcttaaggacaaggactcgtaggcaccaacacagaaagcaattttaggaatatactgtctgaattaaatgtattaaatcagtcaacaaataggaaccttttgagaaatggtcctgaaaacatttttgtttgctttttttcctagagaggaaataaacgggtttataagctgctgagtgcaagtatcatggtctgtgccttttcttcttgactgctctgctatattctctttcagaaagctgagtagctcagcacagtgaatactaaagggaatgcattccttctctctcaggggactgaagcagtgtttaacaccactgtaaaatcctcagctgtggctttctctggtgtagaatttgtctaagaaagattaaaagaacaaggaaagctttgtgtgctgtttctctttcttttcttcacccctcctgctccaggctatcctgaggggggaaaaaaaacgtggagtattttccttggacctctggagtatgcatgttatgtatgtgtgagtcttagagaaaaataaaggcaaatgcaaggcatgcctgctagtgggagtcatcacccatgggtgaaatgaagaaaactacatgagtgcgtttgcgtttatacggccactttttccattgaatgacccaaacaagatgccagtgacaaagcattggtcctacatgtgataaaacagcggcctggccatttgcttaattggtggagaactcaggtgtgttactcttggcagaggtgaaagccttcatagagaattagaaggggtataatttgggcactgtactcagaatctttcttggtatattgtttaagagcttcattgcagtgactgccattcagcaagaaataagagatgacttttaaatatttggccagattttatagtggcaaggacagagttttagagctgaagagccatttagttcaatcccatcaatctgcaaatgtgaacagtaagcccagaatcacatttagtgttagtggccagaagggagaccttggctatgaacatttaccctaccggaaactaatggcgtaaccagatttgaaccttttcttccattctgtactaggttgtcttttctttgttaggaaaagcctattataaacggaacattgacatgaattttaatttttgcatattttcttacaacatttgcccttactgcattttataactaattgtatatacttttatattttcctttttgtactcatgattctaatgtttctatgtggcatttctcacaatctctgtggggttttattataatttgctaaattattcccttgtttgggggcatttatataaactttttttttttttgccatgaaagagaaagccacagcaaacaatgtatatatgtagctctttattctctcaagttattgtttttgttctcatcatctgagttattgggggtgacttcattacagcagtggaaaacacatggtaacctgccagcatcagaaggtgtcgctttgtactgtgtgtgtgtgtgtgtgtgaaggttatgtgggtatgactgtgtaggaaagaaaaaaagtgctactctttgtagatcaaacaattgatgagtcttaatgtaggattacgtgttgcctgttaaattgctatttctgctgagaaagataaaggcatttttattagtgtagttgattagctttattaatgttggacaaaatcaatgttatgaaaatgaaatctatagttttggggtaaaataaaatttaataggtaggtgacccattcatacacttatgtgaagtaatttttgaaatgataacatgcatgaaaatttactatctatactaaatgtatattcaaagatattcttcctctagggttctagttataaacccttataaacccttataaaatactatgattcacatatacaacttataaaatactgtgattcatcagacagctctagtttcattttatctattgactctgatttaaattatcactcttttttatgcaggaatatgtggtaacaagttatatggtaagaaatttaaatgtaaagattttgacctaacgttgattcagattgtagagctgtcagttgaaaagggaaacttcatgtttagaaatttgagttctgctgggcgcagtggctcacgcttgtaatcccagcactttgggaggccaaggcgggcggatcacgaggtcaggagatcgagaccacggtgaaaccccgtctctactaaaaatacaaaaaaaattagccgggcatggtggcaggcgcctgtagtcccagctacttgggaggctgaggcaggagaatggcgtgaactcaggaggtggagcttgcagtgagccaagatcacgccactgcactccagcctgggcgacagagtgagactctgtctcaaaaaaaaaaaaaaaaaaaaattgagttctaaaatgtttgtgaaaaatttgataggttctttaataaatgtttatttccaacaaaaattttcctggtggaggagttattaggaccagtgagcatgcatttttttttaccgtcttgattgtattatcatattagcttcaagaaatgtttgtttcacgttacttatctttgtttgtcaatgaggtcagacactttcccccacgctgagaacagtatccactgcctctgaggtggatagtctctagaaatcctttccctgtcctggagcagtttgcctgaaagtgccatagttggtagcaaattcccttccactcctcttcctgcctgttaacactttctggaaacccaggtccccatgtgctttagcactctctgtaatcatttgtgggcctctgcagatgagcagtctgggagctgtggatgaggggctgggcaacttctgtcatgtgccattgctgtgagatcttttcttcaccagaatctgggggtgatttagaataatggttagttagtgacatgaagttttggaaagttttttgttgacatttttaagaagaagaaaaactgatgatgaactaaaataaagctgttctttcagccatgtctctgaaaccattgagaaggtttccaggtacattttgggcagtaaagaagatgtggactgggcattcctgtaatcccagcgctgtgggagcctgaggcaggaggatcacttgaacccaggaggtctaggccacagtgagctatggtcatgccactgcactctagcctgagcaacagaggaagactctctaaaaaaaaaaaaaaaaaaaagaaaggaaaagaaaacgtgccctgtttttctgttgttgagccttatttattttccttgctctcagcagctctgtggttccatcacttggctgccttcacggtgcctctgactagttttggaaatagaagtggtggtacaaacaacggggtggagttgcaggatacattgtggtgatatagtcttttcattctctatatttcagccaatatgatcttttcaaaacacaggttacattatagcattctcctgcttaagatcctctagggcttcttattacgctaagaataaaatccaaatacttggtcatggcctatgaagccgtatgtggctccctgcccacttccattcccactgtccatctaggtcctcaggattcccttatcaaactttcttcagttgctctaccacacatccccatgtggtgggttccattctgtactgtagctcttaactcaaacattagctctttagtgtggtcttatcttaccaaccatctaagtttgccccctttacttttttttttttttgagacagggtcttgctctgtggcccaggctgaagtacaatgaagaatatgattcactgcagcctcgagctcctcggttcaagtgatcctccagcctcggcttcccgagtagctaagactacaggcacgtgccaccatgcttagctaattcttaaaaaaagttttttttgtagagtcagggtcttactatgttgcccaggctggtcctgaacttctgggcttaagcgatcctcccgcctcgacctctcaaagtgctgggattttaggcatgagccaccgtgcccagccgctttacttatgtcttactctgttattgtttcctctgtatcttcttaataccacttataaacatctgaaattacccctttgtaaatgtatttgcttatttattattattttcttctgacttctttcattgaatgaaagtaagttccatgagagcaggaccttagggatgttattaactgttacatccccagcacctagtgctatgcctagcagtgagtaagaacattaatatttgttgaatgaatgcttgaatggccaaaacaagcccctgttatgtggcaggagctgtgctagcagtaaaaaatttagataagttgaattcagtctctgcaaacaatgttttccataatctggaattgttgtttggaattctttacagaaattcacatccaggctcacttggaaaaataatcttgctgattgtaatttttctcgttatggttgttcttggcagtaaagtcagtttccaggtgagaatgttactgctcttggccaaaggccactgtaaactttccagtattcctgagggtcttcaggccttactccttgaataagacagtgctccttgcttgaagaactaagttttctgagagtagaagggaacaatagaaagtgtacacatcagcattaccagtttattgttttctggacagttatccaaatttgcttaaggacttaattattaccagatcaaataatgttcccctcactttttagtctagtatatgctgtatgctaccctgtctgtgattctgatttcaaagtgagaaacaaattagcaagcagttgtttggtgaattttaaatgcagtggtgacccttgcccaatctttcataaaaattattttatatttaatgagttatatcttggggttccacaaatagtaggttcgatatttaggattaggtgcataatacctggagttaagctttgcagagctggaatttggactgtgtgtcttggccagaccctggaagcacaaggacaatgttgagatgaaaagattgagaatttaaaatctgtaagaatttaaagccattttacatcacaccataatttctcttcgctggattaagacatttcacagctatttataaaggagtgatttgctactataatttaattcacttgacaatcgtaggacattggatccatagttatgtcaagctagattagatgcaaaattggtaggaagacttttgtagattaaagacatatgacagtgaaatgcagaatttgagcttctattgaatcctagttcgagggaaatgctgtgaaggtcatttggggacaactggggaaatctgaaagttggactgcattagatagtattgaataaatattaaataacctcttgagtgtgttaatgatattgtaattatggaggacaatatgttccctttcttgttctttttgctttctgatagggtcttgctatatttcccaggcttttatagagcagtggtgtcatcatagctcactgcattcttgaactcctgggctcaagggtcctcctgcctcagtgtctctgtagccgggactacaggtgtgcgccactatgccctgtaaatttttttaaaatattttaatagagaccaggtcttgtgatgttgcccatgctggtctcaaatttctgtcctcaagtgatacccctgccttggcttcccaaagtgctaggattacagggatgagccaccatgtccggactttaaaaacattgttttccaatacgtcatgactattttgactatttgattggttttaaaatatctagttcattttcatgttgttccagatgaattcacttttatattgtatcagttgatgccatttcaaacttgaaaggtaaaagtagtcactgttcttcaaaccaaaatgactactaagaggtgtgcgtgtgtatgtcaggggaggtggagggaaattgtggatatgaatgaaaataatgagtgtaactttgatcacacagataatacatctacagcctttactaaagctgcctttacagtttctggcttcagagatgtggtaagtgcctcttgaaaggttgatatattacttttaacaacataaaaatgatatttgccttttttagagtctcttttttgttcactcagatttaaatgtatcatctaacagtcttctctttgtgcccatgttcttccatgagacacttagaatgtctaaaaagatgagtttggtattgttctagccttccctttgtttttaagggggactttgagtctatcaagagtgtgtgtgtcagctaagattgtatagctggctggtgcaggagctggaatttaatgttgtttttttctggcctctcagtacatcacattgtcacttaagtgagatggcaagcatttcaggtgctcttacatatatctgcaagcatggataacatttaatgccagctctcataattatgcatcacttgttgaattatttattgtacataccctactataaattgtaaactcctcaagggcaggatttttgtctgttttatgcattgcttttttttgtggtatgtagaactctgtctggaaggtgataggcactcaacaaatatttattgaatgaatgagtgaatcaaaatagaatgaactaggaatagattaatggctgctcactttgcaggatttcagggaaataattggtcagctttaacaacacatccccctctaactagctgatctaaactgaaaaattagacactggcttcctgtttaatttcccgtactcgtgggagtgataatacattaagctcacttaggtcagtgatttgacaacttagagtgaatgatttcaacaacccctttcctaggagcactttttgttgggggcagggaggacgggtggagtgctactaagttgaagaaaagtacagatggaaaggggcaggaaaaaagaaagacaaggagatgcaaagacaaactttgagcgtatcatgattttgagcaggacaactttgctggtatgtgggttaagaaatactttggaataaatggcatggtctgatctgtcaaacttgttcatggtcctgtggtcccaagaatctgtaccatgtaatttgtaactccagatagtcaagacttgaatttggtaactcttgtaattcttggtattgtgtatggatgctcatgtacagtttcaggagagtaagctgttgttcccatcttatgtgtggcttattatatcatgagttattactgtttgtcagttattcctgggtaacgctgttaagaaaatgctggcacttcaaggggtttgaggaaatgttgaggatcagatttatttaatatgtgcaaaattctagattaggtagaaagttgttgaaatcatggatctaaagtgaaaaattgagctttttagagcacctattagagatcagacaatttctagtgtagagcctgacacataagagttacgtaataaatatttggtgtgtgggatgagagggaaggagagaggaggaatgttgtgagcagctactcattgaagttgtgaatgcagccaagctgatggttccatagattgtttttctctatgttgaggctttaaatggtatccttaatttactgctacctttcagatgaatgcaactggacatcaagtagactaggggaagaagagtacatctgttttccctagagaacagggaccccccgccccgggccatggaactggtacctgtccatagcccattgggaactgggccacagagcaggaggtgagcagcaggctaacaaacattaaggcctgagctcctgtcagatcagcggcggcattagactctcataggagtgctaactctattgtgaactgtgcgtttgagggatctaggttgcctgcttccatgagaatctaatgcctgatgatctgaggtggaacaggtgcatcccaacaccatcgccctcccatccccaggtctgtgggaaaaattgtgttccatgaaaccggtgcctgatgccaaaatggttggggaccgctgacatacaagaagagtaattcaaaaaacagaaatagcaatacaaagttgcagtctgaatttgtgcatgctattttacctcttggtgcctcaatttccttatctgtaaaatagggttactaatgtatatttcattgggttttttgggtaggagtaaatgaggtaattggtaaaaaggagtttagatacagcatctactgaaatatcagccagtagaagtattttgcggtcaatttgttttgtatgtgcccagagggaagggaaatatgcttaccaattttgttcattgttaccgtctgtatagaattttgactatttgattggttttaaaatatctagttcattttcatgttgttccagatgaattcgcttttatattgtatcaggtgaggccatttcacacttgaaaggtaaaagtagtcactgttcttcaaaccaaaatgactactaagaggtgtgcgtgtgtgtttgtgtgtgtgtatgtcaggggaggtggagggaaaatgtggatacaaatgaaaatatgagtgtaactttgatcatacagataatatatctacagcctttactaaagctgcctttacatagtttctggcttcagagatgtagtaaatatccactggaatgttagctcttaaagctggtggtcatatttatataggttgggtatcccttatctgaagtgcttttgacagaagtgttttgggtttgggataattttggattttggaatatctgcattatacttataagttgagcatcccaaatatgaaatgctgcagtgagcatttctttggagtgtcatgttggtgttcaaaaactgtttggattttggagcattttggattttcgattttcagatttgtgttcctcaatctctgtggtttaaggctgagagaatagatctaatcagcagtcagtagagctcattagtagaggagagaggagagttttcttttaagaaggctatggggtcttgtgaagagacgagatagcttgtatttaattcacctgacagtcattagctagtaaaaatgaaagagagtctgggaactggaacagagagctggaaattcagctccttccaggcagatctgccttgaaattccggggaaatcagaacaggaacctcttcatttcttcatttcccttcactgcgtagtagtttattttgtgcttttggtaaaatgattcaaggtccaggagacatcctgaggtgatgcagtgtaggaaagcatttcagaaaggtaagatggaagacagatctgggcacagcaatgtgaattggacatttcgttcatcctttgggcttcctagaattagctgtgatccataggactgtcctgtccatcctggtgttctctcagaatcaggagcagctcactgtgcgaaaacccatctgaggaaaacaagaatgagctgatggtcactgtatcccaaattgacacactagttaggtagcccttgggtgtgaacttccttaaaatatttaaggaaagagactgctgttaacatactcagggaacaattatatgttgtttaccacatgacaagagaagaaataaacgttagacatatttctgggagcttagataagttgaaatatggaggaattaaatgctatatggtatgataatataaatcatttgaaagttgaaagttttgttagagctaagaaaggccttgaaaccatccgatctcaatcctgtaccttaaaaattgggaaactgaagctgaaagatgggcagtgatttctcccaaagttttgttgcaaaatacagggcttgtcttgatatcggaatactttctattctaagacattttttttgtctttaagataaccagatatgtatctgagggtagaacatacctcctctgtactatacctttgaagtttttgtttatatatatggtttgtgcatacttatgtaagtgttgccctcaaaatggaaaagattcaattaggcaagaatatcaggtgttgaagtcattttatccaagagctatgaagtctcatattagtcagttgggcatatcgtcttcatgacctttttgctagtgttcccatctgttgtatcattgctgattgtgtccatgtgagacggaaaaggagcattggactcttagcctaggaaccatataacaactataatttaaagcagatgttattaacctagcataaaagatgtgagaagtctgaagtgttagagccagagaaaaggtgagattaaactcaaatcttctgaatctaaaagccttgttccttccaaaataaagataagcatatccttctactggaaactttacagactggcaagagtaagaataaaaagagcaggtgatatatgattgattgtgccattattgatagttactgatctgttgcatagtaatggagagcttgattggatggtgatcctccctgtgtgcctcctgagtgtatttggaacatcatccaggaaggccttttaaagaagacaatacttggagaaggttttgaatgtttgaaaagaagcatgggccaggtgtagtggctcatgtccataatcccagcactttgggaagccgaggattataggagtttaccagtcctccagtgggaggatcccttgaggccaggagtttgagaccagcctgggcaacgtagcaagacttcgtctctacagaaaaatgaaaacataagccagacatggtggtgtgcgcctgtagtcccagctacttaggaggctgtggcgagaggatcgcttgagcccaggagttgaaggctgcagtaagctgtgatcgcaccactgcactccagcctgggttacaaagtgagacccatctcagaaggagaagaaaagaaatgtggtttcactagagttatggaatcaggttaaaagacagtattacctttaatgtaaattggtggcacatctctgcatcttagcctcaactcagaatattattggtttaagagtcagagagcttaggggtaaaaggctctaaaagcctctgaatttcaggaggttggtactttcagcggtctgtctccatctctcagcactacttcctctatgggcttcttgtggttcagagacaaagacgatgactgttctgcctgctcagcagtcctgggagagagcaaggctcatcgtttctgtgtccaacaacaatcttgcagcttccactttacagtcctcctttggttatgtggctattcttgactgattgactggatatatgtatagtcatcccactataccctttagtggggcgactctcatggccctctcagcattcccgaaactgctgggaccctgaggcaggtggggttaattcttcaaaagagacttcagctactgttaccaaagagtgaataaaagggctgaggtggcaaaaacaataatgggtttttgaatatatgttactaggctaggcacagtggctcataattccagcactttgggaggccaaggaggaaggattacttgagcccaggactttgaggccagcctgggcaacacagtaagaccttttaaacaaaaattagccaggtatagtggtgtgtacctgtggtaccagctacttaggaggctgaggtaggaggatcgcttgagcctgtgatgtacagtctacagtgagccgtgatcatattactgcactttagcctgggcaatagtgagaccctgtcttcctgtctctctgtctctgtctctgtctgtctgtctctctccctctctctctctgtatatatataatcccagtatgtttttatttctttctacagataggggaaggtgatctatttgaaagtctaatgcagaataaagtagtagtagttatcccctggcagagtaaaaagataagcaaaacttgggacgtcaacttacagcaagagctgtatggaagagaacagtgtggtgtgtagagagaaatcataaagctggctgctttgggccccaagaaagtctcgcttgtgatggttgtatacatggccgtgtggagcttcagatataagaaaagaattaagagatatgtattaataaggctgggcatggtgcatgtgcctgttgtcccagctacttgggaggctgagtcaggaggatcgcttgagcccagaagtttgaggttacgatgagctatgattgtaccattgcaccccagcctgggcaatagagtgagacattttttccatcagctcagtgtattaaattggttttctaagttaaaggttcacaacttcattatcgttactatgcagaattgcacttggtcctgaaatctgtctgaatttctgaataatagtttcttgtcctcaacttgtgtggtctcaggttttaaaacaaactaaggttgttactgccaatttctaaccactgttgcatttgtagtaattgagtgccagtggttggaggtttagagaaggtttaagattaactgattccaaaaatatctgtgtgtgtgtttgtgtgtgtttccatgttgtctgtgtgaatatgttagaataggaatagcatatgttttgattaggcatttttctttgttcaacatacactttggaaaacctagagaatttcagtgggattatagtatataatgactatattctgataaaatcgtggagtcttaacatttcgggtaacagattatctgctatttactggtatgttgattcgtggacagatgcttctctgtcttcaggtaggctccccaggtacactttcttgcagtcccttctaccaggtagacatgcaagaattaacaataaatgccacacatgtgtgttttctcttttttctgcttgtgagaggtgtttaaactttgtggaaatttattagaaaagatccattgtttggtagttctgatagcatcaactcgccctttatctttcatgatgcattgagacttccattactttgtagcgcctgactgctagaattgttcccagagttcaggggcttccaaatgacaatgggctgtaccgggctttgtggccttaataagccctctgttactggaattttaaatattggcatacctatcagagtctggccgtgtgtcaggagaatgttggctttagagccaccactgatggatcacatgtttttttctcaagagagcaaacaagcactttttgtttaggcttactaatgtttggcaaagaaatatagctgtaattatatatcctcgttcttgttactctctccccatctaaattttactctccctacccctaactttatataaaagcaactagggttggatctgaaataaatgtcatgaatgaataataatttctttcatttacacagtaattcaacctgttgaatgctgacttaatgctttactacactctaatttgactggaagatttggccttcgtgaatgcaaagaagaggtaaaaaatagaaattaaataccgactgactatgaaggaggacatttttcagaagggttctccctccttctatttctcatcttcttgtgtttgccccctgctttctgtgatacttaatacttaggagttgttccacaaatcattctttactttgtgtacccagcagtatcccagcagcaggattctccagggacaaggcctaggtctgccactgagggtagtctgcttccttcatcagaattgccgctgctggccttctggaccattagagttctttctggttgttatccacttttcattccttctcaacccatagaattccaggtggtgagtcagtttttctgtatgatcatgcttgacaccccaaaatctacctgaaagtttgacagatgcatggaagccaggagcattttaggaagctgtactgctcttctgagattttctgcctacttactgtctgagcattcaacctgtctctctcaaattttctctttctctaaggtgggtccagtaatgcgagtcggcagcccactttgctgttcttggaagcgaagtactttccaatagaagtcagttttaatcttctttcaccgtgaggaatgaatgaccattttaataaataattcattcctacagttcactccgtaaggagcttctaagctccctccatgatggtttctgatcctgccagggtactgctattttatctgtcaaatgtgggttgttagaggtactgtgtcataagaggcagtgcagttcggaaccctggaacccccttcataaatttgcaaaacacagtgcatggggcctgctatggcaaggtatgctacatggagcctcagctgtctgctccctctcttctgtcagcacagctagcagtcagagacaaatggctaaccctctttgagtctcttggagtaaagcctggttgtgttctgcgtggattgcatcctgtgcagattgtggatagcaagggcttccttgcaggcctgttgggagcattgattgagatcatgggtgtagaaagcctggactatagccagagtcaataattattagttctttatcttgagacaaagggaagtgttaaaatatttttatatcaaggaatctcctacaaacactgtcctccccactgcccactgccagtatttacatgaattaattttctccttatcttcttactctcgcccacccgcttccctttccttccgttccaaagttatactacacttattcaggatagaaatttcctttataaaaagttgtaaaaacttcaaagtgcctgttgtagtatatatctttaataaatactcccctgctatatttgttaaactataattatgagcatacatttcataaaaataaagcccatttactcataaactgtatgtttacatgaaaaaatacacattttataacccactccagacctactaaatctgggcgttagaatctcaatcttgggttttccaacctggctcctttttcgaaataacctggaacacttaaaaaaaaaaaaaaaaaagcaaactccaggctcaatcccagatgatttacatcagcatattttcagggttggccctgggcatcatttgtttaagcttctctggtgattataaatgtgcagccagggttgagatttaacggtctatcctaagtgcttcttaaggtctgaaactataactattaagtgagctggcttaatttatttaatctttgcagcaaccttatgaggcacagctggcattatccctattttcagatgagaaattatagaggcttggagaagtgtgaggtaataataccaagaatgagagttacttgttctcctatgtcttataatcaaatagtatatatagtattaacatctacttggggatgcaataccttttcacgtgatggtcacaatctatgtattacacattggttttggcatgaaattaaactgaccatctcaatatgccttggaaccaagtgtttgtgtgctgaatccttttgaaatatagacacctggtgtgttagtccatttgtgttcctataaacgaatacctgagactgggtaatttataaagaaaggaagtttatttggctcacagttctgcatgctatacaagcatagcaccagcatctgcttgccttctcgtgaaggcctcaggaagtgtttactaatggcagaagggaagggggatccaatgtgtcagaaggagcaagagagatgccaggctcttttaaacaaccagctctcacgtgtgaactcacagagggataactcactcattccccctggagaacaccaagccattcatgaagggcccacccccatggcccaaacacctccctatgcccagcttcaacattggttgtcatatttcaacatgagatttggagaggacaaaacatccaaatcgtattacctgcaggttgacattataaattcattttgttaaactcagtggaaatgagaatcaggttgaaactcggggtttattactgacttataaacccaggtgtgctttgaatgcattggaaagcaggagcaatttaacattctgtgatttttagaggtttggcagtgaaaccctttggtatttatttaataaatcctgccttcacagtcatggattctttttgaatacacccaatttctcctgcttcccaactcttttttcaagtgactttgttaccaggtaccgttgttgcagaggagtgatttgattattctttctctgtagaaatggtgatgatgtggggcaaatctacctcaaactgtaaactatactcactttttccacagatggggtcttgttatgttgcctaggctagacttgaattcctggacccgggtgaccctcctgcctcagcctcccaagtagctgggactacaggcacatgccaccacacacccagctatattcacattaaaaaaaaaaaatcatctgtaattctaagagctccctgtgtggagccttccaagtggcccacctgtgtgggaaagctgccctgcaatatgggcccaaaaattttccttggttttcatgtatctgagcaagttgcttaaaggtgcctggttctgtgtgtttgagattatttattccatttttactaatagtttagagaaccatgattgtgcatacatgcacctgtttgtttagtaaatatttattgagctcctaacatatgtcatgcattgttgtaagtagtattgaagttacagcatccaaaccaaatagacaaaatctctgcattcgtgaagctttatttaatggggaatatagaaaaaagtataaacacataaatcttaaaagtattttggaaggtgagggatactatttagaaaaagaaaacatgtaaagaagaaatcccccttaccatatttggggaatggtaaaatttttaataaggtggttagggtagacctcactgagaagatgacgttaagcaaatggttgctggaggtaagggtgtaagctatgtggatgtctaggaagaacactgcagacagaaagcactgccagtgtcaagttcctggagtgtttgaggctttagcgaggaggtctgagtgctatgtgatatgtttactacctacctataagagttttatggatttggagaagttttctctgcaatatgaatatatagtctcacaaatgaggataaagtttatagcaaattatcatggatttgattatgtcatggcacttgaaggaaagagagggtgggctgtgaaactcccttaaaaataacccatttttgaactcgacataaattttcagggtcctataattttcttatcaggagtgtctcacactgattgctaggtgtagaaaaatgtatgttgcctgaatctgaaggcatggattgtaggcctggttataccacagttacttgtgggactttaggaaacatgcttcatctggtcctgcttctgtttctgctatcttacaatgaagataattttccccctactttttaaacttatttgcagtgaagactagataaaaaaggatatgactaacacattaaattctgaagtaccacataaatatgacttatttttgcaaaatttaagagcacagaatgttggttatcaaagagtgtttaaaatgacctttctctgttttttgtaagtgttgtttgagagcacagtgatgaccacttaattcctttcctggagcaagacatgtttcttgtgggtttgatttgtacattatcactgaaaaacttcatcagtgacaacaacaaaaaagcccaaaaggaacctaatgaaaatagtagtgaagttttacacattacatagttacccccctgccacacacacacacaaagaacgaaaaaaagaaaagaacttggtgaaatatggtactttatattttaaaaggcctaaatcttgcttgtggaagtgggctttagaaagtttgcagcttttgagttatggagaggtggtggaagatggattatctggaactggatggaaagttgttctaccaggagtggctcataatgcacttggcaaaccgaagtagctgtggtggatgtttgaggtgtgtgcacatgtgcattttgtgtatccctacacagcttaattcgactggatgcagttttctgaattcacctgtttcttgcaggtgaaagtgcacacaaacatgcaagattcacattgtgctcaaagtgttcctgctatgtcaagcacattgaaacaaatttatgttttcaaagtaagctttataacagagctgtctgtacaggggatgattcagtccgatacagtcagggaaccgtacatagaatagaatgactagagtataatctgcaaaggatggaatggcagaagtagtcagaagaggtatgcaatggttggatcaaaaagagctttgtatccagcgtcacagggcctcaaattgtactgtaatcatatgtcttttacctgttctctggcatttaaatattcttgtaaagagctaagccattactgataaaatgtctgttgtgtacagttgtacaaattaaattcagtcacaaaactgaaagaacagcagtgggacatctatcctagtgaaagttagaatacacttttgtggtctttaataacagagttgattgtttaccttctcctttggttagaagactggtatggggattgtttggaatgaagaggtaggagagagaaataattcaattctgtattctcccatcatctttatatttgaactgagaaatgtgtgtttctatcattcattcaaattattaaacaaaaacagagatcaaaataataagaacagatgattaaagagagtcccatctgccccatatccaacctttctctcttcaacctcatttctactcagattagcagatggcaccagttttgggccatggtctctcattttctgattacaaggggttgttcttttgcccgcctcctttaaaacaacaacagaaaaattggtaatgactgactgtatgcccattggccggggcaccaattcctgaggactagacagaagcttggcattcaacccagccttctgccaggatggttctgcctggcagcaaaaagcctggttgaattaagcttgggcttttagatcctagaagtcttgtctattggtggctggaaaaatagctagtactagcagagcctaaaaatatcagagaaaaaaaagcagaggctcttagaagttgcttttcctttttgtttctttctcagacagagtctcattctgttacccaggctggagtgcagaggtgtgatctcagctcactgcagccttgacctctagggcttaagtgatctttccactttagtctctcgagtacctgggactacaggtgtgtgccaccacgcctatctaatttttgtagttttagtagagatggggaatcatcatgttgtccaggctggtctcgaacacgtgagctcaagcgattctccctccttggcctcccaaaatgctgggattacaggtgcgagacaccacacggccaagtttttttctgataaagactataaagggaaggtagggaaaggtgattattgccaatggtggttggtatagtgctgagtgatacagaatgcaggattcatgaattctaattttgcatgtgacctctctgtaaaggaaaatgaccctctaactaaatgggaaagtaaggtttcacagatgagatagaagttcaaggtgaaagaacagtctataaggtaatacctgcctgtctgcagagaatggattcaaggctcctgatgcaattgaattatagcctcattgtcatatttttttttttttttttttgagactgagtttcactctgccaccaggctggaatgcagtggcctgatctctgttcactgcaacctctgccttccaggctgaagtgattctcctgcctcagcctcctgagtagctgggattacaagcacgcaccaccacgcctggctaatttttgtatttcaagtacagatgaggtttcaccgtattggtcaggctggtctcaaactcctgacctcaggtgatctgcctaccttggcctcccaaagtgctgagattacaggcgtgagccaccacacccggccttcattgtcatctttgagttaaatgcattttggctttaataaaaacaatatgagtaaattctgaacctataatttgagtcccaatagtatttcctaacaagtgatataagtaaacactgagaaaagagtatagtgcttacagaatgacagcatgaattcagcaattcctgtttagcaagaggtctgggccaataacttggggatgtcatagacagaatgcatttggctttcagcaaaatttttggtctgctctcccataatctctttgtgaacaagtagaaaaatataggcggggtggcattatgattatcagtattcataattaattttataactttttccagtggtgattaaattttatttcactctagagatgactttctaagattatcataaataatctatccttggctctatcttatccagatttttgtcttagactaggatgaagatacaattttaaatggtaccaaaacttcttgggtcataaatatggtagatgggaggaacaggacacatatagattttaactcttttggcagtggcgaaaataagatttgctaggactaaaagtgtgattatgtttgaaaatccaactgtgaaaatagagaattgatagagatgagacttacgatttttagacgacacttacagtgagtcagcagcatgtagttagctggcaataaagctaatggtattttcaagtaccttataaaatatgttttatgtaccggactgtactttgtatttggggaagaggggatagaaacattgaaggtaagatttgcccagagtcacagatactgttaatgttcacattcttcacattttatttgtacatcactcttagtctttaaaatcaaaatacctaaatagctgtgaaaattcagtggattaaaagctactttgggaaagacagtaaaactttattcaaatagggattttcatataatgttaattttttgaaaaatcaacaattttaagaaaaaaataggatatatgaaaaactagatagttaagttgaagtttgagcatctttcaaagagtagggaagtttacatattgcatattatacatttaaaaatcagttccagacatatttttgttcattcatatatatgaatatattatatatgactatattatatatattcatatatattatatgaatatattatatatgaatatattatatatgaatatattatatatgaatatattatatatgaatatattatatatgaatatataatatattatatatgtgaatatatatattatatatgaatatattatatatgaatatatataacatatgaatatataatatgtatgaatatgttatatatgaatatattatatatgtgaatatatataacatatgaatatatataatatatatgaatatgttatatatgaatatgttatatatgaatatatataatatatatgaatatgttatatatgaatatatataatatatatgaatatgttatatatgtatatataatatatatgaatatgttatatatgtatatataatatatatgaatatgttatatatgtatatataatatatatgaatatgttatatatgaatgtgttatatatgagtatctataatatatatgaatgtgttatatatgaatatatataatatatatgaatgtgttatatatgaatatatataatatatatgaatgtgttatatatgaatatatataatatatatgaatgtgttatatatgaatatatataatatatatgaatgtgttatatatgaatatatataatatatgaatgtgttatatatgaatatataatatatgaatgtgttatatatgaatatatatataatatatgaatgtgttatatatgaatatatatattatatatgaatgtgttatatatgaatatatatattatatatgaatgtgttatatatgaatatatatattatatatgaatgtgttatatatgaatatatatattatatatgaatgtgttatatatgaatatatatattatatatgaatgtgttatatgtgaatatatatattatatatgaatgtgttatatgtgaatatatataatatatatgaatgtgttatatgtgaatatatataatatatatgaatgtgttatatgtgaatatatataatatgaatgtgttatatgtgaatatatattatatatatgaatgtgttatatgtgaatatatattatatatatgaatgtgttatatgtgaatatattatatatatgaatgtgttatatatgaatatattatatgtgactatatattatatatataatatatatatgaatatatattcatatatatattatgtatgaatatatattcatatatatattatatatatgaatatatatgtgaatatataatatattatatatatatatatataaaatgccataagccatagagattcagaactaataaaaggcaagttgcttgctcattaaaagctaataaactagaaggaactacaaaaagttttaaggttaagggatgcaaaattgattagcaaaggcagatcagaaagagtttctgactcatgcttcattggtgagaacagcaaggaagaactgggaatgagaatcattgagttttggccgacttagaggcagagtgttttaaaactgctttttggggccgggtgcagtagttcatgagctgggggaaaaaaaattacttcattttcccacctcagtttcagtttcctcatctataaaatgagataacaacagcgtggagtctacacatgaattaatgactttatttatttatttatttatttatttatttagagaccgagtttcgctctcgttgcccaggctggagtgcaatgacatggtctcggttcactgcaacttctgcctcccgggtttgagtaattctcctgcctcagcctcccaagtagctgggattacaggcacctaccaccatgcctggctaatttttgtatttttagtagagatgggatttcaccatgttggccaggctggtctcgaactcctgacctcgggtgattcactcgcctcagcttcccaaagtgccaggattagaggtgcgagccaccgcgtctgactttgaaatattttttttttaagattacacagctaaatggaattctctaggaagcacatccagctgctgaacctgtgatatttttttcttatggaacgttgattgaacagcttccatgggtgacctggtttggatttccgtagggccttgcttataatgctgaatacactgttagtttttacttttgtgtcacaaaagtaaaggttcatagttagatctaagccccttgggggacaggaactgtgttctattcatactttgaattgctagtgtctggcatgtagtagtgattaatatattttttaaaatgaatgtcaagtattatgacaggcactggtacagaaagatcaagaagaaatgacctcttcccttgtgagaggctcactattgtgatagaccaacctctgaacagaggaattaccatctagggggctgttataacaggcatgtgctgttcgagttcaggggaaagatgcacttgctcaaagagggaagtttgggaggtgtacgggaaggaggaacccacctggatcttaaaggctgagctggctgctgaagaagagaggggcacttgggcctggtcaccagctgtgcaaaatcaacaagggcaaggaagtggctgatgaagcctgaaacagggagattcccaaatgtgatctgtgacctcaaaattgaaaattttagttagtgtaattttagtatattttatgtgcatgttccaaagttttttgaaaattggttttatatgtttagcatatggggcaattctaaattagtatatttgattaacgttgtatgctagtcctttgaaattctgcagttggattgtgtatatattgtgtataatgttacctcttttccgacttcatgaacctaacatttaaagtggaaacaaatgcacgcatgtgttagtgtttagtgcagcaagaaagcacggcccaccacttccaagaagtgagtcgttgcatagggtgccccgtcctcagaacattgctcattgttcattttttattcctcagctccttagttctactcaaagtctaatattagtttaactaccaaatggcagaaaccagagtacgttgtacatttttcttgaaggatacaactggaaaaaattttgcagaggctcatgtgatgctattttccttccgtggtgacacttagaattcgtttcacattgcctttgagagaaacgaggaggggggagaagcctgtatttgatagttttgtatgttcctctaaagaaagagagtgcttgaaaaaagaaaggcaggctttcagatgttgtctgaacaaagctacggaaatgtgagacgagagcagcatctggagattttcaaacactggaacatgggctgcacgtttcttttgctgttggaggagtgaaaagctgtttcctgtcatttcccatcttgtcacttccagaaccaacatcttgctacttcttgcaccagctgctgctgctgttgttttttttaccccctccacagacagatggtaaaagagctttgataatcctcgcccaacttccccagttctaaagaagtttgcggtgtggtacctttatacaatgatcacatgccctgatacctactgtagcctgttaatagagttgggaacagagcagaaggatgtgctgcagacttttaatgtctatggcattctttgtcatgtctcatgggaaatgctgtgcacaagccccatctctgtggatgcttcgatttagcttctgaggttatatttagaaaagaggaagttgtggggagtacctttgcttccataagaatttgagatttctgatcaagatttctctgtacattgaatccaggatgggagttgctcttgatattcttgttcgtatccctaggttttcgcaaagcagaattaggcatattggatataccatcttttcacagggctgtttatccttaattactttttttacacctatttcttccaatatttttcttgcattacctagtgcaaacaggaacttagaagttaatgcagaaaatgccgtatgcataggaaagatatttgatgcagacaaccttggttttgttttaagttttattacctttattattacaaactaaaaatgataacctcaatgagggagcttagcctttctgtccccccctaaatcatggttgctttcctaagtataaaagtaacatactcattgtagaaaactttgaaagtagaaaatctattacagaaaatacaaagtcatccataattccttaataaccactcttacatttggtatatttccttgtagcttttttttagagttatgtgtgcctgtatttctcttgtatacttataaacttacattaatattgtggccattttccagaatggatctggtggtagtagtagtggtgatgataatggcataacctaaaatttattgaacatttattatgtgatagtcactatggtacgtgctttacatatattacacatttcatttctcacatcagttctataaagtaaggattatttatttttattttagacatgagaaaagtgaggctgagaaacatcaagtaattttcccaaggtcacacagtgcgcaataggtgaagctgggatttgaacccagatagtctgtcttcaaagctcatgctgtttgtcatttgctcatctatgtttaaaaggtctgaatattttttaaattattgatacatatagcctaagattttctatttattcagacttttcagtcatgagagtacttactgcgctctcaccatcttcacatatcatcaaatatgttttacctttataggtgtttggggtgaatgattgctcagtttttacattggcctttcttgattactagattgattgggcattttccatgtgttattgatcatttttatttaatctataaattgtttatgttctgtgtggctgcttttgttcaacagttaatttttttgtatacaaaatcatcatgtgttaagtatattaactctatgttgtgtttgtttaaaacatgtctccttctgttaacttgcttccttatatttgaagaaaattgtatgaatgttttaaatatgtacatattcatattttttctttataattctctcccacaaatcagttatttagcctatgttttcctttattttatggtttttactatttataacaatttttaaaatcaaatctgaaatttattttaatatatagcatgctatgagactttgaatttattttattgatgggtaatactttttgtttttgttttgctacttcctttaaaaaatattatgcattatatattccactcttctgtggtggcattctttattatatatttgtttattttgtctaccagcgtctcttcaagcaatctttctgtgtcagtggcctgtgtatgggtatgcctacagacattttatggatagtaaatttgtaaaatgtgcaagaagttttttgtcttaaaagcacccagactcagcatcagaaggcccatatccaaacctcagtataacctcatgattgacttgtgacatgaccgcatgtaggcttaaatgctgtcaggaaaattaaaggaagtaaaacgtgaattgagaaatttggagatttctgaaaattttgaaaattgagattttgctgttaatatcacagccgtatcactaaaatttccacaatcctttgaatttgtgaaatctatataaacatgatttaaagtacttatgatattgtcctttttttcatattacccaaagtatggaatttgtggcaaataaataaccaggtatatatggcccatatagatatggtttttatcctgcacttcttttgagatagctgggggctttactagagagaagaaataaaacaagataactttggcaagtatagatgaagtttgagaggtgtcttatttcattttgtgttgctataaaagaatacctgagagtggctcatggttttggaggctggaaattataagagtatggtgctggcatctggtgggggcttttttgctgcttcattccatgggagaaggtggaaaagcaagagagcatgagagcaagaggaagcagaactcactttaataacaacccactctcgcaataaccaacccaactccagtgtgaatgacgttaattcactcatgaaggcagtgaccccacgatctaatcacctcctgtttggccctacttcccaatagtgttgcattggggattcagtttccaacacacaaactttggggacatggttaaaccatagtaagagggaagtttaacatttgtttaacgttggtatcgaaaggaactatttacgttgcagccccgaaaagactacaaataatattggttaaaatagaagtgggctgtattcttttgccattgcagcaagccttagtagtgacctagattcaaaatgttactttgattttatttaaagcactgaagtattgcatttttcctcgtggttttatgcacctactaagtgcagctaccaatgacaaagatcttctataataaaaatgatgtttccttatttttgggtcttttttcaatctgaaaaatgtttctttaatcggattctcataataaccctatgcagccatataatctatggtattattatctccactttgtatatcaggaaaatgagactcatgctaaaatacttgcccaaggtcatatgacttgaaatggtgggactagcctctggcttagctctagtgagacctaaaataatactcttttggtttggtgagttccatcctttctttttttaaagaatttgcatatctaccttatccacttttaaaatgtttaaagaatttatttcaggtgcctgtccagagtgacacatgtcaaaatgttttttaaacagataagtactattcaaatacaaggctttatctttcttactgcctggggtaagatacctgtcttccctgtcccaagttatatgatgcttatttaaaaagttacctgtgagccttgcttattaaagtatgcctcagctatgtcatgaggatatttttttttaattaattttttttgagacagggtctcattctgttgcccaaactggagtgcagtagtgtggtcacagctcactgcagccctgacctcctgggctcaagtgatcctcccacctcagcctcccaagtggctagtactacagtcgtgtgccaccacatccagataactttctatttttggtagagactggggtctcactcttttgtccaagttgatctcaaactcctggtcttaagcaatcctcctgcttcggcctcccaaagtgctgggattgtcagcataaggcactacgcctggctgaggacatttttaaaggtgtatacttcaccatattctcttttcctctacatgaagtttagcaatgttcaagatggtggccactccatcccccttgatgactgagtgactgtgatgagccgagcacctgctgactcacaacagccatagagacataagagtgtgaacaagaaataagcctttgttatttttagccatggagattttgcagttgatactacagcattatgtagcctatcctgaatgaggtaggatcataataatatgtttgttatgcatcacacaagtttttgggttgtttcaatctaaagatctgaaattatacccaaactagatattctccagtatcaccaaacaggatctatccattctacagtgctcaccagattgcttctgtcatacttcacctggacatctgtggattctggatattagaaattggaaggaaaagcttgtaaggggatctcagtgcccagggtcaaagcttcattgttgggcagccaaggaagagatttgcttgacttacttgagtaatttttgacacatacttgatttggtcatcaggcataaaggatggccagattactagtaacttattggagatacacttttaaaataggagttaaggctacttatgtgttgatctgaaattaagaaaagggcaagatttctccctgtggcctgattttcaaccatgactaaataaagcctgaggggagccactgaggatggaaaaggtcactcagtcttttttgctgatgaaaaaatcgagttgtctagctctggattgacatccagcactgacatgctttaggaaacaaatcttttgatggcaaaactctcactagcctcacctctcctctcctttcctctctcctctcctctcctctcctctcctctcctctcctctcctctcctctccctcatttttcccttttctactctcccacttctaccctcatttacttatttctcaatttagctcatcagggctttttgttacaaaaaaatggtgtgtaagttacttagctgtaacttggaaactgttttcccatgaatagatgacagaattactacatgccaaattatcccagaataggtggcttaaccaattgtataattaagttactttaataattaccaagagggtcctgagccccatggaaaccttcactgcttggaggatgtataaatggaaggtgggcagcatgagtcttttggactggtggccggaacaagcagttcttagctttttttaaaatcatctttcatatttcagagcaattctttgcataatccagattgcttctgtcatccttcacttgatcatctgtggattctgagcttcagggtggccatgcgacctttcagcccttgctgtggaaggtggagctcctaccatctctgcctgtgttggggctagacgaagtttccctctgactgcctcaatcttttcactgtcatgtgtcctgggagcctcctacacagtggagaggagggagtatgagtctcaggaaccattgagttttttcactgtgaggtgggacaggcctaaatttctccccttaggcctgccattcactgagggtgtgcagtcatcatgctaagttctctttcttgctccattttcatcttcactcaccccttactttctgcaaagcgttgatggtgttgggttctgacagttaccagttggggcatttgtgatctgtggagaaggcagagatagttaatgagtaggcacatttgctaacctccttggacaggaataagttcaaaggggtggacaagcaggattggctggaggaggcaggtctccacattgttctctcttgcccctgggccctggcgtccagggtaatttttgtctgcctttgtggttcatatttttagctctctgtaagaggcccccttggtaaatatgtcagttcattgttaaacctagacatgagtttgacatctattttgtgaaacaaaccatgtaaaaatatgggtctttatggtgttcagtgttccaaagtcaggaattttttagtttcttttgtcttcacttcttgttattctctcacttgctttacttcttccagccttttccttttccacctcatctcctgcttcttatttcctcatctctttttccttaccattttttcctcttccatttctcccttgatcttttcattatattcaattcatttcattcattgaatggtgttagaagaggctttgtctttgcagtcagaaggctcaggtgaagcttcatatttcaaagcacactatgctgacactaagaaaacatcttgcccgggcacttcagttgaagaaaactatatgatgtgatcagtatgtgatgatggcttttcagatcagatagctgggttgtatttataatttatttctcttatcagtgaaaaagataaatgataatgtagtaacaggattttctagagtttgggttgtagagaaataagtgctcatgaataggaccgcatatgtgtgcatgtatgtgtgttttgggggtatggagaaagaggaggaaaagaatattttatagagaaaatttccatatggttaccttttataggatctagcacatttcaatgaaaacacactttgctggaagaattcaattctctgtaaagtttggtgcagcaaggggtgaaaatgtggggacacagctggaaacttatttgtgctgcaggcttgcagctgtacctacctgtgatgcgatgaatactatttgattgttaatgtctttctgttactgaaagcttgcttcctttcctaaagctgatggtaacaatttactgactgtctaaaccttgaggactaacttgggctgggaaaaataaatcctgtctcctgaaatttacatcttattaaaactcaaagcagccagcagagatgagaaggatctccagcctgggagctggaggtgggaattctgctcaagtcaagatcgcttttagctttcctacattctcctgtgaagaaccattggattgaatgatggtggcaaaactggtgtgacttcattcagtttatctctatcccatttcccctctccacatttgactgtcagtctactaatgagacccagttatggtccttggaaggggaaatggaaggtggacatagctgtgggggatgaaatggaggagtttttaatatcttagcttgcaaatttactgtctgccatagctgaagaccatctagtaccctctttaacttttgccactttggagtttcctctctaccgttacttattcagcaggtttttgtttttgttttttgagacggagtctctctctgtcaccaggctggagtgcagtggcgcgaactcggctcactgcaacctccgcctcccgggttcaagcgattcccctgcctcagcctcccaagtagctgggactacaggcacgtatcaccacgcccggctaatgttttgtattttagtaatgatggattttcaccatgttggccaggatggtctcgatctcctgacctcgtgatccacccacctcggcctcccaaagtgctgggattacaggcgtgagccaccgcgcccggcctcatcagttattttttaattggctgtgttttctttccctgtaaacacacttgttcagaaggaaatataatatcactataatgagcagaaggcaagtatcacatgccataagaaagtaactataaaaatgagtgtaatacaattaaaatattatgaggctctagttagatactgttccctatggaagattccgaacttgaggcctgcactcacttctgtctcaagtagaaagggagcttaaagaggcatacactttacatctaaggaagcactaagtgaggcattgttcttaactaattagacagattaaaaaggaaaggccaaaccatgccattgtcttagctcttgttttctttgattttgaagatggaaaaagagataacacttaaaaataaagcttgcctactcagacataattaaggtattgtcattcttttttgtctgtcctggttctcattgcaatattttgttcactgctcaatgagtatttattaaattaatgaagatttcaatgttaatgtctagtttcatttgcccttcctctaaaggctgtattctttttttgctcttgctctctgtgattttttggtagttctcttttatgtgcttactcacacatgagtgctttctctaacacactggtcctgtgttttgcttctttgtgtgcattcacgtagacatgcacacctcttcaaatgacacatgcctgtaggcaggataacaggttgagttgtcttgttaattaggcattctttttctggggctggtacaggatgtttgagaatactgtcccccagaatactcatctggtacactggaactgccatggactagttttccagggcttatacatacaagtggcttccaaaaaagcattttcagacaagctgcttgttatgtgaatgtgtttttctttttagtcaaccacaatatatgcagcacaaagctgttgccattttcttggaatgagaaaattatgagcataatgtttcttttacatctctgaaaaacgctaatatccagctgttgtggtggttgcagttgtcagttgctttttgtaacccgacaacactgtctcaaggatgaagagaggaaatttggtgactagtctttcctgctcactctcctgaaagtcctattaatttgcttttttaaaaacaacagccaagtatctcagttggagaaggcaaagtcttattggtccttatattctgtgcttggattagtatccacagtaaaccacacacattttgttccttgcttaacgtgagccaggtgttatactttaaagacataatctcacttagtcctcacaaaaactcagtgaatacatactatcattagcaccatttttacagatgccaaaacaaaaaattgaggttaaataattgcacaaaatctggcagccattaaatgactgagctggaatttaaaagcagatgtgtctaaattctgagcttacatttgtaaccactgtatataatgtagtataataacttccccaataattgacagagtactttactcagaggctttacaaggacaataaaagaattagttgagataacacaacccatgttgtgagaagattgtctttttgattcacagttcatgcaaagaaataatatacagcagactgtgaataatacacaaacgaaatgaaatttcattcttgaatgaattatctgtatctccttttaagaaaaattggtaaagcatttaactggtcatggctcagggaaatgtctctattctgtttctgtctgaattttattctttaaatattcactttttttttttttttagcatccagtggccacctagttgttgttgttgttgttgttgttttttccccctgtgcttatgcttgtgccttgcagggctgcatttctgcttgctgtgaattctcagttcacagctgcagttgttcaaactttaaatttaaaattcagtctatgtttctagtaattgctgctgggaaactgaaacaggactacttggtttcagagtgaggctgttgcttcatattggaagaaaggtttcattagcttggaaagcaaatctcgggatatcaagaaaacaacaaaggctgtaaattaatgcagaactcaccctaaaaagggtcaatgatgaaagaagggagaaagaagagacaggagtttcagtggtcaagggaatattttcttcatgataacagtgacctgaattggacagaaagcagaagggagtgtgtcattttaagaaggtcagtttgacagaccgcaatattccaggtttctattattatatataattgacattgttagctaagggatggattttcactatttccttctgtagtacctcagtcccttttaagtaattttttttttcctgacttcaccaccaggatcgtgtgatggtttaggaggagatttgggggatagagaggtgattctgaagataaacccactttggctgcctctgtggtctaaagccagtttggagagcgcactacagaaacagggaattcacaggggatgagtcagagagagggactggagcagtttgtcttgtttcacttgctcttatcacacagttcactcctttctgctcatacattgtgtagtccaccatggagagaaagggagaaggttgcacaatgccttgacagatttttttttttttttttgaaacggagtcttactctgtttcctgggctggagtgcagtagctcgatctcagcttactgcaacctccacctccccagctcaagcagttctcctgtctcagcctccctagtagctgggattacaggcatgtgccaccacgcctggctaatttttgtatttttagtagagacagggtttcaccatgttggccaggctggtctcgaactcctgacctcaagtgatccacctgccttggccttccaaggtgctgggattacaggcgtgagccactgtgcctggcctccttgacagactttttaatgattgtagggatagagaatggtatacaagtaaatatactactactgtttttgaactggcacagtgatgaagactaagccagtaatgctatgaaacttcaagtattaaatttctaaatatttggcattaggcaccaatctaagttacagtttaatgcttttcatcacttgtaacattaccaaatcagaggaatgaaataatatttatccaaataaaagatgtgttaacttcgccaaagtgaatgcacatttttctttgatttccccataatacatctttctttttcggggaagacagaggttgggaatgggagggagggagattattgtgaatctcagattatattgatcagaaccaagtttagcttgttctggtatgtaaattagagatttgtagttaagtgaaattgattttgctgagactaaattaatcacagtccttaatcactgtaacctttaaacattgcagtcttggccacagctgcagggcagagcagtgctcctccgagctttatgctgtcatttcatgaaaggctgaatgcccgtgacttgtgcaaacaagaattcccatgtacaggcttcagagctggttccctgccctgcaggggatcagctggagcatctcccacagggccaagaggctgctgtggcctcttcaacccaagaagatgttctgctcagacacaaatattttcagtcttcctccagacatcatcaaactagccatcactgcgaaatgctcacaggaaagtagttgttagaattaaaatcagaaacaaccagttatattgtgatagttttttctttaattgtatatgtttatgtatatttataaatatatttatatttatagatttcttttatatatttatattatatttatatatatatgttttactgatcacattttgaactatttggaagggtgatgttgacaattttgaaagatagtgaggcatggagaggttaattgactcttcagaactaatcctgagagcctagaaggagggtcaagaatagaaactgggtttggtttggttttgatggtcatttcagttctttggtttccgtttcatgaagcatcccagaatcaaaccatcattaagcctgccatagaaatgcaaattactttcccactttagttggcatatttgaaaatagttttgtgtgattttttttagccccttttgtagtctattcatgaagtttatacatgtaggactcttttttttttaacgcctttaactaccaatcctccatttttcctttaacttttctatattcgctgacttttatgttcagttgaaggaattcatacacattcagtataataaagtgcagctggatcaatcatttaaaaaaatcagtgaacatctgtatttcacaaaatcacactttatcaggactgaagggtataccaggatctaacgatcaacttcaaccactcagttttgtaaatgaagaaaccaagagtagttaggtgaaatagctttctcaaggtaatttactatagccattctgaggctgcaccctagctaatttgattcctgtttaacactcttctctatgacattgactgttttctctgtaaaagagatcccggttatacaactatttcacaatccgattccttataaaaaagcaagtagtgctcaataaatttgacttaagttgtactttataagctaatgtaaaaggagatttaccataatctgccgtggtgagttgcttatagtaggagaaagaatatcttaaaacttactttacaaaaaataacagatgctggtgaggttgctgagaaaaaggaatgcttatacaatgttggtaggaatgtaaattaattcaaccattgtgaaagacagtatgtcaatttttcaaagacctaaaaacagaaataacagtcaactcagcagttccattactgggtatatacccaaaggaatataaattgttctatcataaagatacatgtctgtgtatgttcattgcagtactactcacagtatcaaaggcatggaatcaacctaaatgcccatcaatggtagactggataaataaaatgtcatacatatataccatggaatactctgcagccacaaaaaagaatgaggtcatgtcctttgcaggaacatggataggagctgtaggctattatccttagccaattaatgcaggaacagaaaaccaaatactgcatgttcccacttttaagtggaaactaaatgatgagaacacatggttacatagaggggaacaatacacactggggccttttggagggtggaaggtgggaggatgaagaggttctggaaaaataactaatgggtactaggcttaatacctgggtgatgaaataatctatacaacaaacccccatgacacaagtttacctatgtaagagacctccacatagacccctgaacttaaaagctaaattaaaaaacaaaaacaaaaaaccaaaatacttactttaaaaacaatttctgtggttgtccttctcttttttattgtatattggtttgtgtaggtccatttaatttgtttacttttcgtagtaggaatacaattgtcagtgacatctagtagattgaacataggctctgaagctgaagcctcaggtccatctttggccctgacactagccctgttacctttgtcattttacttaacagctctctgccctaaaccataacacctaccccatagagttgttgagacagttaaataagttaatgaaaagtcaggctcttagaatagtgctgggcatatatgaatgttcattggatattatctaatattgtggtcattatcagttgatttcttcttaatttaaaaaattttcgtatgtgatttcatgtggttttagggaatgataaatgtaatttagactttttattccattgggtctgttacagcttttttctcaatgaaactgatttggttacctcagttctaatgctggctttgcctctgctttttgatcacatttagaatacagcactcagttctgggtatgtccaagatagataggggagaaaggtaaaagagaatattaatgcaacttgattgtgcagctgttctttccacaaatatttattgaatgactgctgtttgtcacatgttgatgcatagggacacggtgcacacctgagattccattcctgtagacaggacatttgcctgcttcctggcacttatacctctccccaaattgacaccaagcattattttagaaaggcatttagtagaatgcaatatcagcaaatgaaaattgtagagttgtatcttgaagaaacttgaccccaccccccactctcacctgcatccccacatagagccaggacatctcttaagacccaccttcctgggtttgctcatagttggcacttaaaacattctattgcagttacctatttttgatggactctgcaagagagagactgtcagttcacaagggcactgatgtttggttcttcattttatttacagtatgctatacaaagggataggtttttgttgttttgaatatatcttgagtactcctttggaaggatagagtccaaaggcatcttacctgagccagaattcataggggtggttccctaccgtttcttctttcctgtacacactcaccaccctcaaatttccgctcagtagaggatgctttaggaccttttttcttctttctttctttcttccttttctttttttcctttttctttttgaggtagggcctcactctgttgcccatgtagtggcacaatcatagctcactgcagccttgatctcccaggctcaagtgattctcccaccttagcctcccaagtagctaggattactggctaattttttcagttttatttttggcagagacaaggtcttgccattctgcctaggctagtcttgaactcctgagctcaagtgattctcccaccttgatctcccaaagtgttgggattataggcatgagccaccatgcccagcctagaaacttttcttttcttttcttttctttttttttgagatagagttttgagcccaggctggagtgcaatggcgtgatctcagctcaccgcaacctccgcctcctggattcaagcgattctcctgcctcagcctcccgagtagctgggattacaggcatgcgccaccacacctggctaattttgtatttttagtagagacggggtttctgtatgttggtcaggctggtctcgaactcctgacctcaggtgatccgcccgccttggcctcccaaagtgctgggattacaggcgtgagccaccatgcctggtcagaaccttttcttgactccacttaagctcttccatttgaactttcttttaattatctggattttaactttatcagaattagtctgccggtaatcctgtttttagctagaaggttaggctttgagaagtgtgaagctggatgggagggaaggaggccagcaaagggaaagggactagctgggttgaagaggccccatctgctattccagatggggcatcctgaattcatcactcctaaaactttgctctatgtgttttctaggctgcagcatccagacagcagcacacccttcacatgttcactgtagtaaaataacgtggaaagggtagaggtatctggcagataagagaggttatttcgtaaggctgtgatgcccagcacataggtctgtacatcacctccttcctgctgctcctcaatctgcctttctttggtcactgccccctgctagtatttaattctgttgaatttgttcaaattgacttgtttaagaaggttacccaaatctgcatacagccttcagcattgctttgaatctcctttaggaaaggaaatgtagattcaaatacacaggtttatctctctgacctttagctaattattagattgagataaatgtgtgtaagtgacaaattgcctttaatgacatttaatctgcatcctgacattaatgtctggtttagtgtcccagttccatagaggcaaagagcatggacttttgtcttaatttgacctatttaaaaggtgtttgtggtgagagtcaacctgtgattaacttaatagcatgttttacatgaaaagcaatcaaatattgatgtaagaagaggctactagatgacatattttccagtctgtcataattggcaaaaacatcagagaaaggagagagttgttagtaactaaaactgaatgaaagcctcatagctgccccaaatccaatactggtgagcacattgatagtatctgaagaaaggaggctcttcttgttgtttattgtcacagaggccattcactgaactttggtgggtgttagactaatagatttttttttttttttgagacagagtcttgctctgttgcccaagctggagtgctgtggtgcgatcttgcctcactgcaacctgtccctcttgggttcaagccattctcctgccttagcccccaagtagctgggattaacaggtgcacaccaccatgccaggctaatttttgtatttttagtagagaaagggttttaccatgttggccaggctggtctcaaactcctggtttcaagcagtctgcccccattggccttccagagtgcagggattacagacatgagccactgcacctggcctaaactaatagattttcacacctttttgattcactaaaggacatcataggggcttattaaataagtgagctatttttagggagtgagaggtctgggaagtggcattcttggtggatttgttgtgtgctagtcaggtgctaggtgctttgctttttgcattctcatttaactcctaactacaaaaacatttgtacaggcaaccctctaactcgtgataccatctttttgaattaaattaatttttttttttaaataaggtcttgctttctcgcccaggccggagtgcagtggcatgatcacagctcactgtaacctcaaacttctggggtcaggcagtcttcttgctttagtctctagaatagctggaactacaggcacacgccaccatacctggctaaattttttgtagagacggggtcttgctgtgttgcctaggcttgtctcaaactcctggcctcaagtgatctttctgcctcagcctcccaaagtgttggaattacatgtgtgagccactgtgcccagcctctaattggtgacttctcaattaactttgacataagtgtgtgttttataagatcattatcaccgataataaatgcagcttaatttctaatcaattggccaaacagggaaatttgagttgagtgagatcattaacaactttctttagcgctttaagagctaagtgatagcttttccagttctttaaacattacaaactgccgttcctggtgaatgtcattttctcaaattcattttcagagactggaatgggtctgtgctactctatataattttgtgctgagcggatggtatattgatgggaggaagtaggagagtagtgatggaagggcacaggcattggagtctgtctcccaggtgactctgtaagtttttcaactttcctatgccttgatttcctcatctgtaaagtgaggataatgagttaatgaatgtaaagcacttagaagggtgcctgtagtaaggacttacaactgttttatttattgtttttggagtttggttggaggattcaaagcaacattcattaaactaaacactcactaaattcactaaaatggtttccaagtgaaataataaatatagcaaaggagtctctcctctgctatggagtagctgagttgagtgcatctgggtgtccattctgctgcaaatccaggccaagcaaatacagtttctgtgcaattaaatggttgttgactggcaaagaaaaaaaatgtaaaccatagtttttccttctaccctgtaatctgtggtgtctttatgcattaccttaagagcaacttcagtgacttgattagagggaggtttataaactgcttggaggcaaagcaccgaactcttgactggcacacagcaggtccacaaggaaagccacttcccagggtaagaaagcacacacaaattattcagggacaaatgtaatggttacaagggtgtcatagaaacagatcagaatacttttatactactgcctggcttcttgttcccccattccccattataattctggattcttaagtttattttaatgacaaacatttttgcctgtctttaagtaaaagaacagaaaagaagttacttaaaatgcagtcctaattatgtcctaatgcaattttgatgcagcaatatgctttcaaacaagcaggtactgggtggcagattgacacaagtatttagtgaattgagaacaacatgtgttacatgaaattataatcaaattacaaacaatggaatggattgttgcttttaaaatcctctgaatgttggttaacttcatagggcagtgctgtgactatttccattaattacggagtagttatactgggacttgaccaagctcttttaatagttccatctgatttatgtttttctcttctctatttttcttttctgtctctttatttctttttgtcactatttttgttgacctgtatgtgtgtttttttctctttctgtatcagttcaagttctccagagaaataaaaccaataggaggagtgtgtgtgtataaatctaaagagatttattttaaggaattggcttacttgattgtggggggctggcgagtctgaaatctgtagggcaagcagtaggttggaaatttggcaagagttattgcagtcttgaggcaaaatctcttctttgtgataccttatttttgctctgaaggccttcagttgaatggataagacccacccacattatagaggataacctcctttacttgaagttaactgattgtagaagttaaccacatctagaaaatacctttatggaaacatctaaattcatgtttgattaattaactggctgcctgctattgccttgccaagttgatgcataaaattaatcataacattgtctcattcctttttccctcactgtgtgtttctgtctctcatctcacatgcacacaaatgaggttatgggacagcattagtgttaatgaatttcaggtaacaggataatgatcattatagcatctaccagtaattggatacctattatgtgctgagtcttgtatttgatgctttgtatttctgatctcatgtaatcctcttgacaattccatggattggacagaattaattttattttatgggtgaggaaactgaggcttaaagagctgctagcttttatttagccatgtagagctcaaggttcaaactctaatctgcctttcctgcagatatactctcttctgtatctgcttgtttctctaatattcccccatcactgtcatcactggctatttttcagtgtttcacttggatgaaaaacatatctacatactttttttgtttccttttttttttttttttttaaagacaaggtctcgctctgtcaccaaggctggaacgcagtggctggatcttggctcactgcaacctctgcctcccaggttcaagtgattctcctgcctcagcctctcaagtagctgggattacaggcatgcactaccatgcctggctaagtttgttttgtatttttagtagggacagagtttcactttgttggacaggctggtcttgaactcctgatctctggtgatcagcccgccttggcctcccaaagtgctgggattacaggcgtgagctgccatgcctggcctgcatacttttttttactaagcttttttttttttttttttaataggatgctgaaggagctgaggcagtgctgaaggatgttaaaagcacacacagtggagagcttattgttgttccaaggcctaattggagatctaggttggcatttcctacagctttcaaagtgtacaactaaaagactatcctaagaagatgagatagtttctgaactaggcacgaaaagctgtaaggagtgtcacctcccagtgccctctggcctatttttctcactgatggattgctttgttatctgctgccagaccccttaatgtgctggctcagccttcacagggattagtcacagaagatgggcgctgcagctgcaggtctggctccagaggctttgggtggtacctactactacttacttagcccttagccagatattccctagaagggaaaacgctccttagtttcactgaggatctggcctcatgagcagacactagttctaataatactctttaccttctttgtagctcccagccattgtcttctaccttcccttgcctagctttagtcactgccagcagctatttctaggctgttggcactttgaagtggaattgggcagacagaggtgagagcaggctgtgagttccctctctggaggttggctccttacagcacacatgggaggcagtgctgaaggatgttaaaaagcacacacagaggaagagcttacttgttgttccaaggcctaattggagatctaggttggcatttcctatagcttggcatggaacgatttgaatgtttgtggatggtgcttgcctcataccttgccaactcaaattttgggcagatcagcttctgtgagttttgtctcgacaagttgggaaagtttcctaactttagatgactgtgtgaatctttgaggagcttgatagttagcaggtgagggctgctattttgaaggaaatagacattaatatattcttctttaatatatctgaatgggtatacatatgtgctcctttgtttcttgtaaatgggcagtacaggagggagaaactgaaggagaggacttggtcaggagataaacccccacagatgccaagatgttggcttgttgaagcttattcgtggttagttttactgtgatactatgtgcagatggttcctaagttataatggtttgacttatgattttttagttttatgatagttttggtgcaaaatcatttttttttttacgtttagtacagtatccaataaagtgtgacatattcagtactttattataaaataggctttatgttagattattttgcccatctgtaggctaatgtaagtgttctgagcccatttaaggtatgctcggctaaggtcaggtgtatcagatgcttttttgacttttgatattttcaactaacaatgggcttattgggatataaccccatgataagtctaggagcatctgtatttgtctgtgaattacttagggactcttttgatgtcttcgttttggaaactctctgttgttggtttttgttattttagccttgtcgggttttcctcatactggtctaactgctagtatcttttattggcccctctttcttggatatcctttacatgtttatatttgttagtgtttcttccttgacttgtctcacttctcgtgtttccttgggtttgcctccattactaagtcttcatccagcccctatgtcattggttctcaaagtgtggtccccagaccagcagcagcagcatcacctgggaacttgctggaaatgcctgaactaaacttaagacactatataaaacaggaaaaggcattttacattttgatacacattgtcaaaaacattgtactggtttcatggtatgcattataaggcataaagtagatcaagcctatgttcctaatgcatacatttctattgacctcagagagtgaactatcatataatagaaataggattatcattagtttaatgaatgagaaagactcttcatgtttgttctttacctaatctatgcagtttaaacctagatcgacctcagggaaatatgggaaattgtgttctcttctggcttgtttaagtacaaggaactcagacccactctaatttgctttaagtgtttttttttgtttgttttgaacagtaagaaactatttagggtggagaactttatttcagtaaggcctcatgtgaagtggaattaagacagtcataatgtccttttgtggcttgatcttgatgaggtgataggcttctgcacacattcatcaactgttcatattctttcccgctctgtccgccccccccaccctcatcttgcttgcacacacgtgcatacttttgcatgctctctgactctctctcttcttccctctccttcctgccaacacagctgtattcatcttcatttctttttcacctggcttcctccctctctgctctgtgtcttttcaggtccctcccaagtttagttcacgcattactcattctatgaacctcttaaacttcgtgcattctatcttttatccctattactatgtcaccctggcagtttcataatgcagatttctgagtaggagtcccagtgggacagaacctggccacttgatggcaggtccagtgtcctggtcgattcccttagaaagtgctgtgcagaggactgttactttttcttatagatcattctatgttttaagtattaaatgaagcctcagctccagcatagcgtttctgacaggctgactcacttcacatttaatgattgtatccagcatcttgtctctactctccagcaatgcagctccttcttctggtgtcgtcacttctatggacatatcctgtggatgttcccatccacctgagcccaaaacctctgtgcttgtttgttcctcctcctccttagccctcacatctcttcaatatttttctctctctttactattacttaatgctactgccatattgcttcttgactagattttaataatcttctgatttcaatctgttactttgtctcagtcagaataacctacttcccctttcacatgaaatacttatctaccctgaggaatatccctcaaggctctctattgcctgcgaattgagaatagactcctctgctgaagattcacggtcttcagcagtatgccccctacttggttcttttactccaaacactgtactctagctacataggactactgagtaatactcctcaaaggctccctctcttgggtacttgtaaagtgccctttagctgtgtagcagagaataggacaggagtgcacactctggggctagactgacgggctggaatctcagcccagcttgaaaactttgagcatttgttattttatctttctgtgcctcatttttctcaactgtaaaatggaaacagtgatagtatctgccttgtgggttgttttaagagttaaatatggagcactcagagcagtgccagacacacagcaaatcctcaggtctttccagggatacttttttttttttttttttttaatattctccattagacgtgatgtttctgtctctgcgatgtggtaattttttctgttttttatttttaagggtacctatcacagtctgcttcccccttttcagattatttgtggatttcagatgttcacctgtttttctttgagctccttgagtatggagatggtattttattgaaacttatattatgacatacggagctcaataaacatttgttgaattggattatatccaaaagatgcttctgctaaaatactgtagtaacttccatctgtcccatgaatgttcgtgttctgagacaataatgtaattcttaaaactaggttttaaaccttaaaagtgaaagaaagtgaatactttgcggttgtcatatagatgtactgctactcaagtatagtaagtatattggtgaaatatttagaaaaaaacaactagttgtgaatctgaatcagagatcagcaaactttttgctacagagggaaaaatattaaatatgttcaactttgctggtcatattatctgtgttggatctgtttaccacagcaatcgtaatatgaaaaatatgtaaatggttgagttccagtaaaactttatttacaaaaacaggtggactataatttaccaacctctggcctgtgtcattactgtgcaaaccacacatcattttagaagctgtttgttgcaaaagctccaggtgctgccacatccaaagatacacacctgcatgtcttctcattaggtataaggaaacctttccagaaaatctcagcagattactcacaagttcagtggcccaaagttgtatcacattctcacacttcaaaccagttactgatgatggaatgagactaccatgattggcccaaatacaccaggaatcacaggtgttgttgtggataaggcctccctatctgcatcacgtgaccatgttgatgagggcatttccttgtgaagtgaaaaccattgaattgtacaatgaatgtgatacagcatgggctgccacagtccagttgtcacctactcttctgttgttcttctgaacatcatcataatgtcacatttgacaggtgtgaggtttctttgttaaagctcagacttattttaaattaatattcttatcacatgaatagacccgtggtaatgatgtaatgaccttggaggggcaggccagttttccgctgtgaagcataaagtttcccatatgacatccttgggctactcattttggtattctcagatatgcaaaacagagaaaacaacaggcttcccacttcagaattcaccatatacccttctccttcttgaaagggagaaaccaattagacaaggactagccttctcttatacttaataaaggcaggtgagttgagcctcttagtatttgtcatacactatggattaaaccagtttatggcccatgtcattgtacccaaaactctggtgtataatagtaaaacgttcatagttttcaaattagacttagagcttcttggtctcactttagaatattttgacagccctttggctttcacagaaagacctagtccctcaggggtcttgaactgagctaattatcctagtcatatcctgtagaacgggatcccactatggcttgtctgagactgcattgttgtcttgggttgtatgggaccatgagacaaacggctgtactgtttttccacttggcttttctgtggtgtaaaactatcttttaggagccacaaaatgctattcttttacttgttgaaagattttaagaaagaaagaaagggagggagggaggactgtaagggaaaagagaccattaacatgacatgtttcctgtcgctctccaatctgagtctaaccccagatgactgtattcccattgttttattgtgagggcatttgtgagggccttccccttggttgtgtcttggtttacagtctatagaattggattagacaatgttaattcaattaatgactgtactgaaagtttgtcttagtgtgcagtgaaaacaggagagcagcctctaataatctatggatttaatgactgcaactttgaagagtgttaagctaaagtgaagttcagaatggcttgttaactgggtttattagctgttgaccttccctttcagcataatagtggcagtcagaccgaagagagcactaacgtcctgattagcatttatctaaagataggctgctgcctgttacacagtaaattagttcaatcagccataaagagcttgagaaacattttctgctttataaaaagaattagatgttagaacagttcatctggcatagctcagtgaagatggattgagcccctgaacgtgctcatttgaggaaggcgctttgaggatattgagtaattgaacagattttcctacaagattgatcaggggccctagatttcctgcacaattgagtgatgctctaatttttgccttctaataagagcagtacatctgctcctgtttctgtgtattcatcgagtgaaactgaaaatcaatttatttagcacctactatgcactctatgtcccttacgaaataaaagcaataggatctactgatcacagtctatttgattgaagagatgaaaactacactaaaacttgaaattcaccacttccactaccactgcttcttttcttctgaaaagaagaaactgtagaatgaaagctgctacttttggtatatttcttgagatcatcttatgaagtgaagcacattttcccacagaaacagtatagtagtcggggttaacgtttctgactaaagtcttggcaccaactaagttcttctcatagtgggtcataaaagcaaaaaggcaaaaattataaacctttctaaatcatttaaaaacttaaattatgatccaggtccttaaaaaaaggacataaatgtactgtacaattgaattttatgaggtgccccaatgtactataaagtatacatagagcatataaaattctaactccgctgtatcataaatttgacctcactgaaatgaataggctcactgtatggcaagcattaatgaaacgtttaattaacattcccttcacttgcatttttagaattttaaagggcttcctggggactatttcaatggctgaggtttttgcaaaacaaaagaacaaaaccttctcataaaaactgatctcttttgctcaataactcctccaatagagacatttaatttaattagactgatgaacctgaatttgaattttatacccaaacctatgatcatccttaaaaaaaataaaacaaaaaatatggtattgagacagttaagcacttgatgacttcatgaaggcttcctgtggaccctttaagccactgtgtatacacatatcatttatgtccttgcagttttcccaagctaaaagccacagggatatgagtactttgtgagggacagtggtgcagtgttagaatggatgagctgtagggctgtgggcttcagaccctttcatagctccctgtaaggtatcctcctcctctaaccttccctgtaattatgctatgttggtttactttattgcctggtcactccaggagaagtccccagggagtcatacttgaatgaacagatagaggcagagtaaaaaaaaaaaaagacattatgctaagtgaaagaaaagtcattcacaaatgactgcatatggtgtgactatatttgtattaaatatccagaataggcaaatctgtagagatggaaagttggaaagtagattagtagttgtctaggggtgaaacatgagagggatagggagtaactgctgataggtacagagtttctttctggggtggtaaaaatataaaattagattgtggtaatagttgcacaactatctgaatataataaaaaccattgagttgtgtattttaaatggttgagttgtatgtatgcaaattacatcttaataaagctattatttttttaaaaaggtattaagtttcctcaagttaaatgaaatgaccaaaaggggaaaggttttaagcagtgagcactccttgtaatgtatgtgtatagtgagtatgcatatgtttgtaaaagtataatgtgtgtgatccaactatgagccatatggtgctagtcatgatgtgtatacatgaattctagaaaaagaggaagaacctttaagtgagagaatgccatgcattgggaagcagtgtggggcaagatctgtgtggctctagggtggcaaatttagtttgagcttgtgaatccttgcagagattggcaaatatcagatactccttggcagagaaagcagtagagtcaaaattgagaagatttaaggaagcagagactaataaggagagaatgttgaaacctgttatttgtagttagaagtgtagatgtatacaaaatagaaaaaaacaaaaagaatcttctgcattatatcaggaggaacttattggtgttttaggaccattaagatggagaacacagctcactcatatgtgggagctacaaagttgagctcatagaagtagaatataactgtggttattcaaagttgggagacgtggaggggcggggaggatagggagaattggtaagggatacaaaattgcagctagataggaggaataagttctgttggtctgtagcatattagggtgaacaccgttaatcttttattgtatattttttaaaagctagaagagaggattttgaatattcccagcataaggaaatgataaatgttagaggtgatgggtatgctaattatcctgatttgatcattatacattatgtacatgtatcagaatatcatgccatagcccataaatatggttgctacatgtcaactaaaaagaaaatttttaaaagatggaagacaaaagtaaaagataaatgtagatattcttttaactgtttggtgcttacctggtgtcctctgaaaaatcagagtcgtgggagatgaataacatttccagagagcactagatgaggagttagaaaagctggtttatcattcctactctgtctcttcccatgttacattaaataagtaactctgtgatgctttcttcctcccttgagttgtccttcttaccctgagaggatggcacaaggatcaaatgagctgacatatacctattgcattgcacctactagaatgtaacaaatgtttgtcagactgagggaggaaggaaggaaggaaggaaggagtagagtgatatcacatgcaaggaattggatttactgacttattcctctggccaagtgtgtcaacattatgattgcaataagaacttttgcattaatactatttatacttatgggtattattgctgcatttggtaattctacggtaaatttggaggtgcttctagtatcactgtcttgttctaccaatagtcttgtatttattgacagtttggtggttgttacaaatgacaggattgcaaatagaaatcaagctccaaagatggatggattagcttccttgttatgaccgtgttaaggttaccactcagaacaaacattggtagttgagcacgtcttgagtgtgagtgtcatactcagaacaattctaattttttaaaaattacttttttagaggctgtctcactctatcatcaggctggagtgcagtggcataattacagctcagtacagcctggaatttttgggcccaagcgatcctctcaccttagctttccatgtagctgggactatagtcacgtgccattacgcctggctcaattctacttttgatgaagtttttgacatattgacattgggtttgacatgtcattccaatataatatgatactgtagcattcaacaattctcttcccagaggagactatagaaaacagaacatttgcatttcccattttgtactttatgccacccactaaagaattccaaagtcatgcagaatgcctttgatgatgtgagctgcatgtgaatttcttattgcttgacttttaaatcccctttgttatctaggtccattacttataagctgtgtcacattaggcaagtgacatgcctctctaagtttccacttcctaatctggaaaggggggaaataatgagattggccctgtggcatcaggattaggcaaagtacttggcataacaccagtctcacagaatgcagtttttcttgagctgttgggtcagtgatgcctgaaagaggaggagtggaggttctgaggcattgctgtttttatcacgtttgatttgttttctttttgtctagacttgccatattatagcttcatcaggattttaaagacgattgtgaattatattttcaaaagttgtatggactcttgtactttagtataagcagcacaaaattaggcttaagaaacttagattttaatgttagctatgagaccttaggtcactggtgcgtgttcctctcatgaaataagagaatggaaccagctggttctttattcttcccggttccaagatgatgtggtcatagagtcttcattgcataatttcttgttcctcctcatttcttcttaccacactcttgtctttaatctctgacacctttctacccatctccttcaatgctccttctattcatcctttcatacgtcctaaaaattgttatgtcaactatgaggcaagcagtatattaggagctagatatgtaatgttgaaaaatatagacatggttcctgcagtaacagaatttacagtttaatggaagaagtacagataacacaagtaatacttacaaaatgtggtaagtgctatgaaagagcaggacagactgctttgaatgggggaaggggggatccctggcagtttaaatgacttttctcaaagcaggctgccaaaaggtagcggcgccggccagaggtggtttgagaggcaaagcagcaccacagacaggggtccaaggcaagaaaacgctgagctgctctcaggtgctggaaagccagtgtggcttgaagcgtgctaagagtgagactggaaatgcatgccaagtttgaggccgagttcaggattttgtattccatgataagtgtaatgggaaatctatgagaacttttaagtaacaacaatatgggaatcatacttgacttggctagaacaattaaaagctgatctcttttagaaagtacagttttgttttacattaatcttaacacagaatagtgtattacacctaaagtgaatactcttttaggctgggtaggggctgtcccgtggtttaatattgtttctatcataggagaagccttggtttcctagtttcccaccttgtttctcctctctctgccccactgggattctagctgcttcttcactgcatttgctcacctcttcttctccacagtcctttggtccttgaaatgctgtaagagcagaaataacagctatccagagaccttcagatagcagatgtgccttgggcctgtgggtctgtggctctggagggctaggaattacagaagagttaaaagagaaggcctctgccagcaggaattccgaagacaccaaaactgatgtcactggctgtgcaggcactgagctaattcttttgccaatcagttaaatcacctaccaagagtgttcattgtaagtaacactttcttgccatttggtggggatgtagagggacaaaggatgcaaaaggcaacaggttctttccttgtaaaactgtaatctaattctgtaaacaagccatgtacctttggaaggtcattttgaactcagtcctggtaaatatttgacaggtgttttaaaaaaataattatatttatacaatctataatggaatattatgcagcttttcacaaggaggaactcctgccatctgccacaacgtgggtgagcctggaggacattatgctaagtaaaataagtcagacatgaaaaaaaaattgcatgatttcacatatgtagaatctaaaaaataggataaaaatacagagagagaataaaacagtggttactaggattgggtttggaggaaggaaatgtggagatttgagtcaatggatacaaagtagcagatatataggatgaagaagtctgaatatctgtacaacatgaggactatagtgaatcacaatgtactgtattcaggatttttgctgagtgagtaggttatagctgctcttgccacaggcaggaaaagtaagtaactgtgagatcatggatatgttcacttgttttcctatagtaaccttttactatatatatgtacctgataacaacatcatgttgtacaccttaaatatccacaataaaatgtattaataattttatttaaaaatattttaaaatgtggacaattaaaaattttttatataattttttggtagttataatgctctgttcttttacaaattgtgagctggatactcactactcttcttttagcccaaattgagaacatctggaggcatttttatgtgatgactaaaaatacggtaattgagttagactgtatgggtctgtaccctgctctgccacttcctggacatgtctcagttttctcatctgtgtaatgatgatagtagcgtccacttcttgttgttattataggattaaataatatattacatgtaaaatgttgagtataaaacctggcagatattaagcacctaataaatgttaggtattaaaaatatataaagtatgacttctgctttcgagaacttaacctataaatatcctttgataccccgccccccgccctttccaccttgatttcatttacacaagagccaagtgaaagagtagtgagagatgaaactaggaaagcaggaatgaggcagtgggtagagaaggatatgtcctgaccaatggcattgacagagtggttttgacaggtgagtgtggaaatggactgcggtgagggagagtggaggtagtgttgagaacccgtaggctctggcagcaatgtggagcttacttgcagcatagcctcccttcaacttggaaaccaagcatttcaaagtacctgggaactttcttcatcacatccttccagcatttacattgtttacaaatgaaggagggaatagagtatattttattttctgataactttctgggtttccaaagagagaactgtaaaactttgataaacacatccataagagttgctgcccacacggtttcaaaactggatctcttgagctgggcataactggtcataggcagagaaacgttgactggtgatttataccttataccctctcattaaacactcttacctaactacgcaaattaggcttttaaaaatagattatttttattgtttaaatgtagaagaatatatctcagagttataggaaatttgcatgggtacatgtttataataaaaatcctgccaccatttatcataaatggccttggtttaggagtttacacagtagagagctcaaaccactggctttgctatgaaatagacccaattcaagctccatctcttaaaaagccatgtgagtttgggaaagtggcatcactttcctgagccctgggtttctaattattattattattatttttgaaacggagtctcaccctgtcgcgctggagtgcgatctcagctcacggtaacctctgcctcccgggttcaaacaattctcctgtctcagcctcccaggtaactgggactacaggtgcccaccatcatgcccggctagtttttgtatttttagtagagacggagtttcactgtgttggtcaggctggtctcgagcttgtggcctcaggtgatccacctgccttggcctcccaaaatgctgggattacaggtgtgagtcaccacacctggccaggtttcttatttttcaagaggagttataagacccacaaaccttacaattattgtaaaaattggtaataatatatatgaaaagtccccagcacagtgactcctgcctggtaagcaacccacgaattttacctattgtcagcattgtttagatcacctttatttaacttagttataatggggcttaattacaaaggggatccatattctaaaagcaaatactgaaacaaatttttacaattcactaccggttcttcagattaaggtcttctgatcatggttcagtttgggtttttgttgttgttgttgttgttttttctccccaagatgcagtcttgctctgttgcccaggctcaagtgcagtggcgcgatcttggctcactgcaacctctgccccctgggttccagcagttctcctgcctcagcctccctagtagctgggattacaggcgcctgactaatttttgtatttttagtagagatggggttttgccatgttggccaggctggtctccaactcctgacctcaggtgatccctgccttggccttccaaattgctgggattacaggtgtgaatcattgcacccggcctgagctactgcgcttgggccatggttcttaatagtaaaattatttaacgagatttttcccagttcttactggtaaaaatgtcctgtggtttaaaaacgttcaaattaatttgttgtatatttcacatgacagtgatacgagggataattgattatttgaggtattgatttgacctaattcagcataataatttactgattttcattcagtgcatgctaagtactaaatccagtcttgctgggtacagagaaacatacattcattcaaacatcatctcttctctcaaggagctcacagtagaacctatttaaatttaggcagtggggagcatgaggctgcagagaaacaaacatccaactttatgaaaagacaaaattatggagacagaaaaaatgatcagtggttgctaggagttggggagagggaggaatggataggcagagtggagaggatttttagggcagtgactctgtattacagtgggtacatataattttacgtacgaccaaacccatagaatgtacagcaccaagagtaaaccctaatgtaaactatgaaagttgtgataatgatgtgtcagtctagactcatccattgtaactatgtaccagtcctgtggggaatgctgatagggagattgtccatgtgtagggacaggaagtacatgggaactctgtactttctgcccagtttttctatgaacctaaaactgctctgaaaaaagtattaattttaaaaagtggtcttactgctttggagcacaagtaaatcatactaagaagacgatgtttaaattaatatactacagatacagtttgctttactgaaatgcagtatatgatgttcaaaacatatatctttaagtaatagccattttacaaaggaattgcatgtttttacagggaggtttcactggcctattagggcatgttggcttggtggtacagctaagatctaattccttctgccaccaaggagctttgtgaccgtgggaccacccaggaacctctctggctgtattctctgcagaaagacttaggacaacaacatggcatgctgtgtggacatgatttgctttgttgggcaaactggtgggattggtggggtggatactctctaatggaggttaaaggtcctgaagccactgcaggttaccctggggcgccatttctgtgctctggattaattctttgctcagctgttaaatgtctgtgtctggaagtggagatacacaagatgggttggtccccatggctttttatacctcaacaattatttcatccagtagatatctatactaacttgattgtaaacattaagtttacatgggatttctttaacacatccattttctaagaaagtgatccatgtgtaagtatagagtgaccaatgagaaaatagggtaattcccacacacccttccaaactttacaaggagtgaaataatataaattagcttcctctagtgataaaactgcaagaattttcaggcaaaagaaaaacagtttagtagcaccatctacaggctactgaagaggaaaacttcctatgtggcttttaaatgcaaggagtttgtggaaaagggaatacaaaaacttcatactctcttaaaaaaatattatccataaaatatactaattttagtatttttgttcttctttaccatgcattcaattcattttacaatatgtctctagttatcctgaactagtggaatatagacttgattatgtgttttcattaggatccctgtttcatccccatgcttacaaatttctctccctctctgtactaatgataagaatgaactgtgaaattcacatgaattccagtagtttcattgatagtaattcacagtataagacttgaagcacaaagcctgccagcaagggatgtttcatcttagcttatctgtatactcaaaggatttattgcatcatttacttccattatgggaggaaaaataaaagcagacactcttgggtatgtatgtatatgtgtttgccttttttaaaacaatgaagttgatttattaccttctgggtttaaaatcttatctgagccttttctgcccctaagattctgtgattctataatcagaaatagcttggggaatggataattattttgtaaaggaatctagaaaacttgtctttgaatatgataacagtgaaggtaatattttcattcccagataccccagttttattatctttttttgctagttttattttgttttcttataaactattatcaattttggtaacctggaaaattttattggattctccaaataactggattataaagtatttatggaattatcagagttgtaattttctgttagaaatggcttattaaaattaacttaatggcctccttgtaagttgttggtggagttgctgtttcattcattcattcatttcattgtgtgtgttattggaaagtgggtaagagttactggaatgcctagataataagttttcagtaaagcattacacattgcaagaagccaatctgcacccccacccaccccccaaaaaaaaattgagcataaattataattattagaacaatcttacttgaacagcattatttcttggaggaaaagaggaatagaggagatacatattgaaatagtttgctaaactaaagaggaattcaaaggataaaaaaattgataatgagattttcaaggttcctgttgaaacagatgaggcagagcctatcaaaactggagccaggagtgataatggtttttaagtttgtgtagcttaattgctgatggtttaggttgatggaaaacttagtaatactgtttccaattttttcctcattattttaaatgtgtaaaaaaattgtgcattaaatactggaacctttctctgaaaaaaagtaaagcaagttctagtatgaatagaggtttaaagtaaggcactgcctcgtcgtcctatagctaatatttttccctgtttttcttgcaccagatggcactgtttagttctatttcacaatcttattctggaactttcttcgggagaatctgttttagcccagggtcaccagtgacacctctctattctgcatgaagtctttatgaatgcttgtaaaaggtcactgactcagacatgaagctgtttatttgaggtcttgtggttctttccagttgcacatttgctgtgaggtgagcctaataaaccagctgatagaaacctacatgcttcttatagagttcagccagtattttgcttggagacatattgcaacaatatgatttcagcattctcacggcccagtctaattatctgacacattttggaattattttatatgtaaaagtagagctataagcagaagggcacactcactaaaaaaaaaaaaaaaaccttgcagagcttaaaatgtttcatgacagtctgttgaactatagatttatcaaattaacttgcaaaaataaaatttaaagaacctttcctgactattcccaaggctgacttggaaggaaattatcaatgacctctgatgtcattatgcataaatggggcaggtccatagccaagctcgcctctttgctgcacataacaataaaacatccttttggaagatagaattagctttatttaataaaaatgccagggtcatattgtaagacttatctctgtgagctttgccctcccctcccctcctctcccttgaataatacagaaacgttggacataattatgacacagatttcataaggctgcttctccttttacaattatattttatgaagaacagacaatgttttctttgcaaattttgaagctccttcattttctgaatgcattggatttggtactaaatgctctctcccgtttgcatttccttctctccctccctccttgcctccttccctcccttccttccttccttccttccttccttccttccttccttccttccttccttccttccttttttttttttttttatttttggtcagtgtttcactcttgttgcccaggctggagtgcaatggcgcaatcttggcttaccacaacctccacctcctgagttcaagcaattctcctgcctcagcctcccgagtagctgggattacagacatgcgccaccacgtgcgtctaattttgtattttcagtagagacagggtttctctatgttggtcaggctgctctcggactcccgatctcaggtgatccgcccatctcagcctcccaaagtgctgggattacaggcgtgagccactgggcccggcctcccctttgcatttcactgctctatgtattctcttggtggtgatatgagttgaagggtgggagtaggggtggagagccctctctagactggagctatgagtgcataagtgaaatctcattatttccatctttaaaagaaggagtattggcgtgtggtgtttttagccagccctccctcctttcctctcatgcccatccacaggccattgactggaaggcacaacagctcccagcacagcccctcctcctgccgctggagaggtgttgggactggtgtgctggtttccaggtgcaggtcctccaggctgagccacagctctctgtagaagtaagcatgagacaggctgcttccataaatcaagccctgaattttattacagtgtttatgtaacctcagtttatgtgctataattctttgctgtgttgcctagagtaattcccaaagaggatgtttgttctttttccctggaaattttctagcataggccttttgttttgacattctccttccccccaccctctgccttttttgggatggcctggggatgggtatcactaacagtcaattgctttttactgagtaaataatataatccagcgtgtgttagattctgtttgtactagatgttattcctactcttaagtgggagaaaaaatctcaaattaatttttacattttcaagattatagggtggtagggttaatgtgtacttaattgatgagtaaatgaaatataagtgaaaacaaatgcctttgctatccatgggagacccgttccttttcatagcctccgccaccatcacagatctcatgttgatagagtcagattgaccgctgagagagaaaatacagactggaaattttgggtgatttagacttttaactgaagaaaatgtcagggtaagatgaccagattcaactgtattccatgtagacaactatgtcaagagagaaatgttttctggttggaaatgaagacaatttgacttaaccggagcatgtttttaaagaaacccatagcatgttttttttttttttaacttagctctttttttcgaaccttatgtttggccctacagagaaattaggtgatgagactggacctactgaaagtgttaccggacctattctgcttggacacgctagacttgtgaactgctgactggtatatttcagttagtacagttaatgttttatcatcactgccattagaaggtattacatagatgtgatctttttcattgtagtttaaagaagatagttaatcctggggcaaagtttatgaaggaagtgtgtgaacagagcaatctttttagatttactttaactacaaaactggatatttgttttaaagctgtgctgtttaggattgtagacactagccacatgcaactgttgcgcatttgaaatatgaccagttctaattgaggtgtgctgtaagtctagaatacacacttgattttggagcttgagtatgaaagcaagaatttataggtcctctttaatcatttaaattaattacacattgtaataattatattttagatacattgggttacataaactgtatcatcaaaattaattttatacctatttttaccttgcttttactttttaaaatgtgactcctagaaaaaccttaaaattgcaaatgtgactcacatttgcaactcacattattttattatattatattttattttattttatttattttcaagatggagtcttgctctgtcacccaggctagagtgcagtggtgcaatctcggctcactgcaacctctgcctcccaggttcaaacagttctcctgccccagcctcccgagtagctgggattacaggcgcatgccaccatgctcagctaattttctaccttttttttttttttttttttttaagtagagatagggtttcaccatgtttgccaggctggtatcaaactcctgacctcatgatccgcctgcctcggcctcccaaagagctggattacaggcatgagccactgcgcctggccttgcaactcacattattattggccagtgctgttttaaagttctgttgtccaatgaagggaataacagatgagtacactcagtaaaaccttcaaagttatacgtttaaaggaatattctatgcttcctgataaaatattaataaccaaaattagcaacaatatatagatgaaattattgcctcaagatttatgaggaaatattgactggaatactgtctattaaaatattcctctttacttgtcaagtctacctctcagtatcttaaaggaaagttctcatctaatagggtgtagaggttaagagcatgaactctaggttggaatcccagcttggttgtttactgtctgtataataggaagtaagttatttagcttccctgtgcatcagcttccctacatgtaaaatggatacaccttaatatcttcttcatattaaataaaacaaagtgtataaagcacatgctaggattcgcacatactacataagtactatgtaagtgctagctattatagtgatagatgttattgttcttatcttgttaaaatacgtacaactttttgatagattattcgaacctggactctattctcaagcaaatggaagctgttggctttcagtaattagtctgaattttgttgaaactcagaaacaactggcagtaattaaaaatgggaaagtaaatgagcaaagaagggagctcatttattggaacatatgatgagaacattccataaagtaaaacttgtagtaattgtcgattaaaccaattttctacctgatataaattcagtagtactatatttctttttatcatgtttctttgtcaccaggtatattggtctgcaattttgagtctttggaagttatttttgtgtttattatgctctgataaagagatgatgacctcttaatcttgtgtccaagagtggtggtgctatattgtcctagaattgtttgaattttagagcaatgtgtatgtgtgcatttaaacccaagtttaataagtcattccattgtgttcttaatagggctagataacctgagaaccagttggttttttattgtgccgaataaaatttgtaatctggtttagactctgtacagcactgtaggtataacaagtcttttatgcagttcgggggtgatctgtgatataagtttgttatggtggaattgatgtttgtgatgggatgtctagatgaaattaccccatggaatataatcttttttgagtagaggatggtatttaagaaatatgtcttcaaaactcttatacaggccagtactgcctctttagatgtaaaagtttataattttaattgcaggaccttcttttacttggcttttaaaagttattcacttagtcaaaatttattgaacacctatagtattccaggcagaatgctaaccctcacggagctcacaggggatacacactaagggatatatattgtagtacagcacagtgctgtattaaatagcaattgcagagacactttccctattttttatgtttttactgccactttgcctttataacatgaggtgattttagcatagagctgaaccaaatgttgggatattaaaaagctgaagcaaagttcataaagagcatgacttgggcttggactttgcattttacaaggtgtgcagtgtgagcttacagaggctttgacagcagggagtgagtggagcgttgggctttgttatttggagagatcactcttagtattggtattgggacatagatggtataataacaaggagagactgtaagaaactttgcagtatctaatcaagatatggggagaaacttacactaaagagtgtgtgctaggtgaagaagaggtaggattttaaggaaattctccaagttttaagtgcagaagtgtgggaggaaaaaatgtaagatgatgatggttctggcttgattttccagagtagagtagagtagccttcaagatttgatacaacgcttgacataggacatcttaaaggggagctcttagacttcaaggagaatatggtaaatattaagtacactattgggagcatgggtctgctgtatgggagagtgtcttggctagaggcttacttgaggtagtcatgatctaaaggtgatagctgaaggcatgggaggtagatggtataaaataataagcctctccactgtgcttctgggggatttccaaacaccttagcatgccttacaaggccctttagggtttttttctgtactttgttagtctcctttacaaaagttaatgctgttctctctcatgcaacatgcattcctcgtgtctccagctgtttgctgttctcctcacttcccgggctcttctgtatctccattacatcacacatgctgtttcctgtgtttgcaaggcatggctcctctttgtccccttaacaagctctggatttttctttaacacccagttcctgaacctccatggcccagctaatagctccatccttgaacccataagattttgtacatatttctattagtacttatatctcacttagagtaattatcacttgcctttcactcattctgtatagactgtgaactcctaaaggaaagagaagtaactttagtcatttttacatccccaacctcaaaatggcacttggcaaatagatgctcagagaatgtgttttgattgaattaattcatttgtgtgtgagctgcaggtgtcacattagtggcttttggatgtgtccagaagtatacctattatacgttgaaattttgcaaatcatcatatttgcaaaggttaaatgtaaacaggagaaaggtgagacctgaggtccttgtcaaaactgtttttcttactgtaatatcaatgtgtattgtttgtggaaaagttgattgataaataaaagaagaaaatttaaaatatccatagtctgaccacccagtgatatcttggcttaaattgtacgtacccaaaatagcaaaaataggatctatctgtgtatattgtccttgacttttttaaaaaacttactatctgtgcatcattaaatattagtaagtagtcatgttttgtggggttttcttttagtttgagatgaggctggtcttgaactcctgggttcaagcagtgttcctgtctcagcctccaggtagctgggactataggtacacaccaccaccatcctcagtagtcatttttgagtgggctagttaaatagacgacactcccatcatgcattatttaaccagttccttgctgttggacttataggctgacttataggctgtttcaaatttttaatttatatagtcacatttcaatgaacaatccagtagtgttgtcatattcatttttatttagaatacttcggtgaaaggaagtatatatcttactttttccaactctattagcaaatcatctcttggacatttttttttttggagacagaatctcactcttgcccaggctggagtgcagtggcatgatctcggctcactgcaacctccacttcccaggttcaagtgattctcctgcctcagcttcctaagtagctgagattacaggtacctgccaccacgcctggctaatttttgtgtttttagtagggacagagtttcactatgttggtcaggctggtctcaaactcctgacctgaagtgatcctcttgccttggcctcccaaagtgctgggattacaggcgcccagccagtctcttggaaaagtcttaacaatttttattatcaccaactgaattcttctcatcatatttttaggttttaaattgtctggaacttaaaaatatatgaagataggccagccacagtggttcatatctgtaatcccagcactttgagaggctgaggcaggaggatcacttgaagccaggaggttgagactagcctgggcagcatagcaagaccctgtgtctacaaaacccaacaaacgtgtgtgtttgtgtgtgtgtatgtgtgtaaaacatatatatgaagatatgatatatgaagatacattacgaagataattcaaatatatatatgaagatacataggaagataatttagcttgctgcaacagaaattccaaatttagggctaaagaaattatcaaactgaagcctttttgtaaatttaagtagttttgttgattttagaagtagacttttctggccaggcgcggtggctcatgcctctaatctcagcactttggaaggctgaggcaggcagatcacctaaggtcaggagttcaagaccatcctggccaacatggtgaaaccatgtctctactaaaaatacaaaaattagccaggagtggtggtgcgcacctgtagtcccagctactcaggaggctgaggcaggagaatcgcttgaatccatgaggtggaggttgcagtgagccgagatcgagccactgcaatccagcctggcgacagagcaagactctgtctcaaaaaaaaaaaaaaaaaaaaaaaattagacttttccaaataatggtcaaggtttttaagtatgagaaaggagtttcatggtcttggggatcagggtcctcttggcatggagtgggtggtgacgtgaaggtgagccctccagttccagctctgttattagccttcttgtgcctcttgtgtggctgtttcccagctccaacccaaagttttattaggataaagtcttggatttaggcatatggatattaaatatcagtagctgaatttggggtttgaaataattgctgcttacttctaacttccccatcccactccagattctttttgccatccctatctacattaaatagctaattgaagccaggcgcggtggctcatgcctgtaattccagcactttaggaggccaagacgaatggatcacctgaggccaggagtttgagaccagcctggccaatatggcgaaaccccacctctactaaaaatacaaaaattggctgggtgtggtggtgtgctcctgtagtcccagctacttgggaggctgagacaggagaatcacttgaacctgggaggcagaggtcgcagtgagctgagatcatgctactgcactccagcctgggcgacagagcgagactctgtctccatcaatcaatcaatcaattattattcataaaatgagaagaagctcctccgccttcccctgccaaggggatgagcaaatgtgtgttacagctcactttgaagagctgtccaggcttttgagtgaaatgcagaatttttacctcttgcttagtaatttgctcatttttcagactactttgcacagatttaatgattaaggaaacaggataggcaaaggtgccagcgtttgatattatcttaaggcctaaactgaccttacggtgatgaaatgaactttttgagtgcgtttgtctcctgaataaatctgtaacagttttcttaactgactccctctgtctctcagcatcagaaagaaatgagagaacattaagccacagaaagcaaataatggtcaaaataaagatactcttttgctggcaaacttaaaaattcacttgtggggctgagcgtgttggctcacacctgtaatccctgcagtttgggaggccgaggcaggtggatcacctgagttcaggagttccagaccaacctggccaacatgatgaaaccccttctctactaaaaataccaaaaaattacccaggcgtggtggtgggcacctgtaatcccagctactcaggaggctgaggcaggagaatcacttgaacccggaaggtgaaggttgcagtgagctgagatcacaccactgcacttcatcctgggcaacaagaacaaaactccatctaaaaaaaacagattcacttgtggaatctaatagctgtaggcaagggatatttattgaaaccaagatttaagtgtggtttatgatgtttatggagtagtttaatactacttttcttcaaaatgagtttttaatttaggaaaaagaattcagatatgttcccagagtagagatgactgaccatcatgggagtggttagggtttggggtttgtgtgggtaagattctgtttacccactacagccattgtgtggatttaaaagctttcctggatggaatttatggagtgaaatttgaaactagtgtcctgtgtactacaatatatggtcacaacaagcaatcaatttagaaagaaatggaacggagaagatacaggttaaatgatgagtattgtgcagtgcagcaagacatagagtgatcttaacagtaatgtggtatgtcaccatctgagttctgttataaagctcctaggcaatgactaaatcctagaaatcattgcctactttcagtggcagacagagtataatccattcatgatagggggttccaggtacattgatatagaagactggccaagggggaatgacaggggttacagctaacatttcctaggtaattggttctaatttccaggctccaagcaagatactgtatctcttttaccctgtttaatcctccccagcacccagtgaggtacagatggtattgtatccattttagaattgagatgactgaagcttagagagattttcccagtcatatatattcacggttcctggatacagctgtacaggttgttcactgcatgaaggtggctggctgaggtagcaggcaaaggatttgtttgctcagcagaggcagcattttctaatttgcactaaaacctgtgtaggccaactgtagccctactcataaagttggttaatgcctgaactgggagtagaggtgaggcagtgttgaagtggataggtagattctgagaagcttatactatacctactgaagtcctaatctgtaggctgtctgcaaactggtttgttttgctaccatcctatcccagcatttcctcaaagatcccacagtgacttctttattgtggatctgatggtctttggcagctatacagacattcttagagtcacagccaggattaaagtctaggatgcttgtcttcaagtcatgcatgctttctgtatgagataatatacaaaaagatggtcaagaaaagtgattttgagataaatagtggcctagaatagctagactgagattgttcaagcacagctattaatttgcttacttgctcagcactcaggctgtgctatttgcttcaagggatataaagattgctgctttctagaaaattataactcaattagggaaaccaaatcaatatatatttcataatataaaataagagaaattacagataacaataaataatagccaaaatacctttcttaactaggcatgtctatgtttctttaccttgctttagtgctcttagatgtcccattccagcctttgagttggagtggggaaggtgttccttattaaagaagcatctactacaaaaaatctaaaaccagatctgaggcccatactagacccttctattagtggtaattttaaaaaagaattttccatctaaatttaatagctttcttctgtagctaccctaccctatccctgggccaggcaccaaagtgaataataatgtgctataaaatccaaaccaaaatagtacatcttctttggcatttgaaatttcagtgttttttgcgtgtagctacaaatgtcttccattgtggcaaccactgttttgggtggttttttttttttggagacaggatctcactctgtttcccaggctggagtgaagtgatgagatcatggctcactgaagccttgccctccagggctaaagtaatccttccacctcatcctcttgaacaacttggactacaggcatgcaccaccacagtcagctagtttattatttttatttttgtaaagacagggtctctactatgttgcccaggctggtctcgaactgggctcaagaggtcctcctgtcttggcctcccaaagtgctgtgggattactggtgtgagtgaaccaccacagtcagttttggggttcttttgaataatcagaagctgaaatcagaagccaaaaatagcaaaatgggaattctgtgtgcttttgtgatatgattatatttgtgttcccagcctccaaagaaagcaaatgtaatttatatggtactcaataaactatggcagtcaagaaaaccaaaagaaaaacctttttccacttggcactgtccaatagagctttctgtgctgatgaaaatgtcttctatgtgcactattcaattcggtagctactagccacatatgcatttgatatgtggctagtgtgatcctaaggaactgaattttgagttttactttcataaatttaaatttgcatagccatgtgtagccagtggctaccatactgggtagcacaggcatgccacatgctgtttctctcttaagttggcacctttaatttctgttttaaaattcatgtctcctttacttgtccccttctatcttctctttctcactcactcccttcctttttctctttgctttttatttctccttgcttctttgctttcctgttttttctcaaccttctgtgatactactaggctgaccgtaaccccattaattataattatttattatggtctttcacctagttagacttgcctgcctgtgttctccttctgtccccaaagatgggggcattcgcggatatgcagtgtttaccaaaagctcctgatatactggttacttaataaaaacaaacaaaaaaataaatgggatttttctgacaagatggttttggtgaacctatgctgattcctgagatcacggcttctttttctaaatacacaaaaaaactgctttggtaaatcattctagaattttgcacagaatgaatcaaaatcagtggtattacataatcctaggctccatagttctgatttccagaactattgactaatagtaatcaaaacactggaatacttcactggaagacttctctgtccttacttttcagtagggggtttaatctaactcctctccagtctttcttctagaggaactctgtaattccaatctcactattttggtcttcccttctcctcctccttatctcttccccctttctgcttttccttctcctccttctcctgatataacttacttcctttctgagaatgccacttgtctctttctaactttaggtacttttgcctacttctttccttctactttaattcacatagaagtaccgtgagactatgtaaacacatctactttaagttaaacatttcctctattcagagtcatgcctttttatatttaaaaaaaaattctaggctgggcacggtggctcacttctgtaatgccagcactttgggaggccgaggcgggtggatcacctgaggttgggagtgcaacaccagcctgacaaacatggagaaacctcatctctactaaaaatacaaaattagctggacgtggtggcacatgcctgtaatcccagctacgtgggaggctgaggcaggagaagcgcttgaacccaggaggcggaggttgtggtgagccaagattgtgtcattgcattccagcctggacaacaagagcaaaactccatctcaaaaaaaaaaattctatatttgatttcaagcctcaaataacttaagtaataatgactacccatctgtaagagtccttgctttgtgatactgttacactctgttgtattgagaatgctctaagtcatatgttaccaacatgctgtggacctttagcttttcccagtttccagacagaagcagtggtcagtcacttaactgcactagacagaaaagcagtttttcccttctgaaggttaaacaggtttttacaccactggagatttttaaggtgggtatgggtattaaggtgggtattgttagtcttttccctctaagtttccccaatgtccaaagaattaacaaaattttaagggttctgatttatatggtaacacagtctgttagtcagatgtaccaagtttcttcctatctaattttttttatttttattttttttgaaatggagtcttgctcttggtcaggcaggtctcgaactcctgacctcgtgatccacccacctcagcctgccaaactgctgagattataggcgtgagccaccatgcccggccttttttattgttatttttttcagagacagtgtcttgctctgtcgcccaggctggagtgcagtggcgtcatcttggctcactgcaacctccacctcccgggttctagcgattctcctgcctcagcctcccgagtagctgggattacaggcgtgcaccaccgtgcccggctaatttttgtatttttagtagagacggggtttcatgttagccaggctggtctcgaactccggacctcaggcaatccatcctcctcatcttcccaaagtgctcaggatacaggcgcccagctcttgccatcttagagtctttgcaatttttacttttatagcctaaagtggcgctttgcatgcctagatgtatcttcagcctttatactttaatcattctgaggggggttttctgtgtccctccttcatcaccttcaccctgtttactccctccatatcattcattcctcaatacttatttccatgtttccctgtctccaccactgggatgtaaggatttcttatcacttgttctgtgcagttaatctcagtgctcgggctcacagctgggagctgataagtgctcaatgaattcaagtgtttagaagaatgttagtgcagagtagagattgggcaggcagtgttagtaggttagtaattattactagaaccaggtagagtttctacaacctgcattgaggccctgagcatgaagaatggagtgttaaaatgagcctttcaaaggcaggattggcaactgtgtgaggtgacaccactagagacatggtttggacagcgcttccgaagatggaataccagataaagatcagtgtggatggtggagtccttaactgattcagtttaagatatttgattttgatgcatttgggaatagggtgctcttgctgagaataggggttagggctcaatttacaaacctttctgttcctacattctaggttcctatgattataatgattcttgctgataatattttctcccagcattatttcttatatataatacgtgactataaaggctcgttcctgtttcaaatgcctttgcacatgcatgatttggatttttttccagccaggtctcaggggccatgtttttaaagtctgctgctctttgggctgatattgtggcttcttgaatcgcatacaaagcaggtttcttgaaatctgctcatctaccatagtttaccagttatctgtatccttgcggctctgcttgaactgaagcttaatcttgttctttgtagggcccagctatttttgcttgtcattctatcacatgccgtttaccaggaaacattcaaataatgattaatgatgccaaaactttaaacatggaggaagctggtaataccagctccgctgtggagattttcaggagcatcaatgccggctgaccggactggtatttgagtctcggataatggagtagtaggtctcaaaaagttacacttttctgggtaattgtcagcttcccagagtactgttaaattctgtccctcaaaaatgatgaaattgcaaaggaatggtcactgttacaggtattctatcttcattatctgatttaatcctcaaaaaaataattgatgtggaataagttttttcattcccattttaatgctagaaaattgaagcacaaaatctacccaccaaattgtggactgtgttttctgtatctcttatcaaagctctccagggtccctagaccctctgttgtccctctgttctagcctttcagattggcttctttcacttagttattatacataaaatgccatgttataaaatgcctcagtcaggataatggggaaagtgttcttgggagacagtgcacataaagaccttacagtgctgggtgctcaaaatgttaccatcacttttattgttagcctcttccctcttaagtttccccagtgtttaggaaattagcaaaactttaagggttctcatggtaagacagtgatacgactattatgtatatggtaagggggtgatatatctatcatggtaagtaacaggacattgaaaagacagtcatgggaataaagctaagtaaacacatgtttcattggaatagcttctattagtgacaatacctcctatattttggactaattcccagatgaaagattttgctgaaactaggcattaatgaaactaagccattcagtacagtgtgattttctttttttatcttgtgatttgagaagtatattctaaaaacccagtaattcagccaggctggacattcagttaaatatcagtggagccagctgtgtaaggacttattggctttgtcctatacatgtggtatgtctggagttttggaaacaattcatggcctccttttatcggttgagtagcattgaggcctcataaaaaatagtaacttgattctaaggtaaatttccctggaaagtatgaaatgggaaagttaggtttccatgtacccccccgctacgcatagcattatttcaattccaagaggcatttgtagtcaatttctatgatgattggaaaggagcttaaaaaattcttacaatctctttaaaaacttttgaagcagaggagaaaaaattggtaatttgtttttcaggaagaaacatacctggatttatctattgctacatgtaggttttttttttttttaactaactagaatcacagcatctttttctttttaaactaacttgaatcacaaaatcttatgtcatacttcatgtctttccttattaaggataattagtttatggaggattcagttatgatggtgatattattagagacttatctgaatgaaatcagaaaagtgtatcccgttttatgtagaagatttttacataaaatatttacacacacacatacacttcattttttagagcagttttaggtttaacagcaaaactgagcaaaaagtgcagaatcctccctacccccaccatacccctcaccctagcatccctgactataagcttcaagactgcaccagtatggtacagttgctacagttgattaactggtattggcaaaacataatcacccatcttacatagtttacattagagttaacttttggatttgtacattctgtgagctttcacaaatataaaacggcatgtactcaccattatggtatcacacaaaatagtttcattgccctaaaaatcctttgtgctctacctattcatccccctaccaaaaccctgatctttttactttttccatagtttcgccttcgcaagaatgtcatacagttggaatcatactatatatatgtagcctttcagattggcttctttcacttagttattatacatttaaggtcctccgtgtcttttaatggcttaatagctcatttcttcttagcactgagtagtacattgcctggatgttccacagtttatttttccattcacctaatcttggttgcttccaagttttgtcaattatgggaaaaagctactgtaaacatttatgcgcagatttctgtgtggagatcttaacattcacattggttactttttttaaatttcagatttatcaatattacagagctattgcaagagtcatatgagaatcgaggatctggaaattctgtatgaaagaggtgccatctgagtagggccttaaaggatgcgctgatttggacacatagattggaggaggtacatcgtactgtggctggcacagtatgtgattttctgtttgattggagttcatggtaaatgtaggaacacggtgttatgttttcgatgccttcgatgctaggctaaagaagataggcttccttagtgaggccataggaacccatggcagatttttgaggtaggaagtgataagtaatgtcactcatttatttaagcagctagtcaagctcgcttagttccaaatagctgcttgaccttgcctagttccaaataattgacttaaaattaacaagttgacatttattaaacagtactttttacagtttaattgttcaccactttagactaaattttttctacaggtggtgcaagttaattagattttcttataatgagaaagaaaagcatttcagtacagtgtcttctgttctgatattcaaggtcatttcctatataaaagtaaaattctacacagcataaaaccatcctttttgacatttagggaccataggttttaataacattgaacaaagggttaaattttttaaaaagtttttgtacactctttctttggtatgcttcatctctttcatttgagctgaacagctttaaatttcacttaaagaaatgctagataaagagaagaacattgtataagggcaactaagtgaacaggaagctgtgcttctcagaatggggagattttaaaatagaggagaaagctgtcaaagcaaaagtatagcagcctcagctttacttgggaatttattagaaatgcagattgttagactctaccccagaagtcctgtgggcggggctggcaatctgtgttgtaagcgagaaagactaatctaaaccactgatcaagggagggggatgttaagacttactgcagaaaagaggtgagaaattgtactaacagttactgttaattcaacacttactttgtaatgcacattttacagatacagcttatgtaatcttttatgtcaaccctaggaagtataatattacaatatcttactatatagatgagcagaaaagaatggtttaagaagtagcattgcaaaacttccggcatggaaggtgtctttgactctatactctgacctctttaaatcgtgctaggccatgcaggtatgttgtttgtctcccagaaggcagcggtggggctaaggcagcacccacctctctgctccctctgctgcattccccagcctccctgactgaggtaggtatttcttccttcctgcatccaggtggagcctgcctggtccagtgaaggaagcagaacaggaatggcaggaaaccagctttttctgtttctctggagttctcttaacaaaccctgtgaccctaggcctgtctcttggtatctctatgccttatttattttcagcggtaaaatgaggactgggataaatctgtaggttctttctgaattttatctggctctagcacttaattagagacagatggtcaaactaggtgacctctcaagggttcattctggttcgtgttgagaggagtttgatattggaaataatagattcttgtttatgtgcgaaatggagacagtactttctggaaatggtgtgatgcaaagtgaaatcatgtctgtgaagtccctagtagcctgcctggcatacatggaaggtgctcagtaaatggtagttcctcagtccccaagaggaaaacagccgcattcctgattctggtgttttctttccttaagttttaacaggttagtattttaattttcctctcaaggagggaataagaggtgctaggtttgtattaaaatattaagttaattaaagcttcctattaaaattttaagagagaggaagagaatggggcaacatgaccacaataaataaagcaaataggtcattatgtttccaaatggcattatcccttgactgttggtagctttcctaataataataggttgaaaaaatgttactgtaacataaataataaaagatacttatggtagtactctgctaagtactatatagacatgagatacttaataacttttaatatcatggtttggcaaaagaaacttcacaatggattaactatttatttggtgaacttaacttggggcaggcttgtgggtggaatttaagggttatttcttcttttttttttttttgctcccccggagacggagtttcactcttgttgcccaggctggactgcaatggcgtgatctcaggtcactggaacctctgcctcccgggttcaagcaattctcccacctcagcctcccgagtagctgagattacaggctcccgccaccatgcccagctaatttttcttattttagtagagatgggattttgccatgttagccaggctggtctcaaactcctgacctcaggtgatccacccacctcggcctcccaaagcgctgggattacaggcgtgagccactgtgcccagccgagttgtttcttccctaatttctctcacaaaccttccttttatatagagaaaacatttttacttttcatttgaaatattcttattgttgtttttttctgatcattactgatgtaccttctatagaaataagacacatatttggcagggcacagtggctcatgcctgtaatcccagcactttgggaggccaaggagggcggatcacgaggtcaagagatcaagaacatcctggccaaccaacgtgatgaaaccctgtctctactaaaaatacaaaaattatctggacatcgtggcacacgcctgtagtcccagctactcaggaggctgaggcaggagaatcgcttgaacccaggaggcagaggttgcagtgagccaagatcacgccactgcactccagcccaggtgacagagcgagactccgtctcaaaaaaaaaaaaaaaggaagaaataagacacatatttatcccaacgtacattgtttttcacaagttgcaatttgatatccttagctagtttcatcattctaccgtgacatttatccccattatgacatttctaaattatagtgcttctctctcatgttacgcatgtttctaagctcttggttggaatctgtaaaatagctagttgttaacatttaataaaatttagacttacctcaccttactctgttagcaaagagttacatgaactctgttgttttgaattaagaggtcagttgtggcagtaaacctgggtagaatttggaaaggaactaggctacttcctttttgattcttccttattaggtcatttgtcaagtggatacattatcttctttccctgagggcaggagaccatcttagttcccttctgttaaagagatctatgattcattacttccagtgtgaaggccaggtgcttttgcatgagttgtaaactgctaagcgagcccttttgtgccttgtttgtgtatgagagtctttctcttcagagtgtagggcaacctgtccccaaccagtcccctttcccaacatccccacccacagtgtgatggatgctggcagtcataccacattcaacatttccaagtgggacttgtttttattggatatgatcaccaaaaaaatttgaatttagatgagaaacaaatcaaggggtggttattcacattgccgatgggttttgggttttgtttttttttttttccttcaaaatggttcagcctaggggttctttaaatagcaagttgctctgctagatttaaatgggatttgatatataaaaatccatttacacatttaacaggatgttatgttggtataccagaatgatgaagagcaaaattctggagtcttaaacccaagcaagtttagaatcccagctttctcgtatcctggcttgtgtgatcatgggcgagttatttaacttctctcagcctcggttttctcactggtaaaccagagatcatagcacctcatagatagcacttctggagtgttttgaatggcagaaacagaaagtgtcgtgtaagacaacacatgcattgtgtaaggaaagtcttagatgtctaacacagcagtggcagtgttcattttcagggccattttgcctgagtttttgttaggcccttctctcttttcttctttgaatgtatttgtaaacttgaaaagaacaccgcgaaaagagctcaggatcctgctcagccacacttcacctgctctccagcttggcatgattgattgtcaggaaggcataaagaactcaaaccatgaattaccctactcggggtaatcacaatggtttggatggcatctccttaatttttgctttgacttttctttcctccgggcaagagagagtagaaggagtggcaagagtatgccttttagttactgagttctaaattcttggaatgagcatagtctgttttctcaggatcagactagaaggcgtcattctattacagaagagccaagacttgtcccaaatggatgtgggtttcagcaaagcatctttagcttaaggagcgaaggatttggactgtgttcagcatctgtgcttcgcaggccactctttatccttttagtgagtcccgcttgtctgtcctctgtcaagggctcgtgtacaccatgctgatttagtgctaactggggagattacaaatgccttgcctggcactgtcagctaaacctgaatcattgtctgtgtactgtgacccgactagtcagaggtttaccctttgctttgctgctcactcttataggcagaaaagcccagctcaccccagcttttataacggggtcagctccagaaatagcacctttaactgggaatagaagcaacacaaatccagcaagtagatagtatacaatggctgctttttggccttggaacaaacaaaagtggtttatgtttactacataccacttccaaaactgctgtctgtcatttactagagagtttatcattcctgagggccaaggtctaggttttcttcacacaaatgccctccaagtgggagctgcttggtgttggtcattgtttgcacccagatttataatttggggttaattagacataaagacttaaaggcaaatgtggtacctgatggaccatgggtagataagacacctcccaaaatggatggtgaaattctttttaagagtcatagtatggagaaagtccccttgtgaagctttgtgttggagcctagaattgtaatgtatggcactattagacttccaaaaccaatgtgaacttcagtcgtttgtatcatgatttgctttatcctatgttcctatctttcccggtagtaggtattactttgtctgtgggttacatgtctttctcctctaagatttaacctggggattattacatgcatatttatatgcccagagacaatagtaggcgctcatcaattgttgaataaatgaatgaatgaatgaccaaatgattgaacaaacaaaggagcaagtgaacaaacagagatgtgaagtggtggggggcatttctatatgattgtgtgtaaagagcaccctaacacagcatctgaacaaatcactcttggaaatctgttcaatcccaccaccttcactagctattcctgtgaaccccaaccctcccctagatacattttggtgatatattagattattttttctttgcctccctcctaccatgataaaaaggatattgaatggccaaaccagtgcattacagtaacatgaaagaaatgtttatctttcatctaccagaattcaaggaaaaaaaccacaaaactttgtcagctagatactttcctgaattgttttttaaaattgtttaaaaaattattattattgccaggcacggtggctaacacctgtaatcccagcactttgggaggctgaggcaggtggatcacctgaggtcaggagttcaagaccagcccgagtaacatggtgaaaccccatccctactgaaaatacaaaaaatttagctgggtgtggtggcaccatgcctgtaataccagctactcaggaggctgaggcaggagaattgcttgaacccgagaggcggaggttatggtgagccgagatggtgccactgcactccagtctgagcaaccagagtgaaactccatctcaaaaaaatatatatatattattatttttaatagggtcccaccctgtcacccagtctagaatgcagtggcacaattatagcctacagcagcctgaaattcttggtctcagggaatcctcccacctcagcctcttgggtagctaggactgcaggtgtatgctaccatgcacagctatttaataacagttttttttagagagggagcgttgctttgttgttcagactggtctcaaattcccggcttcatgcgattcccctgcctcagcctccttctcaggtagctggtattgtatgaattgtgttttgaataagaagaaattaaggcttataagatcagttgtgtgttagcagcgatgttgctgactgatctttgcaatctgtaggactatttggtgctacaataataagaaattaatcagtttgataattttgccatcatttttaaaaaattttgtaaaataattgaaaatcatatgtgcaatatcttataaatttttattttcaaagcacattcctatatggcaattgaagtacagtttgaacttacttttgactaccttcttaatagtgattgatcataaattataaaattttcacttaccaaattatgtttaaaaagctaaatttaacattttctttttaattttggagttgaatggtcctttattccagtctttgtttttgtttttttccaagggaagacaaatatttaagttcaaagtcatgtttaatagaggaaatgaatgaaaagtggatgtctgttatctgtttgcaacaatcatctttatgtcctagtaaaagtttaattttaaaatctaactttacagatctatacccagtaaatttttttttttttttttttcaaacagagtcttgctctgtcacccaggctggagtgcaatggcgctgtgtcggctcactgcactccgtctcccgggttcaagcgattcttctgcttcagccctcctgaatagctggtactacaggtgcatgccaccacacccagctaatttttgtatttttagtagagacagggtttcactatgttggccaggctggtcttgaactcctgacctcaggtgatctgcctacctcagcctcccaaagtgctggggttacaggcatgagccgccactcctggcccccagtaaataattttaagaatcttaaagttactcatttttacttagactttatgagattaagctattttcaaactcacttctatttgtcctcccctgagagctatttacaaatttgtatagcactctggagtgtgataatatcgaagtcaatgcacagtcaggaggcttgttaacttatgtgatgatgtcagttttgataaacatctttctcatttaggcatttaatgataatcatttcttcaagaaaaagttcttagtggggaaaaagaggcgaaaagtacagtgtgattaacttatgatgcattttggattacagccttttaaccaaaagagaatcatcattaaaacaataattcctcagaaggcttgaggcatttaacttctcttaattaaattagctcagtttactgccagtcaataaagtctggtttggaatgatgatagaaattaaatatctaagaatgcagtatacataatagttaaagaaatgcaattaaaagtaataaggaggtactacttttcacttaggaaattaataatgatttatagaagtgagactactaacttctgggaaaaatatagtgagactgtcacttttatacaccactagaaagcccttttataatgtttgtcaagattcttcaaaatactaatagcttttgatccattaattctttgtctaggacatgctgagttggtgatcagatgtgaagaaaacttcaggccaggcttggtggctcacgcctgtaatcccagcactttggtagttcaaggtgggagcatcgcttgagcaaaggagttcaagaccagtctgggcaacatagagagatcccatctctacaaataatttaagaaatgaaattagctgggagtggtggcacatgcctgtggtcccagcttacttgcaggactaaggcaggaggatcacctgagcctgggagattgaggctaaagtgagcccgtgatcacaccactgctccccagcccaggtgacagagtgagcacctgtctaaaaaaaaaaaaaacctggaaaaagaaaaacttcatacagccaaaatacccaacatcatgcaaatgcatggttgatttatgttattttctattttggaatattatgcagaggttaaataataagtgcacataatatttactacaaggcagaatatttgctatatcttaattttactaaaaagtgtaacatataataatatttgaattatgtatggaaaaagagagtgagaacaagaatgaattgaaaacagaaagaaaatgcacccagatgtttacagtcagtgattatgttctgactggcaaaacataagtagattttttttttcttttttttttttttgagagagatggagtcttgcttgtggcccaggctggagtgcagtggcgccatctcagctgactgcaagctccccatcccaggttcacaccattctcctgcctcagcctcctgagtagctgagactacaggcacctgccaccccacccggctaatttttttttttttgtatttttagtggaaacggagtttaaccgtgttagccaggatggtcttgatctcctgacttcgtgatctgcccgccttggcctcccaaagtgctgagattacaggcgtgagccactgtgcccggccataagtagatttattttctaaaataagtgcatattacacttatgataaaaattatcatcatgaaagattttatgttcaaggatttcatatagctgctttgtatttcttctggcacattacagtcatagtggcagtgacttgtagggacattgtcctgatacttcgagtgcaattgatgatatttgtttaatagtgaatgtagcttaagaaaagaaaagcaatcaaacaacaaggtgattaatgtagccacttcaactcctcagatctttggctgacatgttttcctagcaaagcagaggtacttaactaaccacagagaaatgctcacacatgtcagaaggaaatccaagtgatcacttgttttgccttgggcatctgcactttttatataagtatgactttcagtctgtgagacctttcgataagtagtgataatccagaaggattgatgtagtgattctggacttgagatttcttttcaccactaagacatttgactgtcacttgcatcttaatgcgtccatataattttctaaagcattgggggactgactaggtaaagtcactgtggccttttaagtatgtggccagctgatctcatggcctaccagggcttccaagtgattagtggggattggcaagaattgacctctttggagcctggggaggcagaagtacctcagtaatagggttcagggagaccatacatggagcatagctctctctgactttcaagtggatagagctagtaggcctctactcattgtggtgtttgtgatcagacaacccttgctttggaatcactcttcgttgagagatactgagtccaggatgtgccaagcaagattgtagatactctcacagatgaattcacccattcatttattgagcacttgattttttaggagtacaacttcatcattaatttcctagctgtgtcatacaggatcagttaggttagattctccctttgtaattaatcctaattgctgggactttcatgtttctaataaatgtctattcccataatcctgtcctacattagctttcttcatgttgttctgtgagatctatagtaagcagatgacactgcttattatagattagctacttcctgtgtaataaatcaattattcctctcaatagggacaatcttgaattaaaatcacatttttttcttagagaattctctgtcaaattctatcaaaggccatggttttttttgtttttttttttttcctgtccagagacaccttattaatgacttgattttatccttatttcaaattctaattcatgaatatcagggtataaaatattaaatatgctggttcagctaccagcttttcaagcatcattggggaacatcctgttatataataggaaaacatttggtatggcttttgggatgtagatcatttttataattattatagggagtaaaaaatgcagaataaaaaataatttaaatataattagaagtgagagcaggtcagtatgaccaagaatataaatcataaatctctctatttttgtgttcctttatttcatgcagagaaataccaaacctttgtttctaaaagggcaccaggtctttcagaaagctgtggttctcagcagcaattttagttaggtttcgtttcatgttttctggtattctgggcctcccaatagccatttgtgcctaaaagagagagaggatgaggagatttgggttgcttgtactgccagcctggtggcactctggggatattagatgtgttctgaggatatatgtgtttatttaaatttaaacagaaagtatttcaatggatgctgggcgcagtggcctgtagtcccagcactttgggaggctgagttgggtagatgacctgaggtcaagagtttgagaccaacctggccaacatggcaaaaccccgtctcttaaaaaaaaaaaaaaaaaaaaattagccaggtgtggtggtgcatgcctgtaattccagctgctctggaggctgaggcaggagaatcgcttgaacccgggaggcggagtttgcagtgagcagagattgcgccactgcacttcagcctgggcgataagcaagactgtgtctcaaaagaggctaggcgcagtggcttacgcctataatcccagcactttgggaggctgaggagggtggatcatgaggtcaagagatcgagaccatccatggctaacacggtgaaaccccgtctctactaaaaatacaaaaaattagccgagcatggttgtggtggcacacacctgtagtcccagctactcgggaggctgaggcaggagaatcgcttgaacctgggaggtggaggttgcggtgagccgcgatcaagatcatgccactgcgctctagcccgggcgacacagggagactccatctgaaaaaaaaaaaaaaaagaaagggagagagggagggagggaggatttcaatgggacagaaattcaccaggtacattagaaagccttaacacttgagaatgtgaagtcttaaaaaaaatttttttaatagtttgggttacttaaaatgaaatactgtactgaagcagatagaaggactcttaggacctttctgtgtttcttctgtacctaatggcatataataaattcactgttttgtttaaatgatcagttgacttgagctttctgtcatctgctcagaaacactactttaggaatcttattccatttgggaattctgactagaagctctcccagggtcatcatatgaatgagtaacttacttcgcagctctcctcttcctcagtagctgcttctctgtagggctggagggaaagagagtcttccatgcagtctcatcagccaagaggaaggagatgctggtacctggtctgcatcccaacagacagcacaccctcatgccttccccttgaatgtacctttttggctcttcctcattcctggggaaatgtaatagttcttgattgttcacagtgttgactgctccctacaatgtgaggttccccctctcctctcccacagatggcacagagaaagtgcttatcatcgacacagtagtggggaaaaaaatggattctcattttagcaggtgacttgagggtggttggttgtcagtgtgctttttttcatattggcttgttgctacagggtctgatgctggcagattacaactttgtagctagtcattttcgatttatttgaacctatttctccagtctactgagctttcactggctagcatcaattcagacacattgcaattcttcagaatctctatccccatcagatggttcgatctatgagaaatttagctagaggcgtttagacaaaaaagaaatattgtggctggggaagcatttaagttagaggaggcagccagggctgttttattacttagtcctgtgtcacctgtgatgacccatgagagtggagaatattgatcgcttgtcactcaaggcattcagcagattgcattgacaaagcttggcaggtctctaatagcagggttactggccttgctgcggcccaagggaaaactctgcaggccctattacttggcggcctttaactcttatagaattgggagagaacactgacaaaagcgaggacatgattttacggttacaaatgatttttcttgcttgctttcttctcaccctttttaatttttcttttcttcttttcctgtctatcttaccttccctccgtgatccctgccagcccctcctttcttattatagctgatcatggcagtattgtttttttctgggtaaaaatcagagtggattagagaaagcttagcaggcctagcatgaggcctgagttattctctccttttaggacagcttgtgcctgaccacattgtttggaatgtgcctgtggatatatatacagtacttgaacttgatgtgtaggccattcacagctgttgtcctctagtagaataagaactgccacttcatgacagatgggtttctctcgttttccatttcctggtagccaggcttggttcaagcctttgaccttacatagtcccgaggttcagctgaaagtaatgtgctgacatcagagagataatggcactagtgcaaaacaggaatgattctaaaaaaacagtagagaggattctatctttcctagacactgcctgatttatgcacaggttcgaatcaccaccattaatgacattttcattcctaacataggttggcctcctgttggacactgttgtgtaatgagcgtttctgcatggctgtcatttgctttatgaagcattctttttatttctattttctgtgtacctttcatttaaaaaaatatcgtgtttgttatctccattgtctctttgaggatgagaaagacaaatatcattacccccatttcaaagaagagtaagttctaatcacaagtgatttaaatgttagagtttcattcaatattttcactaaaatttctagtcctctagtaaatcagatataagcaaagatcatatgtctatttcagcctctaggtaggctggccagctttcttgctttctccctctcccctcccctcccctcccttcccctcccctctcctcccctcccttcccctcccctctcctcccctcctttctcctctccttttttttttctgtagtcttgtactggtcaccccttcacttcctcttcctttgcaatgctttaggctgcccaaaaggttctagccagatgaacagaaacagaggagaggagagcttcttaagaggctggtaggccaggtgcaatggctcatgcctgtaatcccagcactttgggaagccgaggtgggcagatcacctgaggtcaggagttcgagaccagcctgaccaacatggtgaaaccccgtctctactaaaaatacaggaattagctgggcatgatggcgcacacctgtaatcccagctactcggggggctgtggcaggagaattacttgaacccaggaggtggaggctgcagtgagctgagatcacaccactgcactccagcctgggtgacaaagtgagacctcatctcaaaaaaaaaaaaaaaaaaatgggatgggtcagccttgagtagtggacatggcctttgcatttatattccaacattttgccacagatgagttatgtattattggcagattacttaatctctctgagcctttgtttctccatttatcgaatggaaggtaatattgtttaccaaaaaaagtgaattatgtggtatatggattatttctcaataaaaaatatgagttgtgtaaagtttctaacatagaaatgccctcctttgcttccttcctccttatacaactaagggcccacaaaggcagaatgagaattaccatctaggccaatactggggaaatatgtgctactactggagacagaaatgtggaagtattgcaaacgaatgtggacctattaatattctatagcactttgagccactttgaattaaaatacttatctgtgaaaggttttataatttatatgacctgaaataatttacacctaattagattttgtcaactgaataattctgtctcatgttgcttccacagaataatttaagcaactgcattttattctcaaaatagctgtaaatgtcaaattaattttgttgacatgatcaacatgtagaagagctacttggcagaattgtttgtcaactgaatgtattatgcatctttacaaaatatgtagattgattatggtttagctgacttttgcagtttgttggtctcctggaaagaagtaacgggtggtggttacaaaaaccgttatggcatttctgttcatctggctagaaacttttcgatatctgtaagttttccttcacttttcattatatagaccatgtctttcccttgggtgttatcttttttgtctgggtgagactggatcccacgtaactgctttggtgtttgttatactcctcattaattttatggggctcttagttgacactggccacataaaaatgattgttgagtctcactctttttattttggaccatttctttcatgtgggagcctctttatccctctccttaaaaaccctgtttaaggattagtgtccttgcagtttagttgtagcttactcaagttatcccatttattccaaaatcccttttccactccattataccctgtctagtccggtcttctagctactaagattgaagtcctgtcatcttcaggtttggttgaatccagtgcttcccaaccctgtctcatcatggcacatgtagaaaatgatattattgtacagcacacggaagtaaatcaagaccttttgctgtggaggtacctggctcagaggccatgacctgccttaagtaggagggaatacatgcatactatcctgtatgttttggtgtaaccaatccccaaatttgaaccaatcttggcaggtattagaaatttgcttatttggtgacatctggaatttacctcctcttttgagctcagtatttcatgtactttaaggtcattactgagctttctaccaaatcattcccatttgtgtctagtcattagataattcagatttctaccttggatgccttgaagtgatgacaccttacccttgctcatctctctcccaagggaataaacctgtattttgctttcagcttctgcttagaggagctggctccatccagaacaattcccctcccactggacatcaaaagattgcatttccattggcaacaagtctcaacatagctcagaaactactgttgactacttgtctcccctataacaatattggatccattggagagtgaatcagtgtctccctcaagttcagcccactcatttagatttttcattttagactccgtgggaaggatgtcccagtgcagagttggcctctgtacccctgattatgtttcagctttctctaatttctctgctaacctgctgttgatgcccctaaaggcactcaatattgagtgtgctttataaatacatgaactacatgtattttatgaaaacataaactacaaatacgttaaaatatactgtagattcattactaaaaggcattatctattcagtatccttaatgtacaaataataaaagagatatgaaaccctgtgtctagagctaaaaatataccttgacagtacaaatacacatggctaaaaggcattatctttttagtatcttcaatgtacaaataatcaaaaggtctgaatacttctgattttcataatggagaaggggaattgtagaaactgtagaccaattagcttgatgtcagctcagaaaagattctagaaaatattattaatgaatgctttctgagagtttaataaaagaagtagtcatcactgggaacctgtggaggttcacttaaaatgttatgccatctatattccttcttctgcagcagagattgccaaactttttctatacatagccagatagtaaatattttaggttttttgggccatacagtctctggtacagctactcaactctgccactgtagcaggaaagcagccacataggcagtatgtaaacagatggatgtggatgtgttctaataaaataacttaatttataaaaacaggcagcaggctgatttggccaattggccatcgtttaccaacccctgctttagaagaatatcttagataatgtgtacctgatatattctattcttctttctgatgggaaatactttctctttttttggcgtaaagacgttttattttctttgctaataaagagttggcataaaaaaaagcatcgcattaaaatcttcataaaggacatggaaaaggctcaagttaataatagtttacagtaagttctcacttaatgttgtcagtcatttcttggacactgctaccttaagcaaaatgatatataatgaaactaatctttttttctcaccaacattgtagtgaaaagatgttgaacaaaaagacgttatccaaggatgtaaatcatttaatttaaagttgcagtttccaagaacctattgactgtgctaagtgaggacttactgtagttaggtagaattataacaggtttaataattatgaaacatgaagagtggtctgtggttgcaggccacaggctgtgtgctcttgattcaattatgtcaatatttttattagtgacttgactgaggttggaattgacttgtggatcaaatgtgtggatagcctgatgaagagagagatcacttacactttgggtgataggagtaagatcccaaaaggccttaggatagcagctgaaatctttcaggcttaaatgttgaaaacagataaatgggaaaccctgtgtctggagctaagaatgtatcttgacagtacaaatacaaattgtgaaaacatagttgaatagcagcctgtttgaacaaagctaagagagtatttcaattagagtgcttgcagagaaagttatccaggtggttgaagggactcagaatcatgtcctattagaaatggttgaaagaagtgtagatatatagcctagggggatatatgataactgtcttcaattatttaaagggctgtcatgtagaagaggaattagacttattctggggggtcctggaggacacaggggagagcagtgggtagaagatacaggtagattcaatatgtaaataggaactttctaacaatttgagctgtccattagagggatgggcattatttagagggtttaagtcactggcaatattgtagacatctgttgctgaccttgtggggatgttgtgagagaatattagctttgactcattattggatgggatggttcttatggtcactaacaattctgagagtgcgtaaaaggtaggccgagggataatgtgctgcgccctacgtcccagtagttggcaaagtccaaacccagatgttttgagtctcctgccttgtttatatggttgaaatgctgactttacacagtgttccatatatgtatctgtacctgtcatctttatgtgattggctagagaccctgtcacgttcacttttgtaatctcacaaagcttgacaaatgccctgtacataggaggagcaaagtgtttgttgacctaaagtgaattacagaacagctgagacacatctaaatattgttcttttactgatcctggttccataatgaaaacatttggaagttgaccagaaattatacctggggattcctagtagaatggtgatgtagatggaacggctctctgcctttgtttctgtctgtggtacaccacacacaaatgccaacacttcaccaagagtggaagccatcaggctgcactctctgaccaggattgttttaccccttctggatggcaatacatcgctccctttctttttcactgcctcctgtgcatacctccgtgctaaattaaactccagaccctgggatgtctggaatatattttccagtcttctgaattctaccaccctgaagtagtcatttgctgtcatcataattctggaagatttaatattcagattgacagtggatatgccggtctcattctttgatgtttggtacatgggcaagtggtcaggtatcctggcctatttatcaccatattctccatggcctgtactcagggtcaggcatatggtaggtagtcagtgaatgtttgtttttgttagtaggactctggtttagtccttacagtagtcccttttatccatgttggtatgttccaagacacccagtggatacctgaaactgtggacagtaccaaaccctttccatactgtttttttttaatatgataaccaagacagctactaagtgactaacaggcaggtagcatatacaccatgctggacaaagagatgattctcatcctgggtggacagatcaggacaacgtgagaatttcatcttgcaactcaaaatactgcctaatttaaaatgtattgacgaattgtttatttctggagttttccatgtaatatttttggactgtggttgctcatgggtgactgaaaccacagataaggggtactactgtacttctgtttcatcctaatgaagtaaagtttctttgttcatcaaggcagtattttctttctcttttgtacctaccatgctctacctacctcatgtcttcattttctgtgccactttcttgctgtgttttattaggataatgttttaatagaataaaagaagggcaaaggtatagtaattgaatgtccttcactatcaatccccccaacccctgaagggagaaaggaaggagaatgtgggggagaggggaaggaagaaaggaaatggtggagaaagtagagaatgagagaagcatcctgtttcatactgagaagactttggtattgaagaattttgactttgttagtgccatataacttgtgtgttgctttgtttaaattctcgtctgctctcatgttttcattgcattctgtggatagcagctaagagagctttcagacacatctgtattagaagtaaaataactgttaatgtcaagactatatctttgcttttttctccctcagcttcttttctcgattggtagaaaacatggaataatggtgccagggttagctttgcctggagaagagttctgtttgccagccctgctgcagattgataaccatcaagggaaggatagcccagtcataagtgaccttgtggactgcgtatctttatgtaccccttacacactagtaggaagaacccaaataccatctgccaatgacagtgaggcaggaacctcacttttgtgacaaaaggattgtactttgctctgctggaactggctcgttaacaattcataagaaccaattaagttttcaagaattttgtgagctggttttttagtaaaacctttattagaagttaagttatattaaaaaaaataattagatgggtatggtggcaggctcctgtaatcccaactgcttgggaggctgagacaggagaattacttaaacccaggagatggaggttacagtgagctgagatggcaccactgcactccagtctgggcaacagacagaaactccatctcaaaaaataaaaaaaagttatgtaaacttacctgtgcttttaatataatttacttaattgtaatcagtattcaaaattcatcacttccttattagctgctacattttactaatatccatgaccttgaggttatttacatctagtatatggtagaaatactacaaaatgatgtgttattgagcctcttttcctaactctgtattcaatgacatcactttagtagccatggtggaagtatttacaccacagaaattggtaaacaggatgtcttattctgttttgttctgctgtaacagaacaccgcaaactgagtaatttataagcaatagaagtttatttggcagatggttctggagactgggaagttcaagatcaaggggccatatctggtgaggaccttcttgctgtatcacagtgtggcagaagacatcacatggtgagagaacatgctcaagagagtttgaagctcttttataatcagcattaatccattcatgagggtagagccctcatgacctaaacatttcccattatgttccatctcccaacactgttgcacttggggttaagtttgcaacacatgcttttggggggacacattcaaaccatagcactgtacaaatccaaatttggtcatttgttttgttgattgtctacacttaaaagaatgatggaggaaatgttattaatacagattaaatttaaaagtatgttgtatttgcatccattacattgtggatagcaaaacaattaagagaatatcttcttgtattttgaaactgtttccaactcaacaaagaagttattcatgtcctcgaggaaggaaactgtttatatcattcatgtcttaggtgttccactttaattttactggttcaaaaacatcaaccaggttttacaaaactacactcattcttcaggtacaaccataggttggctgtagatataagaattgcacatattttaacagaagcattctgtgaatgttaattttcccatttggttggaattcacagtaaagtttagcatgtactttgttattatttgtaaattgcttgctatacatgatttatatcagtaaattttataataaataggtgtacatctatacatacatacttcttttcccaaggagctggttgttaagtattaccaacacactactgtttacaatccaaatgagaatgtagctctgtgtcttaaggtagtgatgatcttgtgtaaatggtgagatttttgccttcatcatagcaaaaggctcaaatgcactataggaaggaaacctttctgattatggaatatgaagtcaggattttaaatgccaccaactgtcgaacacttaaaggacaaagtgtttgaaatcttaaagcctgcctactctatttaaaagaacattagagggcgttggaaagaggtgataaatatcattaggacctcagcaaggctttggaacccaacacattgaaagataattgagtgaagaggatctctggacacaaagcaggcaatttagttatccaaagcatttatgtcaagcagctaatgcgtgaggatttatttatttgtgtttttctctcagagcttaatccatgaggagtacagagtggtggtagggtggaggctagcctttattttgcattgctctgagaagtgttgcgataatgggagaaatttggtgtcctagaaacgttattattataaatgaaaaatcttgaaatacgaggaaagtgaattttttaaaactgggattagaaactcagaacaaaatgagctggacgcgctggtcatgcctgtaatcccagcactttgggagtccaggaagggcggattacttgaggtcaggagtttgagaccagcctagccaacatggcgaaaccccgtctctataaaaaaaaaaaaaaaaaaaaaaaatcagctggatatggtggtgggtgcctgtaatcccagctgctcaggaggctgagtcaggagaatcgcttgaacccgggagatggaggttgtagtgagccaagatcatgccagtatactccagtctgggcaacagagcaagactccatctcaaaaaagaaagaaggaaaaaaaagaaactgagaacaaaatggtcttttgcctctttctacttaaataagatggctcatgcaaaactatatttttgtgtgagatttttggttaacaagaagttgtatttccgttcatcagttagactcagtgtggaggaatgttttgtttaacctactttaactagaaacaaaatgtatttgcagaagtttataggtagaattataaggtgatctaataaacttgaaggttactttcagcatatggaaatcagaattttgttagtggaatggcaaatgtgaagaatgaaaaatccagttgatgccagttaacattaacttttaggaaagaaaaaacggtagatttttctgtgaagagtgtgtgtgtgtgtgtgtgtgtgtgtgtgtgcgcgcgcctgtgtgtgtgtttaaattagatttttctgtgaagagtgtgtgtgcctgtgtgtgtgtttaaaatttagctcatctggttctgtgttgtgtgttttctctgtgtgtgtttgaaaggggacatattatgaacgttatggttccctacctctaagatccattcctaaaatagttttactaatccgaagaatgactaagaatgtaactatggaaataaaatgacttttcaatcctgtgttgactacgtgcctaaaatgttgatttgctaaaacctggtacttccaaattaaatttcatggtatatggatgatttattgtaatctcttgtgaggaaattcatcttaaaaactttttcgaaatcatcctaagtttgggagaggagagcatttctaattcaaagcaggagtcaggctaagatcacatgtctccctagaggaaagaggggaggttttacttgtgcatatgttttttaaatatttatagatacagctggacttttagtactttagttctggttttaatgatggaattcccaaaggactaaaattgttccaaatgtctgaaccgtgtctgaagttcaagaacagtatatggttggtctgaagactttaatcctagttggaaactttgaatgagaaacctggccttttagtcttgtatttcttgaactttctgttaacagaatatctcctcgccttttatgtagcccttaactagctgcagactgacttggtcttctctagtaaagcattttctatgtaaggtcaccagtaaatttctttttgtcaacagagtaccttcttgcctcctattcagccgttaactgttttgtactgacttggtcttctctactaaagcattttgtatataaggtcaccagtaaatttctaagtcataaaattaagtgatttttcttatttcccatctatccagtcaacagtcattttattcagtacctactgtgtgacttggtgctagggattcattagtaaacaaagcaggaatattcttttacaatgtggagctttcaattttctgaccctgttgaccttccttcttcaaatttcataaactcgcttacttctggttagtgaaatcaatgatgattattttaataatgattcctcccctcatgattgtgctcagggccctctctttccctgatgattgtttttcttgatactttgtggatgattttatatggctaagacttccaggttgtcatctgcccatacacagaggaagtcctgagggaacccacgagtttcctctcactgcttccgtgctgtgtaggcaccttctcctgttagaaaaccatcaataggagcttccatgatcatggtggaggcggcaaatagtgtgtattttgcagggataaggcagcgaggacaagttgcctctatctactttagccagaagattagtactaatttctaaaactttcaaatttgtctttaaaaaattgcacccatatagcatatacatttagttgtatgcacacacacactaaaataaacttctttgtatacagtgatttggtataatcttaggacgattgtattttccttttgtttgtaacaactttattgagatataattggcatataatgaactgatcatatttaaactatacaacttgataagttttgacatgcatacacctatagaaccaacacaatcaaggtaatgaacaggctaggtgtgatggcttacacctgtaatcccagcattttggaaggctgaggaagcagaatcacttgagcccagaagttcaagatgagcctgggcaacactggaaaactctctcactacaaaaaaattaaaaattagctgggtatgttggttcgtatctgtagtcccagctactcaggaggctgaggtgggaggattgcttgagcccaagaggtcaagactgcagtaagccttgatcatgacactgtattttagcttgggtgatagagcgagattccatctcaaagaaaaaaaaatgaatatatccatcacccccaaaagtttcctcctttctctttgtaattcctttctcccccacctcccttccatctccaccccagcttattccctggcaaaaaaacaaaacaaacaaacaaaaaaaacaaaaaacaaaaacaaattaactgttttttgtcactataaagttgtatacatttttctagaattgcatataaatggcattacatagcacatactgtttgtccttttttttggaggagggggggttctggcttctttcactcatattatgcttatccacattgtgctgtatataatgtttcacaatattactcaatttatggatataccatagtgtgtgtttatacattggactgttttcagtttttgttattatgtataatgcagctatgaacatttatgtaagagtacaatgtacattctcttggacaaataagagtggaatggctggataatgtactaggtatatgctaaatgttctaagaaactgccaaacaataatcaaagtggttgtaccattttatatgctcaccagcagtgtgtaagagtcccattgtttccatatccttgccaatacttgttatgggcagtcttttccattttgccatcctaataggtatatagtgctatctcattgtggtcttgaattgcatttccctaatgaataatcatgttgagcaccttttcatgtgtgatttttcatctgtatatcttttttggtgaattctgtttatatcttttgccaatttttaaaaattacatttttttcttgagtgtcgagttctttattctgtatacaagacctttatcggatatatggtatacaaatatttgcttccagtgtgttgtttgtctttttattctcttaacagcgtcttacaagataagaggtttcaaggttgttttttaatttttatttaatttttagagataggatcttgctctgtcacccaggctggagtgcagtggcatggttatagctcaccgtaaccttgaactcctgggcttcagccatcatcccaccttggcctcctgactacctaggattacaggcacgaactaccctacccagctaattttttaaaaacttttttgtagagatagggtttcaccgtgttgccgtggctgttctcgaacttctgagctcaatcaatcctcctgcctcagtctcccaaagcaaaggtttcaaattgtggtgaatataatctatcaacttctttttatgggtcatccttttggtgtcatatctaagaaattatttacataccaaggatacagggttttcccttatgccttgctctggaagggttacagttttaacttttacatttatgtctgtgatccattttgagttaatttttgtatatgaaatgagacatatagtgaattcatttatttttgcatacttttttttttttttgagatggagtctcgctctgttgcgcaggctggagtgcagtggcacgatcttggctcactgcaacctccgcctctgtgttcaagcaattatccctgcctcagcctcctgagtagctggaattacaggtgcccgccaccacacccagctaatttttgtattttttagtagagacagggtttcaccatgttggccaggctgatcttgaactcctgacctcaggtgatccacctgcctcgccctcccaaagagctgggattacaggcatgagccaacatgcctagcctatttttacatacttctatacagttgttccagcatcatttcttaaaatgactgtcctttcttcagtgaattacctttgcatccttgtcaaaaatcagttgtttatttacatgtaggcctaattttcttcctttttactaatcaatttgtctgtcttgaggttgccaacccaaggcccatgggccaagaaaagctcacagcctgtctttgtatcatctgttagataagaatgcttttttctatttcttaagggttgtataaaaaaaaaaattaaaggaaatgtgacagaaaacatgtgtactgcaaagcctaaaatatttactgtctgaatcttctcagaaaaagaaaatttctaaacttgacctatcttgacaccaataccacgtcttgattattgtagttttataatctattaaaatcaggtaatgttagtcttccaacttactttttccttttcaaagttgttttggctattcttggccctttgcatttgtgtatgaattttagaatcactttgtaaatgtaaatttcttcaaaaagacctgctgggatttttattcatattgtattgaatctatagaccaatttcaaaaaattgatatcttagcagtattgagtcttttaactcataaacaaggtgtgtttctttatttctttagattttctttaacttctctcagaaaagttctgcagtggccgggcacaatggctcacgcctgtaatcctagcactttgggaggctgaggcaggtggatcacctgaggtcaggagttcaagaccagcctggccaacatgctgaaacccagcctctactaaaatacaaaaattagctggctataatggcgggtgcctgtaatcccagctacttgggaggctgagacgggagaattgcttgaacctgggaaacgatggttgcagtgagctgagatcgcgccactggactccagcctgggcagctgagtgagactccatctcaaaaaaaaaaaaaaaaaaaagttttgtagttttcaggttacaaatatttcacaacctttgtcagatttatcattatgtatttttgaagctgttgtaaatggcattgttttataaattttaatttctaattattccttgctgcaatgtaaatgtacagttaacttttgtatatttatcatatattctgtaatattggtaaactcacttattagtgttaatggctctttttaaaatttatttgtattgtatatatagttgataatgtcaaagaagagtaaatataattttccttttttttttttaatctggatgctttcatttcttttcttatattattgcactggctgcaatctctagtataatgttgaatggaagtggtgagagtgtacatgcgttttcattttaactcatattatggggaagcatttggtgatcttccattatttatgatgttagctgtaggttttctgcacatacctttatcagtttaaagaagtccctttctatttcacatttgctgaaagttttaatcaggaatggatgttggttttgtatcaaatgctatttattaatccattgaaatactcatttttttattttttagtttaatatggcaaatttaactgattttcaaattttttttataaaaacatgatatatttttataaaagtatattaaaaattattcgtatatatatagttgaacttaattagcctgtcattttctttttcttttttttttttttgagacagagtctcactcttgtagcccagtctggagtgcaatggcgtgatctcggctcactgcaacctccacctcccaggttcaaacaattctcctgccttagcctcctgagtagctgggattacaggtgcccaccaccacgcctggctaattttttgtgtttttagtagagatggggttttaccatgttagccaggatgctctcgatctcctgatcttgtgatctacccacctcggcctcccaaagtgctgggcttacaggtgtgagtccctgcgcacagcctattctgtcattttctttcattgtctttggtttctatatcaggataattctgacattatagaatatattgggaagtattcccttctctccaattttctgaagcagtttgtatagaatttatattattgtttccttaaatgtttggtaggatttatcagcgaagcccttgggcctggagttttctttataggaaattttaaactccaaattcaatttgtttaattgacaaagggcttttcaggttttctattttttcttaagtaacatttggtagtttgtatcttttctgagatttattatttctttaatattttgaaaatctgtgctgttgtaacctttcttattcttgatagtgacaattcatgtcttttttttttttttccaggtcagtgtggctagaggtctgtaagttttatcggtcttctcaaagaactaacttttggtttcattcatatttttgtttgtttgtttttgagatggagtcttgctctgtcgcccaggctggagtgcagtggcgtgatctcagatcactgcaagttccacctcctgggttcacaccattctcctgcctcagcctcccaagtagctgggactccaggcacccaccaccacgcctggctaaatttgtttttgtatttttagtagagatggggtttcaccatgttagccaggatcgtctcgatttcctgacctcgtgatcttcccgcctcagcctcccaaagtgctgggattacaggcatgagccaccgtgcctggccacaggtttcattcatattctttattgcctttcagttttctattttatttggtttctactcttatcgttgttatttcctgtattctacttacttttgctctctttttttttttttttagtttcttatgatggaagctgaaggcattgatctgagacccaccttgtttgtttgtttgtttgtttgttttgttttgttttgttttaaagacaaagtcttgctcttgtcccccaggctggcgtgcaatggcgcgatctcggctgactgcaacctccgcctcccaggttcaagcgattctcctgcctcagcctcccaagtagctgagattacaggcgcttaccaccatgcccagctaattttttgtatttttagtagagacggggtttcacaatgttggccaggtgtgagccaccgcgcctgtccgagacccatcttgctttctaatacagtttaatgctatttctccttcaagtattatactattttaggttcatcccacacattttgatatgctgtgttctcatttttatccatatcaaaatactttctaatttttctttaagtttactgagacttgctttgtgactcagactatggtctgtctttgtaaatattccatgtgtgcttgaaaacaatgtatattctgctgtcgttgggctgaatgttctataaatgtcaattatgcataatagtattttttaagtcttatatccttctcgattgtctatttatttgttctttcaattattaagaaaggggcattgaagtctccagctaatatttgttctatcaattattaacaatggagcattgaaatctccaactatagttatagattttttttatttctcctttgagttctatcagtttttgcttcacttattttgaagcttttttattaggacatttaagattgttgtattcttttcatgaattgactactttattattataaaatattctttgttctgaaatatattttgtctgctattgatatagctattgcagctcacttttgatagtgtcttttttcattcctttgcatttaacctatttgtgtccttatatttagagtccattttttttaagagaacttgttttggggtatttaggtctttataattctttttattgtgtctgacaatcttttgcctttttaattgtggatatttagactgtttatatactttcttgatatggttatgtttatatattttatcttattttttcctatgttcctctgtattctttacttacttttccacattttgtgccttttaaaaatcagttgagtatttttaaaggccgggagcagtgtctcacgcctgtaatcccagcactttgggaggccgaggcaggtggatcacttgaggtcaggagttcaaggccaccctgtccaacatggcgaaaccccgtctactaaaaatacaaaaattagctggatgtggtggtaggcgcctgtagtcccagctgcttgggaggctgaggcaggtgaattgcttgagcccaggaggtggaggttgcagtgagccaggatcgtgccattgcactccaagctgggaaagacagagagactgtttcaaaacaaataaataaataaataaataaataaataaataaatttaaaaataataataaaataaaatagaaatcaattatttttaatgattccattttatctcctttcttggcttattagctgtaggtctttgttttttggttttaattgttggttttggggttataccatatcttcaacttataccttcaagtgatatactacccattcatgtataccataagaatcttacaagtgtatacttttgtttcaactctcttgttgtcacacaattctacttttatatatgttctaaagtctatactatattgttattgatatttaattagttaattgttctttgaagaaacttacataatataaattttttttttttcttgagacgaagtcttgctctgtcacccaggctggagtgcagtggcacaatctcagctcactgcaatcttcacctcctgggttcaagcgatacttctgcttcagcctcccgactggctgggactacaggtgcgcaccaccatgcccagctaaattttgtatttttagtagagatgggatttcaccatattggccaggctgctagctgtgctacaatttctggtgctcttcattcttctttacatagatgcatttctatgtaataccatttgccctcttcctaaaggttatcctttaagatttctgtctttttttttttttttgaggcggagtctcggtcacccagactggagtgtagtggcatgatctcagctcactgccgccttcgcctcttgggttcaagcaattcttctgcctcagcctcctgagcagctgggactacagatgtgcaccaccatgcccggctaatttttgtatttttagtagagatggggtttcaccatgttggccaggctggtctggaactcctgacctcaagtaatctgcccacctctgcctcccaaagtgctggggattacaggcatgaactgccacacctggcctaacgtttcttgaagtacaggcctactggtgattaattctttcagcttttgtatatctgaaaacatcttcattttactttaatttttaaaagacatgttagttgtgcatagaactagcggttgatactttcttttcccttctcccagtactgtaaaaatgtttcacagtctttgcaattgcattttttaagtaagaaaattaggtatcattctaatctttaacctctgtatataacctgtcatttttcccctggatgctcttaagaatttcttttatcactagtattgagcaatttttttatgatctgcattggtgtacttttctttatgtttcttgtgcttagggttctttgagcctttagatttgtggttttatagctttcatcaaatttagaaaatgttttatcctcataggactattctgattctcctcagctagtaatttctttacctaatggacccatttacaaaatacactccaggtcctataaattttttttaataggtcatataaaagttactaccaggaatctgatgtttatagtgacagaatcaagtctcgacacttggaaaagaacattgtctgttttctcttgtaaactctgggattgctgaggttttcaaggaagccaggtactaaaccactctgctgttacagtcactgttcttctttttggctttcctacctcctgagattcttggcagatgaaggataagtgcttcataagcctgaaatggtggcccttctgggtcctgtggtaatcatctgagcacgtacttttcatttctgagttagtacggagattcctgaagttctgtctacatctttccaatgttggatttatacccaacatgtaggaatataaaatttagtgctaagatgataggtgttcactttgttccaatcctgtaatttgctgtggtgacatacaagggaaagagaagagccttaaatatttgcctgctagctatcaagtaggggggattatactcttaatctcatttacattttcttgtagctatagcaaagtttgacaggcaatcgtcatatcccccaaattatattagtgtgccagttacaggtctgtgactcctaagtattatttttaatacttaggagtattttaatactcctaagattatatttaaaaaacataatctcaccagtacatttttattccttcctttttaataaaccagctttgacagatgaaaaggaatctgtgctgtagctcagatttctcatgttaggcatattttagccgtaaacttaattatcgcaggaattttcaaatgactccaactttttctgcacttggtatcagaggataccaagtcctgtttttgagctgataaaatcctccttctgaaagcatttgtttattatattactgcttcacatgagctgagctctatcctgaccccgtgttaagtgtctgtggtagatttcattacatccatatactggaagtcctgccaatacactggcagcaaaatcctagtggaaaataaatggcaataaaaaagagaaatgatagcctgtgtgagtggtgaggagcacagctttattgagactggacaaccccagagtagtgacttggcatgcagacatgagcttaagagagtgtgagtgaaagctgatattggaataacgactctgtggcacagacatgggaataatttaattaattgcactgaaatttctttgatgaatagttatgtggtgataagcatgaggtcgaacagcagaatgagtctcagctttttaatgggccagcacagctgcggttttggatgccttcccactttatttctgcctgcagctctccaccgctttattcatccacatctcagctaggagcaccactcgcggggccccctctccatgtcggcagagctgaggggcaagtacatttggccatgggaagcaggctggtgactgctttgaaatgaaaaccagatcaaacgaaaattgtaggatggtgtccttatgatgcctgcacctcccctcctccccaaatctctaggatgcttttacagagtctttgctgctacgttgtataaagattttaataaaaatttcttgtccctggagaaacaggcatgtctttgttgtcagagagctagagggaaatgagcaatgcagcccagctggagtaccagcattaatcccatgattcgtagcccgtattttcagacagatcaattacttatggctgtaaccaatctctcatcgttttcttgctgtgcagggctccatttccagactcggcagctgacataaccttccaacttgataggacttcagctgcaaatctcttcaggtctgctgcctccattcatcgtggttatacaaatgagttgttaaataaaaatcaaaagtaaaaaattatgggtggtaatctctgcctggctcagtaatacccatgggcctaggcaacattttcagttggatttttaaaaaacaagatggatgattcacttgtctgacttccttcacttttatggacaggctttgcatgagagaaaagccatctctagagggaagaaattatccacagtggatacatttcttatcaatttataagttgaaagattaacttagaagtggagagaaaggagattatgaggagacacgaaggacatgtacaggtgagctgtgtctaatgcatttcacactgagtgagtcaccccttttcagctgctaggctgcctgggcttaaggccaggagattctgtatcaaaaagaaatgacccttgctaacacagaggtgtcatggaacatgtaagctgtttatagagtatgtcactgtgtgaatgtagaacttgtgtgaaggatctaaacccaataacctttgaagaatttacccagaatttatttagtgttttcaagttataactactccttgtgtgtattgaacccttcacagctatgtcaggccagctaagccttcctggaagaggtacttaggggccagataaagcaaattggagaatctctttgtgatttgactcactttagatgcacagatgctcatctgttaggaaagcatgtattgactctctttgtgcccttttctttcattgtcactccatcatttccatctcttcaatgaatagtcctttgaggactttcccattttccctataataaccaactacgaaaatttgcaggaagcaaaaaggaaaatgtggacatctagagaatataaatggttttatgtttaatctagggggaattatgtatgtatttatatatatttgtgtatgcgccctgcatgcttgttgcattttgctgtatgctttagaaacctttgcctacatggaacccattagtagtgtcctgggacaggtattcatgaactctgttaacaattaaggaagtaagttcctgctgctacaggctgacagccacagtttccccttgggcttgtatggctttggattgattctaaagaagcaaaggaaacatacagaacatacttgtttgatttgaaagttaaaaaccggtctgtgtctgttttcttctcccttttcactctagcccttcttaggcatcccaatgcgagtagtaaaacataaatcatgcaatatcataagatactgctacagctcttgccctgccctggatttgtttttttgtgcatctgaattttattatgatccataaagcagtatggaaatggctcattggtagggttgcatggcagtaccccatcctcagaccctgccaacaattgaaagtctgagaggtaataagaaataaaagggagatgagatttatagttcgtgagttcaagttgcttttttttctccgtggaatgttgcctgtcttattaggagttctttagtgaaacaaaatgcagtggtagcttagagaaattatggatactttccaggggtgtgggagaagcttaggagtctgtaagccttctcccctggttgcagttaggaagccagttgacagtataataggcttttggaagtgggtgcaatggtttgtgtgttctgtttgatgttgcaaataccaagcccgcagggagatctgcaaagaggatattctgttcttaaagaaaggaaaagattaacctgaaacgtgaactgaaaaactcctgaattctagaggacttaggtgcagccaaggaaggatctcatttacttacgtggaaacatcatttggcaagctgcctgctccagacaagcagatattttttaatgatttcaattaatgaaaagcaatcactaataaacttgagaggattggatcacatattaagagtgtgtgtgtgtgtgtgcgtgcgtgcgctcacgtgtgcgtgtgcagtatttgcatggttaaggtttggaaatacgtgcattctcatacacgcatagaagtcttacaactacgtgtactacttggagcctgcctgatggtccttttcttcacattcagaatcatgcttctgacccattaggagaggctaactcttgttattttggagacattttcaggagtggtaatgaatgggcattaaggcacttctgttattcatgaatatgtacattcacttaacatatttattgagtacctactgtatgccaggtattatgctaggtgctgaggttatagcagtaaaaaaataaaaagatacatagtctctgctctactttagtttataggttattggagagacagacaagaacaaataataatacagttatacacttaaaatttttatattgcctttgtattcaataaaaatttgttgagggcttctagatgctgtagactctgtgatagagtctaaagaaaagcgtcttgcctaatttctgttaaaatcagtggtttgccatttacgaggaataaactggccatgtttagttatggtattgaagaaagggtttgatccatacaggaactatacttcacctctatgtattaatttagtacacagttttaagaacagcaaggtagcattcaagaagagcattctgttatatacttgtatataaaccctattgtatctactaaggatattgttataacttcctcttcactggtatctcctcaactctgagttcaagacctacccttctctccagctgtgggaaatgggatttgtcaacctctctgagacaaagtttcacatcagcaaaatgggaatagttgtactagttcacacggggttgtaaagagtgaatggaattgtgtatttgaaaacacttcattaaagggatggatatttcaagtacactgatttaatttttacaaataatatgaatgtattagatcatcacatgtaccctgaaactatgcatatcaattatgcatgaataaaaaaattgttgaaaaagccggtcgcagtggctcacgtctgtaatcccagcactttgggaggctgaggtgggtggagcgcctaaggtcaggagttggagaccagcctcgccaacatagtgaaaccccatctctactaaaaatacaaaaaattagctgggcatggtggcgggcgcctgtaatcccagctaactagggaggctgaggtaggagaatcgcttgaacctgggaagtggagtttgtggtgagccgagatcgcgccattgcactccagcctgggcaacaagagtgaaactccatcttaaaaaaaaaaaaaaaaagaaaaaaaaagaaaaagaaaatactgtgtaaaggactatactcatttgagtttgtataattttcattattattacatcagatttacagagagaataaaatttattgaagccaactgtgttgtcttaaacctccgaaaattcagaaggaggataatgctgagttcaagtacgatatagaaatcatcatatcttttctctagcaagtgttccaagagaattagaatataatgccaaaattaaggtagaaattaagttattctagaagtgggatagccagtgtcagcatgcatgcatgatccttgaaaagtgatattgggcagcatttacaccaagctttgctatcttacgttctctttttgcttcttctacctggtgttatttgtgccttccctaaagggctgaaattgaaaagaattagtacgaatgcattttcaatgacaccttggccaagaggttcatgcatttcagctttggacaaggtgctatggttcaaatactcatgaatatgatataagaacagtcattatttaaatgatgaacctttatatgagattacactgggtgttactaatctgcaagttgtattttctgtggggaaaaatcagtatgaatgaatcaagaactcagtgtgcatcctgcagtgcatgttgtatttgcatgaacggagatgtaatctcttcaccttttgaatcattttgtttaaaggccctatatagatcattctgctcttactggtgggtgacattttcttaaggttctctccctagatagactaatttgaaaaaaatgcatccctcttgatgtctgcatgtgcatgtgtgtatgcatatgtataaaatatagaggtgatcacaaagcatactgggccacttagcacttccactaattccacattatcagagattgtttggagagcatatttcattctccctactttgtcacttatttctaacactgagtatatctgtacagttcttaatagtaaatggcataatatcttattctctgtattctatacattgtcaaccccattcctagctgataatcagtagtcaaaaatgggtgaataatttgaatggtacttgtctttaattgtgattcatgtctgaatggcttgctggtaactaggagctaaatttaatgttaatccaaggtcacactctagtccacatactggaagctcagcctcttgacatgcatgcttcatgcaattatcaggctgctcccttgtaggataaagtgcggcagtctagaaagcatggcactcaaatgggaagaactgttggtgagtctgtacagaacagatgaggttgcagatatttgaaagcatttgctaatggaaactctgggtaaggcagcatcttaaataatacgtagaatcagcatgctgtctccaaaacacatttgcagcatttattagctgggtgtgagctaaaggtaagctcccattaaaagaaaaaaaaatcttcgtaatgattagcaggggcccagtataatttaaggtattctttggagtttataaatatggcctcataaaaagcctgaatataagagaactgtgactttaagtcattagaagcccagtggtttgataaaataacaggaaacagacaatttattatgagcagtctcagtagctctggattatctataaaacttttacggccttccccaagtggcaagaagccataaaacttgcctgaatgagggacttgttaatttacttgttaaagcaaattaaaaatttataagtgcttttaggtaaatgagatcttctctcattgctgcccttgcggggctgggagtcctaggaggggagagtggatatgcttagacaccactgcagaacaataaaagctattaaatttttccagtttattacagcagagccatgcagctgttgccatggctagctgtggggtaccggtggttgacagcctggagtctcactcaaagggggaaaaaataaaaagccaaggaaagggatgattttttacttttataattctccaattgttgatgttgtagaccatgtctttttatttttccttgaccttgtaaatccagaagttttaaacttttttcttttctttttttttttttgagacagagttttgctcttgttgcccaggctggagtgcaatgtcacaatctcggctcactgcaacctccgcctcttgggttcaagcaattctcctgcctcagcctcccgagtagctgggattacaagcgtgcgccatcacgcccagctaattttttatttttagtagagatggggtttctccatgttggtcaggctggtctcaaactcccaacctcaggtgatccgcccacctcgacctcccaaagtgctgggattataggcgtgagccactgtgcctggccttatactgttttttcttatccccagaagtgtttctgtttattttgtcatacattgttggtccttgaaaattcctgcccgtcatgattccttttagtcatttagtccatggacaaaggccaggtcttaggctgtttttgttaacctcaacatttcttgaaaaaaacctctttctctctcttttcctttcccatatctagccacaaaactaggagaaggaagaaagggaatctggtacatgttcttgtgtatttaactccaaaaactgttagaatcaatattttttgtggaagccaaagtttataggtaaaggcagattttcttgcactctcccttggatgaaatgtcagcgtaggttaaaattcttggatcttagcatcttccttaacttagggctgttctctacgtgttgaatttcttctgtaataataggtttctgaatggtgactttggctggtgggggtcatttttttggctttaagccctgtgactcaggggattttttttttttttggctcccttaaatacaattcacaatgagcagttttctccctgccctagtgacagtaaggtttctgggacataggaaatagcttattcttccactcagatcagaagttttgattgagctctgtggcatttttaaggcagaaaaagacacgttatgcctcaactacctaccctatttaatgttaaattaaaatgatggttatttttaaagtgtgtttacatttaaaaattcctccagaaaagtcaagttctgcaaacattttcttgtagtatttccagtcactgcacaagaaaggtacattttattagttttaagaacagaaatagtagaaagacataattggtacaagtgtttgttcttctacagtatttactcttcagtttttacatatatatccatacctctgatttgtagtttgtttggaattatgtttagaaaagcatattgttggcaagtaaagcatcacaaaattaagggtagagaacagcagtaaaaaaaaaatgacaaatatgtatttttagactgtattccagttttaggaggtatcagcttttagagattccttaacgttaaaatttgtttcagtaagtaactcttgttgtggtcgctgtcttcagtattccagaaataatgctgtatctcttattcaacttcatgaacctctttactggcttccatattaatgtcatttgcatttagagtgtgtcatcttcatttagaatctcagcaaaaattctggtttataaccatctttgcacaaattatctctgtgctttaggacacttttctgggcctggtcttgcattttttatgaatacaactttaagagtggaacttaaatatgtccccttttattggattatccccatagacctgaccacaaagtctgtggaagtagaaagctataacggttgtaccatttttttttttttaaatactttaagttctagagtacatgtgcacaacatgcaagtttgttacataggtatacctgtgtcatgttggtttgttgcacccatcacctcatcatttacattaggtatttctcctaacgctatccctcccccagccccccaccccacaataggccctggtgtgtgatgttcccctccctgtgtccatgcgttctcattggttgtaccattcttttgttcaagagtatcaagttgaatttcatgtactgaaaaagtagatagatttaaaaacatttaaatttaggtagcaaatgacattgggccaaaggtccattgctaaggagacccaggaaagaatttattacaataggaatatgaggtgtggaacccaaggacagctgtcatgaaggataggtaatcacagtaaagtagtgatgcttcatatacatttgtttttgtttttgtttttttgagacagagtctccttctatcccccaggctggagtgcagtggcatgatctcggctcactgcaacctccgcctcctgggttcaagcgattctcctgcctctgcctcccgagtagctgggactataggcgcacaccaccacacctggctaatttttgtatttttagtagagacggggtttcaccatgttggccaggctggtctcgaactcctgacgccaggtgatctgccagcctcggcctcccaaagtgctgggattacaggcgtgagccacttcgcctggcatatatttggttttaagagttcaagctagaattttagagtagatgttcactcattagtaatattgatatatgttgtataatgattgcttaattgctaattttcttatgctaattgatgtttttctataaaaccaaattcttcagctctttacatttattgaatgctatctggcttatgaattttcataagaactgccaaaaaaaaaaagaaaaaaaggggcaggtcccctccttccttctaaaaagagtggttcatgcctgtaatcccagcattttgggaggctgaggtgggcagatcacttgagatcaggagttaaagaccagcctgaacaaaacagtgaaacaccgtctttactaaaaatacaaaaattagccgggcatggtggtgcatgcttgtaatcccagctacttgggaggctgaggcacaagaattgcttgaacctgggaggcagaggttgcagtgagctgaggttgtgctactgcactccagcctgggtgacagagtgagacctatctcaaaaaacaaaaaacaaaaattaaagaaataaaaataaaaaggtagagagtatgtctataatgactttttaatgtgtcagggagtttttaataggaaaaaaaaatcattccactaaaaatatgtcctctgtctcccaactagaatttcttccccatgtcactgccagccattgctgtgacaatatagtctcttactcttttatcaaatattctccatattattgctgtaagtactggacagatatcataagtaaaatatgtccacctggttgctaagaaaaatcccacatttattttatatattttgtaatagctttacgtattcgttcaaccgtaacattttggtttaaagacttcattaagctttcattgtccaatagcaaagaagtatgaagtagataccccttactttgcagtgtttactttttttttttttttttttttgagacagagtctcgcactttcgcccaggctggagtgcagtggcgtgatctcggctcaccgcaagctctggctcccgggttcacaccattctcctgcctcagcctcccgagtagctgggactacaggcgcctgccaccacgcccagctaattttttgtatttttagtagagacggggtttcaccgtgttagccaggatattcttgatctcctgacctcgtgatctgcttgcctcagcctcccaaagagctgggattacaggtgtgagccaccacacccagcctgcagtgtttactttttatttattttttattttttggtgatttccttttaccattagctaccagctgtcaggtattttcatatagttttggcattatagtttctttggttagatcacacacacacacacacacgtacgtatatgtattgtaggtataagcactggaatttagcagagctttttaaataaatgggctagtctacatgcctttctattcttttccttctaataatcttatactaataagattatagttacaagtcagacagcaatttcatggcacctgtagattttgagtaagaaataaaactaacttcagttgattatagttttttttccatcattaatttaatccaaatttctttaagatggctaaggtaaatgaaattatattctcaattgcttgtctggtctaatatgaccaaaaaaaactgttagagactgctttaattatttgaagtgtttgaagaaatttgagagagtattgtagaatttattcttatattaatgcaattaatatattaagattcaaccacatcaaattatgtattagtcatccagaattgagagacatggttgtaaaaatatcattaaggtgtgtggtatttacttaaaatttattcctttagagataccagaataattatttatatctgtttgctaattgcttactctaaatgtttggtcagtaaatcagaaaaatattagagctatccaaaggaacaaacacactgcaatgtgttataacatgcctccattgcccataaattattaatacaatgttactctggaggggtagcataatgttttggaaataatgcacactccagaataaaaaggcctgaatgtgaattctaggcccatctcttcctttctgtttaatcccaggttaacctgagcctccacttacttaactctaaattagtaataattatatctgcctcacaggttctgagaggaacctgtagctcagtacagcaaatagtaggcactacctcaagggcagtaaatagaatattcagtcagggatccacgttctaggctcagcttaccacccaatccctgggtgtcttggtggagttgttcatctctctatattttagtttctttgtaaaggggatacattaaaatttacttttctcactttaaatatttacgtgaggattaaatcatttatgtacaattattagaaaattgtataacagtaggctgggtgcagtggctcacgcctgtaatcccagaactttgggaggctgaggtgggtagatcacgaggtcaggagttctagaccagcctggccaacatggtgaaacccctatctctactaaagatacaaaaaaaaattagccgggcatggtggcgtgcacctgtaagccaagctagttgggaggctgaggcaggagaatcgcttgaacctgggaggtggaggttgcagtgagccaagatcatgccattgcactccagcctgggcaacagagtgagactccatctcaaaaaaaaaaaataaatgaaaataaaaataaaatagtgtaagagtagacaaatgtgtacaacattattatcacaaaaatgaaagcagcttaatggtaattgatcatcctgtttttaagctactagatcagagaatgtgatgtgcccacttgtcctttactgtccttatgatagttgtctttccatgttggcacaatggtagaagctgctgtccaggctattttgggcaatttgagtcaaaaattagcagttattcaatatatacaccttttttttttttttaccagcagctcaatgagggtttctattatatatcaaggggctaatgtggcataagttgttttttcttttttttttgggaaaaatcctaactagaaaattgggtctgttcttaaattgtaaatgtgtgtacatcaaagccattgtaaggataaatttaagtctgatagtgtacatgtgtacatagtttcagtacacattggcgaaatatcctgctgattgctgattgaaaacagttgttaattctctacttcactaaattcagagtggaaaactttccttaatgaagaacagattgaggagatccaagaccttactgtgtgggaattaatggcagatgcatatactggtagttaaaatgtttcattagatgttaatgtcttgctgtgtttttaattgttcaggaattagcctctagaatattaaaaccatctgtttgttatgatgaaacagaatgcttaaatagttattaatttgtgtttcttgtctttttttgagggataatctgtaaaactttgatctgtttggagtttagggaatttggaatgtggaagtgaaaaataattttaaagcacaccagtgtcctgaatagctgaagtatgtctttttttttctccttacccactgcatatattttgtgttctttctctcttttttcttaaaggagggtgagttgactttttttattccatggtgtgatgagaatctattaaacagagctggtttaatagttgatttaaactttaagattatcttcgtgcatgtggattattttacattcaacatcaaaacagaatttagacatttagaggaatgaaggacagcttacgtttttaactctaaggatgtacttttactactatattccactagctctgcataactgttgatggctatacagactactgctggcatgggttctagtcttgactctgctgtttcatgccttgtgatctggcacagattagtctttctcagctttagtttatttgtctgtaaattgggaagtacaatttaatttatagcattttttttaatgcttagaagtaatacatgaagactgcatatttgtcttttgttttgtttttatagagatggggtcttactctgtcacccaggctggagtgcagtggccaatcatagctcactgcagcctcgaactcctgggctcgggcaatcctcgtgcctcagtctcctgagtaactgggactacaggcatatgccacaatgcctggcagtatttaaattttttttagtgattgagtcttgctatgtttcccacgctgatcttgaacttgtccctcaagtgatcttccagcttcagcgtcccaaagtgctgagattacaggcataagcacatacccggacccacatttgttttatgtagtgggcatattaattgctgtctttcttgattacatggagccagtgagatactttggatgccactgagaatatacattagcactgtagctgcaagagccagaaataaactcttcatttactggcctctcccctgtgttgatagccaaacagtggtgcatttaagttcttacccccaaaatgaaaatctcagctaatgtcatcttggctctagttaattgccaggtgtgtagagctacagtggagagaacaaatctacctgtgcatgagatcccaatttatgtctctgggggccctagtatttgtctttttgtctgtgagtttggctaagaaaaattttcagcttctcataaatttatattaatcagtaaaatcatgccaagaattagaagttttatatagttgaatctttctgcatcttggagaaattccatgtgtttagaccaaaaatgaatgatagttgggaaattcatggttctctttacgtttcctttacctcacttgcccctcaatcaaaactgaattatctcatttcctaagtctgttttgcgcaggttaaaaatgggagggtctttatacatcttctggagctgagtgaaagtcacttgctacatgaaagtgaagtttgttgtaaaccttgagtctctaattcaggttcctcagaggccaggctcataatgtgaataagtgacacaggacaatgtagggtgtggggtcgtccttgtcatggtgctccattgaccctttataactatagcattagtgcagttagtgctcttgtttccaggggcacacccccttgctaactggactatgctggcactggacgtcatatgaatgattcattcagtattaaaagaagaatcaggccaggtgtggtggtgcaagcctgtaatcccagcattttgggaggcccaggtggaaggatcatttgagcccaggaattcgagaccagccttggtaacgtggcaaaatcttgtctctcaaaaaaatgtagaaattagccgggcatggtagtatacacttgtagtcccagctactggggagactgaggtgggaggatcactttagcccaggagttcaaggctgcagtggggtgtgatcgtaccactgcactccaggctgagcaataaagtaagaccctgtcttataccatctccatagaaagcaccatcttaaaaatttacccaggatttcttttataaaggttgttgttgttatttttattattaagaaatcagtgattgttagtacacattttaaaagctttctgtcattgcaggatatgtcagaaaaaagtttttgctgtagtgatctttaacaacataagaaaaggagtggttttttttttatacttgttaggtaaaataaataggatttttaaatgcttcatattatccaaattacataaaagtggcaatctcgtcagtaagtatgtataatactaagagagctattaacttttcttggtagtggtttttgaccttttgctgaacaagtactttaaaaattttcaaatgccaggatgaagacttcttaaactaactgtaattatgcaactttttctttataatccgatacctcactatctaaaatatctgaaattacatatgatcactgtttcaagaacaaaatcagtgatagcacattttgaagactatggaatctaaaggctgattttgtatgctcactagcacacatgatacttttcatgttaccattcagcttttgagctctccttactggccaatcccagatgagaagctttttttttttttttttttttttctttgagactgagtctagctctttcgccaggctggagttcagtagcgtgatctcggttcactgcaacctccgtctcccaggttcaggcaattctcctgcctcagcctcccgagtagctgggattacaggcacgccccaccatgcccagctaatttttgtatttttagtagagatggggtttcaccttattggccaggatggtctcaatctcctgacctcgtgatccgcccatctcggcctcccaaagtgctgggattacaggcgtgagccaccatgcctggcctcacaattaagtttataacagggatatgttatgaacttaatatgcttggctattaatatttggatatgttctcaaatattctagaacataggccagatgtggtggctcatgcctgtaatcccagcactttgggaggccgaggcaggcagatcacgaggtcaggagatagagaccatcctggccaacaaggtgaaaccccgtctctactaaaaatacaaaaattcgctgggcatggtgggcgtgcctgtaatcccagctaccccggaggctgaggcaggagaatggcgtgaacccagtaggcggagcttgcagtgagctgagattatgccactgcactccagcctgggcgacagagcgagactctgtctcaaaaaaaaaaaaaaagtttaactctagtgtgtggtataccagttcagttctgtcctcatggaagtaatatggcctttcatgggatagtcactaatgataagtttagtgacatatagtttattaagatagctatggacagtgtaggggcttagtcttgatgagattttaatttttggctgcacttgaaatgaactgggatcaaaatagtggcaagttggatagagatttgctgtcagaattaatattcaagaagttctgatagcttgcaaccaaagtattttatattataacaaattctagatgctcataattattcaattaaaatggataaacagtaaatatatgggttagagaagaacaatgctttttccagaaacaaagttttaaaaacttgttaatatggcaattttaaaacatacatgaaagtaaagataacggtataatgaacccaacatcatctaacttcaacaattaagacatggctaatcttacttcctctatatccctacacttcccccttcccaataggtattgctccccctatcccctggattattttataaaataaaactcagactcaagttatctcacccattaatgttttactgtgtatctgtaaaggactctgcttttttactgtaactacaacaaaatgtaaataataattccaggccgggagctgtggctcatgcctgtaatcacagcactttgggaggctgaggtgggtggatcacttgaggtcaggagttccagaccagcctggccaacatggcaaaaaaaaaaaaaaaaaaaaaaaaaaaaaaatagccgaggatggtactcaggaggctgaggcatgaaaatcacttgaacctgcctcggcttccgaaagtgctgggattgtgagccaccatgcccggcccaaattgttccatttttggtcagtgggaaccccttcagtttggctcccaagcccctttgtcagggtcttgctaggatgacaaggtgttccagactcatcttacatatttcctttctcagaccttcagttggacacttttagttttttcgtgttagaatgggaaaaacaaaagatagaagacattttctatttgagagtggtggctattttaatgaatgacaggccatttaaaaagttattgaaacatgttttttaaaaacagaaaatcataaaaagtaagttttgtgtgtttattttttatattcatccttgaaaaccaaataatattgtctctaaattactttttaataatcaaaatcttattttaagaaagctgaaaactgtactaaagcaatcaaatattccttcaacacattattttttacattgtgtatgtgtattgtgtgtgaatttctgagcctatttgaaaacagatttatcatttagtccatggttatactcaaggaatgccaaatgcaatctgttcattctggcctttctctttaattcttgtacatcttttgtacatttctattcttgtacatctttttttctctattgtttagactttttggtcaaaaatttaaaaattttctgattggcagttggttgaaagagataatttattatctaaagatctggaatcaatagacaggaatgtctggcttactacgataaagggttatggagaccaacgttttatcatgcagataaagcctccaggtatcaggcttcagagagaataaattgtaaatgtttctcatcagacttagagagtctgctctattagtaattctgaaagggaggaggttattatggggcatgtccggtccctgtcccccatcatggcttgaatccgtccctcaggttagccttagaatgcccttgctgagaggaagagtccattcagatggtgagggggccttagaattacattttacagcataattaaacctaggaatagtatccaagttgtagatagatatgtgagttatacatcaaacactgccttttacacttccattttcttgccttcacattattaaattatgaagaaatagtatcgtaatatcctcttggcctaatcatagagagtagagttaacaattctcttgataagcagtagaacattgttaagttctgctgtctggattgagcgtgtctatagtaatgatgtcaaagtcggtcagttcgctcttgattttcttaactgcttcttatttatgtttgagactatatagttagattgatcttggcttattttcctttttaaattttattagggctgggcgcagtggctcacgccagtaatcccaacactttgggaggccgatgtggctggataatctgagatcaggagtttgagaccagcctggccaacatggtgaaaccctgtctttactaaaaatacagaaatcagccaggcgtggtggtgggcacctgtaatctcagctactcgggaggccaaggcaggagaatcgcttgaacccgggaggcagaggttgcagtgagccgagatcgcgccattggactccagcttgggcaccaagagtgaaactccatctcaaaaaataaataaataaacaaataaataaataaattattaacttagtttttctactgctatgaagtccactgaacccctttaaataatgtgcatgtttggcagctggaagcacttcagtcgtttttattttctaagctaatagcacaattttaagtcatttcctgtctaataatgcctaaagtgtttattgggatcatcattaacacaggtaaataactttccaaagtccaaacatatccaaaaatcctgtttcttactttgcattaatgaaacttgtctaattgcattagagtgactttacgatacatgaatttcaagggaatacctaactttctttctttctttttttttttttttttttttttttgagagtctcgctctgtcgccccagtcgcccaggctggagcgcagtggcgcgatctcagctcactgcaagctccgcctcccgggttcaggccattctcctgcctcagccccacctcgagtagctgggactacaggtgcccaccaccatgcccagcaattttttttttttgtatttttagtagagacggggtttcaccgtgttagccaggatggtcttgatctcctgacctcatgatccgcccgcctcggcctcccaaagtactgggattataggcatgagccaccgcgcccagccctaactttcttatttaaaatccaccatggtaagcagagttccaagatgaccctaaaagtacttgtcccttatttactcccatgttttcttatatagcacagttgactttatgaaaggaagttcttctgtaagcctgacctaatcaagtgaactattaacaggatgctgactttctggagtaagaaattaaactgatgggatctttcctttctataataaactgcttttttagaatataagttagataccataaaattcactcattgtaagggtacaagctaattaattttagtaaacttaaagagttatgcaatcatcaccatacaacattgccatcacctcagaaatttcccttgtgaccatttgcaaattggtagaatcttaaattcttgtgaaaaatcctgttagaacttggtgggctatactttaatatattattaaatttaatttgctgtgtttcttcagatttttgcagctttttaaattaggaaggtcatcctgtagtttcattttttgttttgtcaccagattttggcacaagttagctttccatattttttcatgttctggaacaaatgttgttaaatcttcttaaaaactttagactgcttaattatggttttgaaagtatcactgtagaatgtttacttctgtatttagaaatttatctgttttttattttgcttgccatctcttttatacttaaatgtgttagaggtgtatctcatatctttatgggttccccccagattatactatagtttactaactgtacaatattttaatttctaatgatgttcttctcatttttagaattctcttcctctgattttacctatacttgcctttttgtcttatttcttttttgttcatttcaatctttataattaggccatttatttctattctttcacatttaatagaaaatacattaagtccatgagttaacttctagcaaagattttacaacataagttttaaaatttatatatttataattttcattttcttaatttttaaatgttgtatgtgtgattttgtcttttacccagttgttaattgtagacagactttaaaaaaattctttaggtgatatggatattcaacataaaatactgttattactttttatcatagagaagtctgttcatataatttttacattttgaaatttattcttatattctttgttaccctggtacattttcagttggtggtaatgtcccatagatcctctaggtgtgtctctttaagttacccaatttactgtatattaactaagtcaaacttcattttttaacctctgcgtcctttttcattgttttgttttcttgttccttgattagtagaatgctaaaggctcccaccttcttttgctttcttttattatttagaatattttttactttgtatagttttgtataatggtttataacttagaagggtataaaaggtaaagactgtacctttcatcactataaaatgactttgacaggtgatttttttacctatttatttctaaccttttgtctttttccctctctctttttttaaatttaggagttctttgtaactaataaataatgggacatcaatctgttgattgatctgtatatctatccatctctctgtcttacccaacacaaaccagatttttatttttaaatgggagcttaatgtatttatattattatcagaacactttgttttacactttgctttcttgccacttttcttattttctttccctttctctattatgatttgagtcattttatatttggtaattatttggaaggcaaatatttttaacgtttaaattttactaatggttagcttcaagattatcaaattgttatttaaaacactttctctagctgttgtagatgataacaaaagaacctttgattctgtgatcccagaaaaattccttgccctgcccttgtgtccaaaatttgttaaaataattttagcttttattcacaacttggcactgtacacttaaagatacaatatagttttcttttttaaaaaatagtttttctatccaactttataattttacttattgtagttattttgtgtttgcttatttcgattcatcagcatttttcattaagttttttagtttggttcatgtacctgtcatctgaaatacgctttaaaacttaaagaataaaatagtacaaattctatccaatccatgatactttcccaatttggggacaattttatcttgaaaaataaaaatagtatttttcaagattaaatacttggctgctttgatggtagtgtagtctatgggtatattaaaattttcttgaaaaaggagaatcttttgagcttactgaaacattccccaaattttgcatagagttcatttacattcctacagaaaaactcagcagtctgaaaaaggatatgtgctactttgaggaatcaaatttgtggaaggagattccatttggacagtcttctacattgcctgcataattcgcatcattcctctcaaattccaggcatagatatattctccacataatttatccttctgtaaattttgtttgatggattaatgacacctactgggcaagtagcatctttttgaaactctccatatccaagctgaaaagaatgggatagcccagctcacaaatgccaagcagatgtgcacagaattgctataccttcatgcagtctagggtgatgggacttcgttacatgttcattagcagtgacataactgtggatcgttattttcctaattagccattaataacagttaacactgtaatgggatcacaatttcagaatttggagcatatattgttgacagtgaaatctaatgaaaaacaaactagcttcttatattttataaaagatgttaatctcattgatagaattactgccactcatgccagataccagctggctttcattttgcatattttgttctcattctggtgcccaaactattgaatatataatactctaatgggaagaagcttctcacaacagagagtgggttatagtaatttttaaataaacaaggtcctgaagtatgtaaaggctgatggtaagaaatcttactgtatcagttataggaaaagctttcttgtaatagctgccatggatgctcatacaaatcaatgcaagcagatcaatttttcttagctctttaaatgtttaagccagcatctggcctttgtgatgtttcttggttgtaggtaatagctgggaatttcaggtgaaggattacaacttctgagttagttatgctaccccaaacgatccattggatgtggctaaaatgctagtttgaaactatattcagctgggcgtggtgactcacacctgtaatcccagcactttgggaggccgaggtgggcagatcacctgaggttgggggtttgaaaccaacctgaccaacatggagaaaccccatctgtactaaaaatacaaaatcagctgggcgtggtggcacatgcctgtcatgcctgtaatcccagctactcaggaggctgaggcaggagaatcgcttgaaccggggaggcggaggttgcggtgagcagagatggcaccattgcactccagcctgggcaacaagagcaaaactccgtctcagaaaaaaaaaaaagaaagaaaatatattcatgggattggaaatgaatacttctttgcctgaaatcttgtggtttagctttagtacttactgtagtcagttcatttctttgaaatattgagctgtctgacagcttaaaatcctaagtttcctttaaacttgagcctggctttggaggagaagggggtggtgtaggggtggattttatgtaaggctctctgaagagaattcactgaagtgttttttgctggcagggcactgggaaggctagcaggctgcttcctctcagtccttcttgggttttgcccttagcctagatcaacatttagtcagataatttacgtcaggtccactgaagtctgtttttgtgccttggtaaagtcatcattttccttccgtgaagaagcatggaaaaggcccaggtgcaatgtccaggttttgttaagccagttggatattaggaaaagccttgacactctttatagtcttagttcccagctggatatgtatctctcatctaagttgggaactgagtttttattattagttttttaaatagagacggggtcttgttatgttttctgggctggtctcgaactcctgggctcaggtgatccccccgcttcagcctcccacagtgctgggattataggcatgagccactgtgctcagccataaaggtgttgatcaaatatcacctaacaagattattttctttgtgaacgtactatagtcaggtaccacatacaaatttagaacatattatgtggagagtactaatatgctgcagaatcattacttcatgtcaaatgtaaacatctaactgtgcactgagaattagttttttcatccataccttggaggtagttctacctgcccttacttaactcagaatcagtgggataagagtttgatactgcttatgaattggagggcccatgccacatgcaaactttattatcagtataactatgttataacaataggctttttgagcttgaaaaatgtgtcataatttaaaaaataaataatagaaagaaagagctcttcaaagaccataacagaggaggtaagatctgagctttaaaaaacatcttgacatcagaagcacagagaaggtaagggtgaacattccagagggaatatggtgtgaaaaaaatgcagagcaggaatggacaagaaacgttcagggaatggagacaaggcgatgttcattgtagattaaatctctcctttattatcaatataaaagtgaaaaatcgaagagaatgacaatattctgagcttttattccatagtaataacaaaagcctcatacaacttgcatctgaattaacttagaatgaggagctttagcgttgactgaggagaaaactaagtacttaagagctcaggaaggatacaaagtaaaattagcatcaattttctgggctcctttgcagaaggcttcccggagaaagggattttagaagaaagtgataaaggtgaatttctggaaaggatgatagcaaaaaagaatgccttgttttggagacttggggaaagctgactctgtgaatggtataaccaaaagtgaggtctgaactgtagtctttaaagactacaaggaatgttgattcagcctcactctattcatcttggtttcatcttcccctaggcaccatagccacttgaaatcctgcaggcaaaaatttcctacttattgcctcttctattctttgaagtttcctcctgtctagaaaaatggagcttatgtttagtttgagattttccacgttttcattcatgcacccagctctaatgtttcttattgtctccccaaaggaactctgtttcaaatgaaactgctgatcatttcccagcatgttgctttttctgtctttgctttctgcttttctcctcaatggagtatctttcactgtcctctcagccatatgagtttaatctacttttaaaatccaaggcttcagaaatcacttctctgaacctccctggctactttttggtttcattgaacatgtatttccttgtggtgttgtatttgcttatcttttactgcctttttcttgttatattggaaacattgtcaaggggctgtgacttgtaaccagtactacattgcttggtgtttctgaaaatgtgtttggtgatgatattgtagactagtactccatatatttatgacttagtcttatgtagactgatggttttcaattttatgtatttgttcatttttaatggaaaaccagagcttgttaaatgtgtggaaaccactagaacgtaaacttcatgagatgacttttgttttttttttttgtttttttttgtttttttttgtttttttttttggtgtagtaccatatcttcagcacttagttctagcccatatgtggcacttaatacattatttgttgaataagtgctgatttaatttacttaatctgtaggtcttcattggttcttttaaatatgtagtaagaaacctccaggatgttatctcaattaacaagatcattaggtgccatcccagtgtttgaaggataacatcacagcatctcatcattttttcctaggagaagaaaactttattttattttgctctgatttgtttctttttttgagacaagacagaagaaaaaaggtaagaaatcatagttggtgtaatctcactttagtttattcaacatttttggtcttttcattattgaaaaaaaattgcagtggaacagaagaaaaaatttgatggaaagactgctttctaatttatggaccttgaggtttggctttttaggtgtttatttaaggcttgcccactctgttctctacattgacatttcatggtgaatattttgcttattctaccctctgtattttttctatggcagcttgcctggcagtattcagaaactgagaagaatattaaagatcagaaccttaaattgttcactcttttttttttttttgtgagacggagtcttaacgctgtcgcccagtctggagtgcactggtgcaatctcagctcgctgcaacctccgcctcccaggttcaagcgattctcctgcctcagcctcctgagtagctgggattacaggcacatgccaccatgcccagctaatttttgcatttttagtagagacggggtttccacctcgttggtcaggctggtctcaaactcctaacctcgtgatcctcctacctctgcctccgaaagtgctgggattacaggcgtgagccaccgtgcctggctgttcactcttgacaaggatcaaaaacaggaactaagaagcagaccactaactttttccttttttctcttttcttttgcctttagctcaagccaggacagaacagctgcagggacagtgacagtgaaagtgccagtggagaatccaagggcttccaccggagcagctctcgggaaaggctcagtgatgtaagtttaagtaaaaaaaaaaaaaaaaaaaaaattaacgaaaaccactaggccacacacacaccattggttcaagtctgaattacataactttccctcatctttagaactttttgtctacccaagcattgcggttcacattatctttgtatacttatttgagcattgtagttatggtgtcattctaaaatgtcgtttgagcaaaaatgtattttgacaaatcattaggtaggaggaactatttgttaccttagaaacaacaaggccgggcacggtggctcacgcctgtaatcccagcactttgggaggctaaagcaggtggatcacctgaggttggaagtttgagaccagcctgaccagcatggagaaaccctatctctactaaaaatacaaaattagctgggcgtggcagtgcatgcctgtaatcccagctactcgggaagctgagacagaagaatctctgaacccagaaggcagaggttgtggtgagccgatattgtgccactgtactcagcctgggtgacagagcaagaccccatctcaaaataaataaataaattcccgttggatttctggaaggaaaaccttgtgagaatgcgtcatacctcttgagatatctgtttgccctctagatgtgattttcattgttctctagtctgcccaccaacagggcaggttccccctctattacttctgagaaccacctacccctctttggactctcttaccttctttactcatatgtcatatatcagcattttttttttttttttttgagatggagtctcactctgtcgccaggctggaatgcagtggcacgatctcggctcactgcaacctctgcctcccaggttcaagctattctcctgcctcatccttctgagtaggtgggactacgggtgcacgccaccatgcccagctaatttttgtgtttttagtagagacagggtttcaccgtgttggccaggattgtcttgatctctttacctcgtgatctgccttcttcggccttccaaagtgctgggattgtaggtgtgagccaccacgcccagccatatatcagcattcttaactcatctgtacctcaagagcaacacttggaaattcttttgtgaaatggatcaagtaaagagattttttttttttttttgagactgagtcttgctctgtcaccagactggagtgcagtggcctgatctcagctcactgcaaccttcgcctcccgagttcaagcgattctcctgcctcagcctcctgagtagcctggattacaggcgcgtgccaccccgcccagctaatttttgtattttcaatagagatggggtttcaccatattggccaggctggtcttgaactcctgacttcgtgatctgccacctcaacctcccaaagtgctgggattagagctgtgagccacctcgcctggcttaatttttgtatttttagtagagatggggtttctccatgttgaccaggatggtctagcattaacagaataagtgagagagtagcaccatgaaaaaaaagagatagcacttcagagtgtctgagtattaagaataaataaaggatatgtaataagaagcaaaatcttttattttctccattttatttttaaaaaacaccatactctaaagcagtgtgctgttcattatagagtgcaagatgattcattgagttccagaaagaaaatactagtactttttttcttaaaaaaagaaattaaactttactagtattcagtttaacgagcggggaataattgatgtctataatttttaaatacgtggatttaaggagtgtatactcaaaacttttttttactgagagatgtctactaacataaacggttggagaccactctagcacactgagcagttctctatgataataccacatccatctctccatcagccaaggtagacaattccgagatacaatcacatttctgcacctctcatgaaagtttgtgaggtttatgatgagatgttgtatgagatactgtattcttacaggaattaaatggaataaagtataattatttttatgttattttaatatattagttatagataataacctccccttcttctgtgatataatatcaaagttatataaataaagagtactaacagtattttactgtgtgtgtgtttctgtgtgtaagaatatgttttattgtgtgtccatgtgtctgattaattttgtgatggagctatacaaccataaaaccatgacaacttttcttatctaagttgttagcaataataattaatgtttaaatagctgtttttctgagatttttgttatacttttaatgtaagatctcattgactctagaaattattccagggttagtaggtcatatttttttcatagtgtagagaaatgaacgccatgttagtttaggggactagagctgccattggatcttttggcttgtttcctctaactcactttctgttagataaaaagaaattgacaaaagacattccatattcatgaatagaaagacagtattattaagatgtcagtactaccctaagctatttatagattcagtgcaatgtctatcataattccaacaatctttttttgcaaaaatggaaaagcagattctcaaatacatatgaaatggcataaggccttaataaccaacacagtctggaaaaagagcaaagttagaggactcacacttaccaacctcaaaactcactgcaaagctacagttaatcaaaacagtatggtgctggcctaatattagacatacagaccaatggagtagaatggagagcccagaagggagcccatacttatatgcctaaatgagttttaacaagagtgccaagacacttcaatggggaaagaattttctctttaacagatggtgttgagagaactggatttctatgtgcaaaagaatgaaattggactcctacatcgcactatgtacaaaaataaactcaaaatgaatcaatgaccaaaatataaatgtgaacaccataaaactcttagaagaaaatatacaggtaaatcttcatgaccttcaatttggcagtggcttattagatatgacaccaaaagcatgtacaatgaaagagaaaataaattggacttcatcaaaattaaaaacttctcacaccaaagagcattatcaagaaagtaaaaagacagcctacaaaatggggaaaagatttgcaaatcatataagtggtgtttactctacagaatgtgtaaagaactacaactcaataataaaaagataacctaaagcaaaaatgggcaaagaatttgagaaatatttctacaaagaagtacaaagaagaggtacttgaaaaatgctgaaaatcattaggtattagagaaatgcaaattaaaactgtaacgagattatcattttatacctagtaggatggttatgcttttaaaaagagaatgaaaaataagaagtgttggcaaggatgtggaaaagttggaatattcatacattactggtgggaatgtaaaatgacgcagccactgtagaaaacagcttggcagtcctcaaaaagctgaaacatataattaccatatgacccagcaatttcacttttaggtatataccccaaagaatggaaaacatgaacttaaacagagacttgtaagccagtgttcactgcagcattatttatggtagtcaaaaagtagaaacaacccatgtgtttctcaacaaatgaattgataaacaaaatgtgacagcttggctgataggcacacaatggaatatactcagccataaaaaagattggcattgtaatatatactacaatatggatgaactttaaaaatatgctaaataaaagcaagacaaagaaggacaaatattgtatgattccacttataagaggtatctagaataggcaaattcatagagacataaagtagaatagaacttaccaggaatttgggggatggagagtgggagggaggaaagctattgcttgttggttacagagtttctttttggggatgataacaatgttttggaaatagatagtcatgacagttgctcaatgttttgaatgtaattaatgccactgaattacacaattaaaaaatgatctgttaaaaaatgtaaaaataattagggctgtaataatgcttattctgctttcacttcattgaaaatatggaaaatagttataacttttaccagccttgtctactaattgtgtcacctgtgccatttctggtcctgtttctattggttgttttttctcttcattatgggtcatattttcctgcttctttgtatgcctggcagtttttcattggatgccagacattataaaatcctgtcagtcttatgtcaagccagtcaatgaaacacttccgattcatattgtttattatattttaaaattatgaaaaaaatttgtgggcatatagtaggcgtattgttcattaattattaaaattcacactttttgcaacattactgaaaaggaaagaaagaaaaatgacccaaaacgtggacatttactgaaatgttttgagatccctagtcacatttccctcactcatgtgcaggtctgaggttgcagagtcctgtgtcaagcactatggcaatctgaaatctgctgagatgaaagctttttttttttttttttttttttccgtgacacggagtttcgctcttgttgctcagcctggagtgcagcagcacaatcttggctcactgcagcctccacctcctgggttcaagcgattctcctgcctcagcctcctgagtagctgggattacaggcgcttgccaccacgcccagctaatttttcatatttttagtagagatgggcttcaccatgttggccaggctggtctcaaactcctgacctcaggtgatccatccaccttggccttccaaagcgctgggattacaggcgtgagccaccatgttcggccgagatgaaagcttttaacaaaccaacccacagaatggatcttttggataccaaagcaacacctacctgcacaatattttagagaataaagatgccccattttttcttgaaagagaattaacaattaatttatttttttacttttattttagttttgggggtacatgtgaaggtttgtaatataggtaaactcatgtcacagaggtttgttgtgacatgagtttcatcacccagtagtacccaatagttattatttcatcacccagaattatttcatcacccagtagtacccaatagttatcttttctactcctctccctcttaccacctttcaccctcaagcagaccctagtgtctgttgtttccctctctgtgttcataagttcttattatttagctcccacttataagtaaaaacatgcagtatttggttttctgttcctacattagtttgctgaagatagtagcctccagcactatctatgttcctgcaaaagacatgatcttgttgatttttatggcaatgtagtatttcgtggtttacatataccaaattttctttatccaatctgtcattgatgggcatttaggtgtagcccgtgtatttgctattgtgagtagtgctgcagtgaacatttgcatgcatgtgttgttatggtagaatgatttatattcttctgggtttatatccagtaatgggattgctgggtcaaatggtagttatgcttttagcttttgaggaatcatcatattgctttccagaatagttgaactaatgtacactcccaccgatagtttataattgttcccttttctctgccaccttgccagcatctgttgttttttgacattttaatattaataatagccatttgactggtgagatgatatctcattgtggtttttgatttgcatttctctgatgatcagtgatattgagctttttttgtataggcttgttggctgcatatatgtcttcttttgaaaagtatctcttcatgttctttgcccactttttaatggagttgtttggttttgtcttgtaaatttgtttagctccttatagatgctcgatattagacctttgtcagatgcatagtttgcaaatatttttctcccattctgtaggttgcctgtttactctgttgatagtttcttttgctgtgcagaagtgcttaagtttaattagatcccagttgtccattgttccctttgttgtgattgcttttgatgactttgtcatgaaatctttgccctttcctatgtgcagcatagtactgcctaggttgtcttccagggtttttatagttctgggttttacacttgtctttaatccatcttgagttggtttttgtatatggtgtaaggaaggggtccagcttcaatctttttttttttttcttttctgagatggtgtctcgctccgtcaccaggttggaatgcagtggcatgatcttggctcactgcaacctccgactccctggttcaagtgattcttctgcctcagtcccccgagtagctgggattacaggcatgtgccaccatgcccagctaattttcgtatttttagtagagacgatgttttaccatgttggccaggatggtctcaaactcctgacctcgtgatccgcccgccttggcctcccaaagtgctaggattgcaggcgtgagccaccgcgcccagcccagcttcagtcttctttaatgcctatcagagagtgaaaaggtagagtcaaagatgactactggtttttgtttttgttttttctttaaaaattccatattagttcttattatgcttattcttctttcacttcattgaacatatggaaaatagttattacagcttttactgtccttgtgtactaattttgtcacctgtgccatttctggacctgtttctattggttgttttttctcctcactatgggtcatattttcctgcttctttgtatgcctggcaattttttattgaatgccagacattataaaattttccttgttgggtactgggtatttctggtttctataaacattactcattttgggatacaattttgttatttggagatgtgtgtgtgtgtgtgtgtgtgtgtgtgtgtgtgtgtgtgtttttaatgtttgcttttgtactttcttggacaagaccagaacaacctttagtctaaagataatttttcccccattctgactgagtactttgcctaatgcctaacgtcttacaaggtttttccactgtagattgtgggaaaacaaactattccctgccttgtgtgggctttgtaagttcttcctcctccttcccagtggtggttttcctcgccttgggtattttctctcacagatgtgctgactagtcatcaggtagaaactagaggggaaccttctgcagctttcatgattctcgctttctgtgatgctgtctcctccttatcctctgccttggagttccagctgtctttgcctccccttattctcaactgtgtcttcaagactcagggattccacctgggtcacctcctacccggcaatcatgtggcatgaaaactctccaggcagtaaggtgggaaaattttaagggtcaccctacttttttctcttctctcaaatattattgtcctttactctgtcttacccaatttctaaaaactcctgtttcataccttttgtccagttttttagttgcttgaggtgggagaatacattcagtccctattagtccatcatgcccctgactcgtttttcagctaagatgaaaatttctgtcagcctttcacccattttagtgatatttttaggagctttggcagttgagacttactctcaagtgaggctaatcaaaatagtatattattctagctttgtttttttgaattggttaggccaaaagaataagaataaagaattccagtgtagctgtataatttgactcatgcgtaaagcttaaaaacaccaaatatgtggccaggcatggtggctcacgcctgcaatcccagcacttttggaggccgaggcaggcagatcacttgaggtcaggagttggagatcagcctggccaacatggtgaaaccccgtctctactaaaactacaaataaattagctggacgtggtggagcacaggtactcgggaggctgaggcaggagaatagcttgaacttgggaggcagaggttgcagtgagccgagattgtgccactgcactccagcctgggtgacagagtgagactctgtcttaaaaaaaagaagaaaaacccaaatatgctttgcttttctaaattatatattcccagaccatgttgcctggggggaataattggccacaaggactttcagattgtccacatcaaggagacatagtaacttgtttagattagtcactagggaagagttaaggggaataattgaatatatagttaataaatgtttatgatgagttattcacagggaaaatattgcttccaacttaaacagaattttgtaactgaggaaatttgtcaaaagttaggagcaaaacttacttaaaaacttttaataaacaagcctcaaattatgaaatgttaatgggcatttattataaacaggccaagatttaatagaagttctgctatttattgtgtgtgaccttaggcaaagaatgtgacctttcttccccgccaagatggagtcttgctgtgtcgcccaggctggagtggaatggagtggagtgcaatggtgcgatctcggctcactgcaacctccacctcctgggttcaagcaattctcctgcctcagcctcccaagtagctgagattacaggcatacaccaccacgcctggctaatttttgaatttttagtagagatggggttttaccatgttggccaggctgctctcgaactcctgacctcaggcaatccaccctcctcggacttccaaagtgctggattacaggcataagacactgcgcctggccttgttcgcactttcaaatcttcctacctttgcttattctttttatttatttaaaatgaattgcagtggcatgatcacagctcactgcaaccttgacctcctgggttcaaacttttcttgtgccccggcctcctgagtagctgggattatacacaagtgctaccatgcttggctaatttttgtatttttagtagaaatggggtttcgccatgttggccaggctggtctcgagctcctggcctcaggtaatccaccctcctcagccccctcccaaagccctgggattatacacatgagcctccacgcttggcctattttatttctgttcttttttctttctttgtttttcttttccttatgtcagcttcaacctcacttctaccaaacacttcccaacacactgtggaagtaaacttctttaatgctttatttaatgactatatgaatatgactcttttcacctttctctctgaaagaattttgggttgggttgttagttatgagaagacagaaaaatatttaacacctttcaagggttcagatcgttcaaggaattgaaacatctcagaaaataatgaaaatggatcaaagtcttatgagtctaatgctacacagttgtctactcttattattctggtagctatttacagttgagacattttttctgcttccttttgagataccccttctcctacttcaaatcttccctggtctttgggtttttattgatttgtctatcccacagtgccactgttcatccacccatgccagcatctgtcctattctttctttcttcctcccttccttctctccctccctccctccctctcttgaaatctttattgaggttttattccatgccaggttgtttgaccagctactgttaaggaggaaacagacttgagccactaccatgaatgagcttcccacattgttataattagattaggaaatctaatctcgacctgacaaggattcttggtgttttattcctctctttttaaaaaaatctgtgccacattttccttttccttaacagtttgcttatgcctttttccattcctgtcccatacatttatgaattctcctggatatgtcagtatttcagttgccaagaaatgtcaatcaaatttcttttattcatcaggtatagtctgggcatttgaggttgagtggagaacaagatgaaacctctgccctcatgaagtttccattctagtgggagagacaaatctattaagaaatagctacaattttttctaatagaatgttttctgacataaacaatatgaagggcgggagtttgttgctactttaactagtgtgattagataaggcctttctgtgtaggtgacattaaaactgaggcctaagtaaagaaaagaaggtagacaggtgaaggtctatgggaagaacattctgggcaacaggaacaacaagcttagaggccctatcagaagcatgttgtgttcgagggaaagaaaaatggcttgtgtggctacagtagagtgaagtagcacagtggctgaacacgtaacttctagcccatgctaaggaggctgggtgttgtattaatttcctgggctgctttaatgaatgaccacaaactgtatggctggaaacaacagaaatctattatctcacagttctggaggctagaaatttaacatcagtgtgtcttcagggctatgtaccctctgcaggctctagggaagaatcctttttttctcctggcctctggtgcctcccagtgatccttggtgttcctggcttatagatgcatcattccagtctcttctttagttttcacatggtttctacagcagccattggatttacagcccatcctaaatctgtatgaccttaattaggtacatctaaaaagaccgtatatccaaattatgtcattgtattagacttctccacagaaacagaaccacagcagaagataacagaaccagcagaacatgatttattatgagaaattggctcagttttggaggctgacaagtcccaagatctacaatcagcaagctagagacccaagagaacctatagtataactctagtctcaaggctggcaggtttgaaactcttgaagagctgatgtttttattgtgtctgaaagcacaataaagaactgatgtcccaggtcaaagccaggcaaaaggaattctctcttctctgggagagagtcagccttttgttcttttcagaccttcaactgattggataagtctcacccattttagggaggacaatccagtttactcagcatatcaatataaatgttcaactcatctaaaaacatcatcacagaaacacccagaatcatgtttgaccaaatatctgggcaccccgtggcccagtgaagttgcaacataaaattgaccaccacaatcacactctggggttcctggtagacataaacagggggacattgctcaatccatgacaggttattatcttaaaagccactggactatgttaaaaggattggagttgtagttcttactttaaaatgtttattttgcctttgatatgaggaactgtccatgaagacaagagcaagaatgaaatcagaggtagaagccagaaggctgagatgagagttggtgacaacctgacgtgggcataacagaaggttgaataattggtgttggaagtgacgtagcatttttcccacctgatgcttttatcaagttgttgctccatttttacttgatttcttccaacaactatatgcttatttctcaatcaaatatatatatatatattgtgtgtgtgtgtgtgtgtgtgtgtgtgtttggtcggctattagtaatcttatctccaaggtacgtttctttggattaagatttcaggtttttaaaacactactggaagatctgtgaatgagcttgttttgtgacctttgcaagaaatttacttgttcatgtgattcctggcatggtccttctcctttttactcccaagagagaaaagcataacatgaaggtgggtagccaggaatgttgaacacaattagcgatttggaagaatttaaaaatattcaatttaaattagccctagggtcagaacacacattctcacctaggggtggagtacacatgtgtcctgtctgtactcagggagctgtaacagtagccatggcctctctgtgtggatttataatgaatggagcacatctattttagatggataatcaattttgaaatcccttattgtaagtatgctgttaaaacagaaatgttaacttcatgagtttaatgagtagcttcgatgatagcttagtgaagagatggaaggaaaggcaagtggggggaaatgagaaaaggagaacaagtgtttaatgaatatctacttgcagacttgaatgtcagcagcaacattctccctcctggaaaatgtctttcaactgtgcatcccattatgttcctgcagcccgtggtagcatgaagattgagacaaagagagtgtttctaagaaagctctcctttacaatataatgagatggaggtgggtagtttgcagagattgctggagcagtggtcaaatatgaaaaaaaaaaatccagcagaatgaaaagaccatgttaaccaggagatggcttataatgagcccagaaattgcatatcagatagccagctggctagcatttcctcatatccctgtgttctcatgcaaactgctaaaatgttctcctactctattttctcagcctcttaatagttctcatttctacctactgcattgaaaatatgaatgaaatggcaactctaccacttgaagaaataagaatgaagcccttttcagcaaaagtatttgcctaaacatggatggatattatttcaaatgcttttgaaaccaaggaaacttctgtttctttccttaaaaaaacatcttaactttcaagtctcagtttgactcacagccttttcagtattctgtggcctcttttgctatatagtttggacagactttgcttgaagtctccaagcaaaaaaatggaagtcctcccttcttattggaaattgataggggaggcttggcacggcgcctcatgcctgtaatcccaacacttgggaagccgacacaagaggatcacttgaagccaggagtttgagaccagcctgggcaacatagtgagatgctatctctaggaaaaaaaaaatagctgggcacagtatcgcatgcctgtagtccagctactcaggaggctgaggcaggaggatcacttgagcccaggagcttgaggttgcagtgagtcatgatcttgatcattaaggaagagtcttgtgaaattgttcaatagttagggtattatcacctgtctactttcatggttctttaccttttggtgactgtctcttctttggtgactgtgtcttctaaaatgagaaagcagtaccaatccctaaatatacatctgtcaataacttacagcacatttgaaacaatattactgctgtttctaaacattccttttttttgtttttagcatgatctgttgttgcctgtgttcatataatttctgtcttggaaaattattgaagctaccaaatatttgcagctgtatttagatatagactttagattataaatatatgacagagactctttactgggccttttggatgcgagacctcagggatatatgatacgtgttgtgagcctcagctaaagtctgacttccctgtggctggtaacttctgttaccaatactttaatggtggggtcctgttggtgaccaggcgtaatatctcactgaatacaaggccgtagtcagaatcttggggttgtaggactagacaagcagaagtctctttatttaatagatgtcactcctgttaaaattctccagctatgactgaagggagttggcaagtagccaagaaaaatgtggtgaaaagggtttaagaggggaggaaatgtcaatgccatggacatttggcaaagtcgatcacaagagggtttttctacacatgtgttttctgctgatcctgaaatcaaaactgaataccatgcatcttttcccttaaaaaaaaaaaaaaaaaaaaaaaagagtacagtaggttggcacatgtgaatggctcctgatacgagactctgtatgctttctagcaaatgctgaaacaaattccagtggacctttaatgtatatggggatcttgtgtctgtgttccctcgtgtgtctgtgtttgtgtgtgcccgtgtctaggggaggggagttataaggcagggtgcttaaatgctttgttacattatgttaattcctcggcagtgcaatcaaattcatgtcgtaattaaagctgtcagttggaaggcaagccaatcgccatgaaaacacagcataacaaatgaagtgaaatgattctgcgtgtagctatacaatgcttcgccaggcatgaaattaaataagtaatttgatgttgacatcagaaattgaaatgatacccactgttccctcattcagtcagacctgcataaacaatagccagaacaaatatgcacaacaaagccctcttctccacccagctccctgagtaatgtacaatatatatgcaaaacgagcataacagagctttccgagacctgaaggatgtaattttctttggtatacgataagatgatatgtatgtgggggtagggaagtgggtttggtgggagtacttctctttctgggataaaatacatttgcaggaagggaaagaaatgaaataaacaaatcccatggtctctctgagtaattcatcctaaaatgagttcacttcccaggggcatgactccaagctggtggagacctaacttggcttttgctttcttctgctgctgcatggagggctgtgggtgctggaaacaggtgatgctgtcatatggctagtcactggtatgagaagttgtctccatgactactgtggatctccctccataccatttatgggattaagaatgcagcaggattttaaaaaactgagtgcagtgagcaggatcacacatctatggtgcttcattcccctgagcttgtgtgaaacgctgagatgaggaaagttttgctttgggagctgcatttaggaatgccttgaagcatactgttcttgtttgatgtagatatagttacagtaccatgtttcctcctcaaagagcttagcatcaagaagagtcaccatctgctgtatttttatagatgtcaaattctcctgagccatttttcttacacataatccatccattcatttatttatacattcattcaataagtccttattaaatgcatcctgtgtgcaagtcattgtgtgaagctctaagaagcaatgatgaaaaagccagctggttactgctgtctgaagtttccagagtagggggcaggacatgtaggcagaagagctagcagtgaacagagtaactgttgcatcagggcagaggtcattttgcttctgggaaagtataatacccaacccaagctcatcagggaagaagcctggctggtgcagggatgcttagctgagacctgcagacctattcagcatttgcttcaccttcatttcaagcttaatcacaaagaggaagaggatgctaaaaattaaataatttataaagagaggttttaggagaaaaaaagaaacaaaaatcagaatctcaggcaagtttaaaatacattttttgggggggcttcttttcccaaacaagtgatgccctgcattcctttcagaattaacatttttaaattccctgtgtgtcagaactatgacagcctaaactggtaattcttgtgacttaaacccttcagaaaaatggtgcttttcactgctcctcttggcccacacattctctgcattttagtctactaattacgtttacaaaatgtctcatttttgaaaagccctgtgtgtgtactaactgatgcctttagggaataaactggcaagtaggtcatacactggaaaagtcatccaaacccactgggctttttattttcaagtcaatctgggctttttcctcttgcctgcccctttgcggccacaaaactgagtagcttgagaccagggcattgaatgtcagcaagtcagggaggcaagctgatgcgtgtctgtttagtctcagtgcagggcgaaatgccatcattaattcattacccagctgcctgtcaaataaattggcaattacatccaccgcagaagcttggaattcagtaaatagcacgttagcatctctgagttgttgagagatgtaaaggggaaaattaagcaacacggtgtttgtatcagtagcagatgacaaggggcagcatacactggtgatgtgatgtggtgatgaaaagcctgcaaagggctggtaatgagctgtgtggattggaacgtgttaaaaaccattgctgattttccacttttgtctttatgctttattgcagagttcagctccttccagcttgggaacaggctacttcgtaagtctatctcaacttccacatatgtgccttgcattggcattgatttccttctataatgaatgctcattgggatatgaaaaaaaatctgagaatttctctctcagtcctaaagagcagactgatttccattctttattaggaattgttttatttttagaagacatagcctgctgggccctagggatcttaagtaagtccgaggtatatacctggttcctaacgcccaggacattaagctccttacctggccatgtaaggagatacagggaaccctgattagctcatgccaccatttctccacaattacttttttagtaagaagtgtcatgtgggggatggaattcagattatgcattgagataactgatttcttgaataacatctcttcatatacaatgagttgccttttttggtggggaggacggggaatggagatggtattttttaatgaatgttttccctcacagtctgggtagtttgcctttaggtttttctttcagcaataattaatatacttatttttgctaaaatgcaaagtttatttctgaaccttattctctgtcctttgggaaagatggcagtgaggtgacccttcagggattatcacaatattgtgataatcatgaatataaaattcattctcaaacagcagttgtcacttcattatatttatttatagtgaaattctcctttctggatttagtgacccttttcaagatacaaatgaaaaagagtgacaaataagcattatttgtacaataggataacatgtcaatgtaaaagtctgttgtgatgcttaaaggaatctgattggtgttctgagtgatgaacactgatacagtcatgcctcagtattttctgagaaaatagtgaaatcatgaaaatcaaataaagtggaaaataattactaattcactttagttgcttttaacttttctctccaatgctaattactctggttttcttctgcccacgtatttctctcgatacatttacattaaatttatggaaaccagcatcatttcattaataaatgagtattttccaagcttagcaaaagtggcattttctagatgttgacttttttttggtcttaatctgtaataggagaaaaagtataaggatgatttggacctgcttaatacagttagcacacttacccttgctcctacttattgtggctgaatattcatgctaacagaaacaagcaggatacattcagtatcctgcttcagcagtcgaaataacagacgtagccccatctggcatctcttcacaccaggctggatgtaggttgagatgctggaagtaaaatctggagactgcgatatctattctccatccaaaagctaaagcctccccctttgctttcttcagcagaaagaaggccaaagccactaccttagtccttgatcacttctgtactgaacattctagtattttttttttattgtcagtaggatcaccctgaaagaagaaagtcatttctagaaacattgagattttcattatgctttttgcagttatttttctctctagttccaagaatggttatttttattctctaataatatattcttatgatttaaagagtctttaattacatgtctattaataaaatggcttttacagaacattggatgagtataaaagttttctcttattttggtaaaattgctggtagacttactttgcttacataaaagtctgtcgtattattagcttacatggagaagatacataccagatgtgtattcagctttcaactgtgacaaaaatgccctgctaggatgtgtttccaataatgtgattgttatgttatcagagtgcaaaatccattgatattgttgcccagtcctcatgaaaagtatcttctatttcaactttctttccaatagtatcacatgtaataatttcagatactaacttccacactggtgagtttcatacttctaagtggaaatgatatgggcacaacttacattagttctttgccaacatattatttacactgtgctttgtgatttgtgctgtcataatagctttttacttaagcctgtaaagaaggctcagcttcaggtaagtgaaatggtaatttttcaagtctatccttactcctcttcagcatgtctttgaaatgtggatggagggaaatcacctgcagagtccatgagctattagcgcaattgaaccataacatgaattctggtgtaagaaagctgaaggcacttttaacaatctagaaccgttttcttgaacactgtcccaagccccaacttcacagacttcctttgtttctatttagagcttttgtcaacagaggtaagatgctgttcattgtgtttgttaataaaatagacacctgagtatatacatgtgcaggtgtgtgtgcatgcacacacacgcatacacacccttagccaaaaccagtatattttactttcagttcttttatctgtagtgatacattcaagggtttaaaggagaagcctttgtttttgatctggttgtatttgtttatatctccttggttttgtgttccaaagatgtctgcttaggtctgtcacttttccaatccgtttagaagcagaagatttgagaaatgagaacagcagctcaaatcagtatttacataagcatattgcaaagaattcttaaagtagacaaaatagagaaggattggaacaaactttctacatttttgggagcttttgaataatgtgggtgttatacacacagagagacacacatatatattcattacatactcatgcccagctcatattctaaatataaatgaaagtatagactagttggaatcgatttgctttttttttttcttttttggcaagaggactaaaacttgttagagtgtgtgtaggattttcttttttttttttgttttgaacgtcaatgcaatgaacacattttcttttcaatttaaacgttttaggctgtattttctccttaaacatgtatttgaggtttcaatttgcatagtgtataattaagaacttagaggcagaatgatcttttaagactacctgtatgaccttggtccggttattttatgtctctgagtctatttccttatcaatacctacctattagtgttgcaaatattaaatgagataagatattttaatgaacacagaatatcactctatactaccaaataataagtactgccttctgttattcacacaatcgtgtgtgatggagcaaagttggtctcatcaggtggctgtgcaatgttgtgcaaagtaggttttataatttgtacctgtaggatagtagtattttattcttattatattcttcttgtagctttctcaggagcacagcttttgtatttgatcagttatttacattttttctgtatgtgaacataaaacagggtattcatcctctgtgattctatatgaacatgacgatgttggaatgaactgttctattagctgtccacatattatggttgttctctgtaatttgtcagttaaagttacttgtgtattttcttcctcagaagcatttgaagtacttggagcttttaaagactgcttagcagcttttaggattgggctgagagggaaggtacacctgttcaatatattccacttttatgaacttgtatcacatttgctcctttctgacaagaaaaagaaaaattgatgccctagcatatatgaacacagtaactgaaatcagtagaatgaaaagaccagtgagaacatttcgtgttggccagtggtctggtatgtcatcacaggaaagatctggactcattctttatagcacttgactccatgtggagttgggagctacttttggggcaactaaccagccaggcagaacttgattcctgctgtaagggaagtacagccttacttttttccaagtgacatgttctgccttctctggataattttcagccctcttccaggtttgaatctaactgtcttagaaccacagcctcaaatagcttgtatcctgcttttgtaaactccataatttctcttaaggattctcaactaataattttcatcttcctcaattgggtcacatctagtaattgacatactttaaagttatcagggaaaacaactcacttctactcagtgattaaaactgccgcattatatagtaaaggggaattgtgtagtggtatacatcttcagacgggatttgtataattattgttttcctgtgcagttgaattacttaagttgtgtaggtagtgctggtaacaggcagtaggtgcaaaatattgacctgtagctttccatccagggttataaaggtcatagtgggaatattctttgcccctttctaagtttttgactataaacccttgaaatatctcctgttttcctttgctataattttgtataacttcttcttttttctttttgacagggtctcactgtgtcacccaggccatagtgcagtggtgtagtcacagctcactgcagcctcagcctttctgggctcgggtgatcctcccacctcagccttcccagtatctgggagtaaatgtgcatgccaccacacctgcctaatttttgtattttttgtagagatggggctctaccgtgttgccaaggctggtcttgaactcctgggctcaagctatctacccaccttggcctcccaaagtgctaagattacaggcgtgagccaccatgcctggctgtataacttctaaaactgatttggtattctgtctaaccatagttgctttttaaccattttcccatttccccagataatactcaccagtggtgcttgcggctgcaacatttatcttgatgtaactgccagaaaatatcttgcttttattattttcccattgctctagtatattgactttggaaacaaaagacgtcattctactcatagcattctattttcagtagtggtatttccatttataaaatatagtaatttttataaatgccaccatgcccagccacttttaaatatttctgacacattgtattcatttattttctgggggtgaattcttttattagaacattcaaattaataattttgtttggtttgcaagaaaactgatgccatcaaggaagatgaaaagttactacacaaatttcaacaaagatttctataatttataaatgagggctgggcacggtggctcatgcctataatccagcattttgggagactgaggcgggtggatcacttgaggtcaggagttcgagaccagcctggccaacatggtgaaaccccgtctctctaccaaaaatgccaaaattaactgggcgtggtggcatgcacctgtaatcccagctgctcgggaggctgaggcaggagaatcacttgaacctgggaggcagaggttgcagtgagacaggatggcgccattgcactccagcctgggtgacaagagcgagatctcaaaaaaaatttataaatgaggttgaaaattcattttttaatttaataatcccagtctcagatgccctttcattctttgaatttgcatatctctataatatttctctttcaaaattttctggttgtcttatatataataccttgtataagctgatctagcagtggctagataggatcagattcaggtttggattttggcaaggatgcctcatagatcatgttgtgtgcttcaattaggagccacatatttagttctttatttttattaatgttaacagccattgattagacccagtgttcgttaggagctgcaaaatggtgatattgcagttccatcattctgtaaagagaaacatctacattaactacaggtatttggttatcctgaggtacagttaacacactgtatttgaataagagggtttgagctctccagagaacctatcactatttataagatttcttaggggttttagtttcagaagtacagatacatcaacttggtgctgacggcagctccatccaaagcagaagaaactgtcttcttccccacttggcagtacttgctgtgatgctaggaaaggattttgtaattcaagtgttcattcatcacctgttaagtacttatatttaagataaataacattaagtattttaacacttccccccaaataaagaccctaatctttgtatttattagtaattaacactaggtaaattaatttttggccattatatattgacaaaaatctattataatggaaatatttttgaaaatctaaattttatctagaaatccatgaaggatatccagttattattagggcatttggactaattgataaggagttgagttggaaaactactctccagatggagatttcaattcattttaactcacaagtatgacttaaatatctactcttagttcttaagttgcataacgtgtaagcatggctctcaagtcaaagatatgtagctgaatttgaagcaaagcaaactgattggtctatgagaagtgtaagtagagcacttggaagtataaaggagggtcagttaaatgtagcaggcttaaattgtgcagagcttgatggatgtttagatagtcaacaggaaagaaagggtggaacaagtttgaggcagggggagcaacaaagacaagaatacagagaaattgcataatagtgtggattgaattgactgtatgatgtctctggagaaagacgggacttagattgtcagggaatgttggttgattacagggaatgtgggataaagccagggaggtagtcgggtgagtggggaagagatggtttgtagagaaggacgtcaagtaaaggatcaatgactacaatactcttacttggagttagtccccagaagaggagatttgaatgtaggaaaatggtgagtttggaagttagaatacgtagttagaaatttaagtgtgtatttaagtgtaacttaaaatctaggacattaccaatgcctttgaagctacctgtgtactgtgcagaaacatctgggcaaacgaaagttgttgctctcccttatggtgaaacattgtcacattttttaaatgtaaccttcaaaatactacccttaactgtgttttttcctcctagtaacaaaaccagaatctaaggtgcattctgacagactcctccacgtggcgcagataaactctctaatttcaagggccttagacagaaaatataattgtatttcccatgtctaattcttacccttttttggtcatgtttttgatctgttaacattttaattgagggaataggatcagtgagccaggagcagacacaccttgactaaatgaacagtacaagttaaactgtggtgagagacatttaaacatttgtagaatctctacaacaggatgacttttccagcacactctgtagaaattatcttctgcctacacactatgtttaacttcagcttcctcattcagtacaagggaactgagaaatttgacaaaaaataatcaggtgagaaaagatcaattggtgtttccagttgcaaccaataattttaaccctttcattttctcaacatttaaatgagggaataggctgggtatttttaaacatttgctgtctacaggaatctttgacattgctgttgcaaactctttaaggagataagcggaaaacttaggtgctactgatggatgtggggaaatagccctcagccgttatctctctgtcctcctaacccccatctctggcccctcagatttagagggaaaaaatgattttggagaacaaagatttaatgagccactaggcaagagagtggctaaaggaccttaatttctaatatttcaaaatttatgattccagctgccttacaactagatgtctgccatgtgcaaccattgcttgttgctggcctcactgcctttctttgctgtcctttgagccacaggaatgcaaggccatagtgctgcttagtgaacactgttcttcactgtcaacattgaaaggagtcctgatttcaacggagtggccgagtctgcttttgtttgaaagtaatgtattttaaaattcattatgaacaataatgcaattattcataatgaataatgttttatatttgcatcattcatttagggctagtacatagagatactgaagctgttggcttagcctgttccatagctagtagattgatcatagagatgaagcggtaaaggctttagcacagtgcattgacagtcccagagggaatggacaggtcattgccatggaattctgaaaataattttatcttcattttcatctttttttctgacattggctttaaggaaggttgtcttatccttgttggagatttccacattacagaaatttgttgcatttgttgatacaagctatgtaaaatgacccacaggcaatgtcaattccggaggtttactctgattacccacacaacccttattttgatagatttaactagcctggagttttattgactatcactcagaatctttcagatcagagaactcactcctttgcttaactacttaaaaaatatttttgctgaaattgtaaattagatgcctcccaatccattgcataagaaacttatagcttggtgaaacaccaagagtatcatttgaaaaagaggttaaaaaacacaactggggcttgttaaagaggaaaagtggtattttaactccaagtgtcacattttcctatagtcagctctagcagtaaacaagagttattggaggcttagatagtttgagacacttcacttatctcccagtacttgacttcagaagccaaacatttaaaatgtgttttgctcaggtaaaaatgtttatccatttaaaatacaatgtcattttaacaaaagcaccctggtgacaagctgtttagatatagcacagttgataaactgtcagatcctgtacacatacacttgaaaggaccagcgcagtaacacaaggattggcattataaatcactgttaacaaaccttaatttgcttagtaggctaatgaatgatctccaatttttcttcagtaattagcttcgctaacagccatgtcaaagggaccttccttatactgtatttaatctctgctctgaaatctttggtgtctagtttgcaggatgaataaaaacaaacaaaaaacatttcggtctccattggcgactccctggtaataaatccagatgtagggattgtggctgttttcaagtagaaacattgccaaaggtgatgactgtctattagggcttgtaaactgtaatataatcacagatttggaatggagtggtgaagccagataattgcagtgtttcctgtctaaatgtgctgctgtgcgtagtggcctctgattttaaggagctgttaaaaatgcagcaaggcataacagctgtggttcctagaatactcctaatatttcatatgttcatcacatctcataaaatcttgcccagaccaacaaatgactacttatctgtacagctggactgtcttagaaggaaattagagaaagtgtgaatcatgtaggttagcattacagagacccaccaagagctcatccaagcccgtgctgtgccatatttctcttactgctcctcagagttctccctttccatttttagtccccaaagagaacatttgcctcttaccatttgtgagcagatcttatcaataacttactttttcctacctttgtggaaaatagactcaactttgccaagagaacttagggttctggggcagagaaattcaggcgaagttaatatctcaacccaaaatcaaaaagagacaacaaatttagttctcttagaattttttaaaattaatttttaaaataactttgcaatagaactagctctgtgatatgaaaacctggtttttctgggaggaacattagtactaggacattctgggaagcaaaggaagctagtgaacccaaaatgttcttttaatcagatattaaacagctaagcatcatgaccaaatggaagccttaaactgcatttgtacagaggcataatagagtcacaagttgttttcgcctaattgtttctaaattgcccactttactaatttgataattacagtagacctattattttggttttacataggtccagagttacagaacctctaggtcagaagggacttcagaaatcaccttacccaatcaccaatctgagacatgactcaaaaagttatgtattattagagtaggctgacaatttggactgtgaccttgctcatcctggatcctgtccttcagttgttatagttgaaagtcacattaatttttctgccatgccacagtgttttcttgatgtcagtgactgttttcatatgtgatactgttacatcttttttatcaaaaagtctaatggattctgtcttaagaacgagcctttattgaaaaatctctgttgaagtttgtcatggtatacttagtatacttggcttattactttaacttatgtagattctgtcatgtcatatattgttgttgcttttagttccacactggtgaagatcatcaagtgctacaactgtctttgtggcagttaaatttcagtgctactagattttactcattgctcttcttgtaatgccccacgatttgatttacgctggctgagtattacaagtcctatgtatttctttccattggtgattcttatctggagctttaacagaaatcagacattgttcctctgttttggttatttatagatacatctggaaagagttttgagacaacctgtgggcatacttaacatactgtaccttttttctttgtagccatcgtgtacaactgctttaaaaaaattagctggacatggagaagtgtggaaaccattgttctgttacacaatggcaaaataattgaccattaaaatatacctgtgatagacttagttgtgatgtggatgcattcatggtaagcctctctgagttattctaatgtatgtgaacaagcagtattatgtaaaaatagaggaaaggatatgctataaaagaaatacagtttgatacagtatttatgttttaacagatatgcttgagtactttaaatagataaatgaaaaaactttctattatttgtagtaggtctatgttatacacagtagtgtcctgagaaattcttgagttgtgacatacatataaattttgaatacagaagggataagttcattttagaaattactgcaaattttgaattggtagagccatcaaatttgtaaagcttgggtcacatttacttctgtgcattgagtgtcattacattctgttttctttaattttcaaacaaagggttgtaccacgcttctctttgaagaggccttttggtttcagcacatctatgggtacgttgttaacactgtcatacctccagttaaggaatggtacacgtttagagactgctttttcaagtcaaggtgccaattatttcctgcctaagcactattttagtgaactcactttagtctaaaatcacttgttatttatctcagaatgttattaaacaaggataaaatcaatgcaaagccagcgatttatgtaaatcttataaaagtttgattttctttagatttttgtgactaacagcctctcagtcttccttggacaggggagtggttagagtttgggttccctaattctctcatcttacagcctaagctaagcctcaatggttgatactgaagttttgtgaccctcgttcaatgttcagaatctattattttagtacttttagtggggaaaaaaaattctgctttacttcttttcctgctgtgatgtgtacattgtgttatttttctactgggtgtgatttttgttatctttttcagcttcattgaccataattttacttattttaattaacatggatcttattaacagttttctctcctgtacgtttgtgtttgtgacatactcttcactacatacttgaattaagtaattttattatttttcatctttcagcagtatgcttattcttggttcatttactgttttgaagcaatggaattacttacatatttttatttttccttttctctcatcttctgttttccaacctctacctccatttggtcctataacatgataaaagtgcaaacatgagcctgaataataaaggattgcttcactgattgctaaacatatattatagtgctttaaaactcatttcaggtcatcgtggtggcaattagtttgattacaagcatttaagctgtcacatagaaagccttccacttcctagggcttagtttcaaatcatgaaaactgaatgctctatacttatctatgtacacagctcaattttattattttggaagaaagctatgcctgttacaaagatcactcataatttcagaacctggttaaagccagtgtgcaattttggagcagagacacaattttattaaaaaatttaaaatatgcatgtgtacatatatgtaggtagggactatcaaaagagatgtcaaaaccatctatttattctcatttttggatacagtacacattaccaagttgttacaatgtggttatttaaatatcatttgggccaggcacagtggtgcatgcttatagtcccagctgcttgggaggctgagttgggaagatcatttgagcccaggagatcagtgttggagtgtgctataatcatgcctgtaaacagccactgtactcccatctaggcaatatctcttaaaaaaaaaaaaagtaaaatcatgactctcatacattatacaatctacatgtttaaacattttatttaataatgacggaagtaggcagatgttataactttttcaaaggtaaaccaaaagaaaatccacagttatagatgaggaatattgaaatgagtgtgtagatggaggcagaactggcttcaaggaagtcagctgagtctctacctcacatgacagagtttacatgatgttagagaatgtttattttgcattgttatcacttacctacaacttccagacttgtaaaatagtttccatggaatcagaaattaattatgctggagagtgtgctatagacgatgcctagtgtttccttgaagcacatgttttcctatttgatgaaaaatagtcttaaaggaaggtttgtttatttaaatttggcctgatcatttacacgggtgtaccaagaatgttaatttagcatataagccttttaaactttgctttctctgatgtttttacaaaataaatctcctattgcacttttaaaagtattatttgctgtcctaagggtggaaagccaaacccaagaatcacggaaaggatcactgaaaggagtgatcaagcatgatcactgaatggcactctagaagtcttcactcagcccactggtctttctgtcaccggcagtacctgtaaatttgggtgaatttctttcttcttgatgttcccaaaatatcccaaagtaccctaccaagaagtgatctctctttccatctatgtggctggattctgtaaaccagctaccaggctagtttttctgggaggattggtactttatagagataaagtcacctttaattccctgtaagtgtttaatcatatctgattaaatgagcattactcacaaataggacattccagacaagatcttcaagatttttcatactcatcttggtaaataggaaggccaatttttactgaacccatgtaaataactgtgttgctatgaaaagtaagaagacttagagtttttggattctggggtgtcagaataagattccattttaaaacacttcatttcagtttataaaatcagaattgttatgagttataaatagcttaagaaaaaagagagcttccttatattctcagataatagaacactgacataagaccaacaatactcaaaacaatcatccttcatcatttcattgagtcctgtttaattaattcttgctgtactgaatcttgacttattaatctcatcaactcatctcatgaatttcttgactgaaagaagttctggaaatcttgactcagcccactggtctggtcaaagttatttaagcaatgacatcagaaacctgtacccaagagtctattctttgaagtcttaattattttaagtacctggtgcagttttttttttttattgtgggtgctctgaggttgtctttcttatttgaaaaccagaactctgttctactgtgttactgaatgcataactttcaaggaaacataaaagtaaaacaaaaaacggtgtaagtgacagactttacatggctgtggttaattttcacttacaacttttaaaagtgaaaaatatgatgagaatttataacaaaaataatgtaacgtatttgattatttctgtggcatgtaaaacaaagctagtaaagaatgttttacacaaaactatttaagcaaatgagctcatagaaactatgaagattttaacatatttcattacttttcagactcaggtattacaaagcaaggtaaataaaattcactttccatgttctgttctcattatgttctttcatattttggaacaaaataatactttacttcaagactattcatagggtgttccatgaggtcagaactacttccatagtatttctaagatgttattaccatgcagtatgctcattattgctagtttgaaatgaatcagcaagtcagcattttaaatttttttaagttccaatttttaatgttgtaaatatcaatagttaaaacccacacacactctcatagacacaaaataagctcattgaggtcctcaataagttttaggagataactgtaagcggtttggagaccaaaaatcttcagaaacattgcattaggacacaggtgttcttttccttgaaaaatggcagcatacacataattatatttcttagaaactgttgcttctagatatgatgtcaacttcttgcattagttttaatttttaaccaaattaactaacttctatttcacataaaaaaactgggggatagttacgatcttccttttccatatcagcattttagaggagatcatgaataaacataaccaactttctatagccacacacatctcttatgcaccttcataaattgacaacaatgaacacattcattaacttgacccaaagatagtcttctctgtagattataaaaataaaaagcaaaacgatgaaattttaaattatgattagtgctcagtgttttagtattctatcttaattagaaatggtgtaactatccaatgaatatctgttaattaatttaatatcagtctgaggtttcaaattacttaaaaatcttggaaattatgctcaagccaacatagtaagaagcataattactattgaagaaaagtttttgagaatattgatgcagtttggtcaaagaaaaataaagacaaacataaacataaaatagaaataatgctagcttatttggccaggaaaccagtatatttttaggtaaattatctagtgtagagttaaaatgtttactcatgtacttaaaactgataaagaagacttactgtttttattaagccaagatttattaaactaatcttatttggcaaagttacacgtaaattaagtgaacttgagttcataaaatgtttccgaggtaatgtatgcaagaatttattgtttaatttagtacatttaaatggttagagattcaattcttttctgtgaattttaggaatatttagtatatgtaagcacttacactgaataaggctattagaacaaaactcctttagtcttagagactttataatctcattattaataccatctgaggtaggaaaatattgtgcacacaatgaaaggtaaaggtacttttgaattgtagaccctcagatgtgtagaaagcatacagttccaattctagaatttcagccataggtcaagagtaaatacagaaacacaaaaagtttcactagtccaaattgcaaagagctattcctcttcccagtagacatgctgttcttaattatttgagctcaaaacagacacatagaccatcagaaaatactaacagactagaacttttttttctcaagtgttttaagtgatagaaatctaagcttactgtgtggcacatttcttaaagaagcttttctgtgtttaactgtacattttgtagttagcattttcattctcattgataaattcaacagacagcaggccagtcagcctgttttaggttctgtggatatagcagcagtaaataagacaaagtttctcttttcatgacactcatagttaatcaaattaatccctaatatgccaggtgataataggaatctaaagaaaaatattcatgaaaagagttgggctttcagtaaagaataacagggactgaatttattgttctattagaaacaaccaaaacaaaagataaaatacatgacacaatggtttgcatgacactggacataaggcagtaaggacagtgatccctgaaagaaagtaaacaaatgtagtcatctctttgagtgtcccagcttcctgccttgagagaattccaggcctccatgcagggcagagggaattcagaagtaccaagtggaactcagtagactttctgcattaggagaagatactgagagtccaggaagaacaaggtagcaaaaattcaaaggacagagtattaggggggaggggtgatgcacggagaaaggatcccagagatcttcagaggattgctttccgttattcattagagagttaattagctcatgcatttcaacaaacttcctgatgcctgggaaagaaccatccagaaggattagaggcaacagtgccttacattaacccatagccaggaacagtgctgattctcaccagcaggattggaaaaaccactagactcatggggcatagagtcaagtacatagtagggtcttgtctcagtattgagaaataatcagtcattgactgagcagtgctacagtttgccgtgacactttttattttttatctttttgagacagtttcattcttgttgcccaagctggagtgcaatggtactattgtggcccactgcaacctctgcctcctgggttcaagcgattctcctgcctcagcctcctgagtagctgagagctaatttttgtcatttttttagttgagatggggtttcaccatgttggcccggctggtcttgaactcctgacctcagatgatctacccaccttggcttcccaaagagctgggattacaggtgtgagccaccacaccctgccctcccagcacgtttaaaatgtgagttctgatagggtcaaactatttcaagtgacttaactgaattctaaaaccattttatggcattcaattacgaattaccagacattcaaggaaccaggagaataagacccataatgaagaggaaatcagtcaatcagaactgaatcagatgttagaattaacagagaatgatattttaaaaattatagtggtattccgtatgttcagacagttaagtagtataagagcaaaattgaacttctaatgtaaatactacaaggtatgaaataaaaaatatattatatgggattaacagcagattagacattgcaggagaaaagattagttaacttgaattcatagcaacagaaactagccaaaatgaaacatgaaaagattagagaatttgcagattgaacagagcatccgtgagctgtgtgaaaacttcatacagtctaatgcatgtaaattggagtctccagagagaggagggtgagaggacaaaagtaatttccaaatttgatgaaaatagtgcagaacatcagaaacataaagaaaattacaccaacacatattataatcagatttctcaaaaccaataagaaagggaaaatcttataaatagccaggaaatagtaaaaagacataaatgcagaggaacaaagactgacagcagatttttttttttctggaaaaaaaaaatgcactggagcaacatccttaaaagtactagaagaaaaaattgccaacctagaattgtatacccagtgaatataactttcaaaagacatggataagagaatgagatgataatccacaggctaggagaacagttttgcaaagtttgtatctgataaaggacttttatgcacaatatataaagagatcttaatattcagcattaagaaatcaaaaagcctagttgaaaaacgagcaaaagatttgaactgatgtgtcactaaaggcaatatacaaatggcaaataagcacatgaaaagatgctttacatctttaattattacataaaagcaaattaaaaccataataggtatatagtaatatattattacacacctattaaaatggctaaaatgaaaatgactgactacagcaagtgttggtgaggatattgaggaattgcaactcttttacacactagtgggaatataaaatgtacaaccataaactctagtttctctttagatcatgtaaatctttcccctttttaaagatacaaccaattgagagaacagtttgataatttattaaaatgttatatatgtatgtacaatatattctagccattccaatcctgggtttttacccaagagaaaagaaagcacatgtccatacaaatattttacatgaatgttcatagtagctttatttgtaatagccccaaattggaaattggccatatgttcattatcaacttaatgaatgaaaatttggtatattcatacaacagaatactacttagcattaaaaaggaacaatgtattgatacatgcaacaacatggattcatctcaaaataattatcctgagtaaaaaaagaagccacacaaaaaaggtacatattgtatggttccaatttatataaaatgctagaaaaagctgtttaatctacagtgacataaagtagatcagtggttgcttggagaggcaggcacagaattgggagggaggcattaccaaggggcaggagtaaacttttgtaggtgatgggtatgttcattatcatgactgtcaggatggctccacagatatatttataggtcaaaatttatcaaattttatcctttaaatatgtgcagtttattatatttcatttatacttcagtaaagctgttttaaaatgattataaaaactatttccctgctgttgttaacaccctgagatgtctgcctcttttcctatctttctgtgttttaaatacaccagcctactgcactttaatacctctctagctcagacagctacacacaaaacttactctgaagaatgtcaaaatgcatgttttcatcagagaaatatctcatggtcctttgttaaatgttcaaaaattcatgattgggctttataaggcaaatatgtcctgttttatagaattacgggagagaaaatgcatacaaaagagcccaatcctttttttggctggcttttatgtcagagctcaaaattgctctctgataaaatgtaggccaccagattgaattacttcattgaaccactgctgtcctctgttaatggtaattgcacagatatagcagtctttctcggcaacatctcagatatttacctcccactgtttttcaattcaaacctttgatgaaaatattcccagtacttctttaaagcagacatccaactgtctttcttgacaaaagcaaggtctctaaatcagatcctgacaatttgtgacacagcagtctatccaaatcaccttttacctatgtcactatgtcatttcctgaagaaaaaagtgtccatcagacaagcaatttctgtaggttttgggggctggaaggttggtatgccagcaaaaatgagagaggaaaagggaaaaataattttttcctttgacttgtgtggaaggaattcagtgaggggttgaccagatctaataagcaaaagaggggttttgtatatttaaaagatacatttttataaagagagatctatagatatttgttattttcaagatggtaacaattgaaacttgaatctagtgatttctgaaagctgctccctttaaggagacagggaaacaaggttagtttttttttaattcttaactttttctgttagactactttaatatgacaatatttagcagtttattttctcgtcagggattcagctcagtttctggtctacctcctgtcctgaactgagcagactacatttcctcacatgaaggttgtaggttgtacaaacaatgccactggcatgaaccatgatcagcgctctccacttgactcatggtgactttggaggctggagtgcagcacatggtaaccaggagatcagctggatcagcctcagagtgaaactcgctgctattatctctttggctatggttggttgggtgctttttttttcccttttagtattggaaggatataattgatacttgctttcttggatcaaattgtagcatcatatgtttgactgatgggttagttgtaggagctgtcagagcccccctgggacctgctttacaggtttggtgaatgagcagctgacagcacagcaagcacactttctgctgccagcctggttttgttcttcccaggtggatgtttcattataggaatgggcctcaaaataacatttgcccaggaatatttctagagagtggtcatctttggtggcactgttatggtggtatgttgctcatttagagtggtctcattcaagcaagacccatacatcatttggggagaacagtgaggaaaaccgtgggctgagctctggggagggttcgatctgggaataaggcatgtcctagaatctcagtcaggattctactttcaagagacagtgcaaggctcctaggaagttggggccaggaggtaattaaagaggtagaaagagaaaatcttttaaaatcaagtttctgactgcatgggctcttgaatgtggtctttactttgattgtggcctcaacatacaggtggtagcagagtccttgaagggcccttgacttttttttttttttcagagatcagggaatttgtaatttagaaggagaaaactggcactcttgtgccagtaaagcctctgctgatagctgtgtgccgtttgtttttaatcctttctcggtatccgtctctggccatccttatctttactagaaatcaaaggctgtgaagggaccaccagaaaaataaataattcatagcttttcaaagcctgagccccaaatactcaactttcaaagcatgagccccaaatatcccttcccttgggcttgaatttgctaaactggagcctgtgtttactctactagggtaaccaagtattcaagagctcagagaaaaaaggactggccactatacctctttggaggtaagagaggagcccgtgtgagttcatgtgtagaagaatcactttcacctggaatagaatgtcaatcccagaatctcactatctggcaggcaggaagtgataccagtttctggcttggaaaggacatctgaaggatcctgttggttttgttttgttttgttttgtttttttctcctgttggttttgtctgctgacacgtgggtagtgctgacccagtgtctgaccggattgtctccatccataacttcatctagccctgtttacaaaagaatgaacacaagtgacagcctcagtgaacctgcaccatgaggatgcccttacttctcccacactctcactttcttctcttcttggctcctcttcccctgtacttctctctgttgacatagaatatgcaaagtccaagagatgtggcaatgccagtaagagctaagttacttgcagctggcggtgccacctgtgcctatcaaatttcagccaaagcaattgctttcccagaatgccctgttttggggaattggaaagtgaatctgtaggggcggcaatggctgtatagaagagagcttttctctgggctcaaatatgaggacaaaattgtgaagtaggactgtagataatcccaaatccccacttttgcatcttcctgagctcagaggcaacccaagagatttccgagttaatcctttggactttaggtgaactctcagctagaaccatcgtttgcaagcagatctcctgtggaggtgacagttccataacctatcctggtggttgtatagttgagaatgtttgtgattccttctctctccacaagacctcaccacttccagttatgttcattttatttttgtttagtcatttttgtgcttagggaacaatttttcagctttgtactctcacctcataaaagtcctttgtatcattgtgaaaaagcaagtcaaggcctggcgtggtggctcatgcctataatcccagcactttgggaagccgaggcaggtggatcacgaggtcaggagtatgagaccagcctggccaacatagtgaaaccccatctctactaaaagtaaaaaaaaaaaaaaaaaaaaaaaaaaaaaaaaaaaattagctgggcgtggtggcaggcacctgtagtcccagctacttgggaggctgaggcaggagaatcgcttgaacctgggaggcagaggttgcagtgagccaagattgtgccatttcactccagcccgggtgacacagtgcaagactccgtcttaccaaaaaaaaaagcaagtgaaattgacattttaatttagtctgactgcatttttctataattttctaagaatttgtcactttttagtattttctcttttctgataaactgttccagcttttcatcactttttaatcagctttcatcagttttatcatactcaacctctggtatttttctttgtatgctctctttttctcctttttttgttttgttcatgagacaggtcttgctctgttgcccaggctggaatgcagtggtgtaatcttggctcattgcagcctcaaccacctgggcttaagcgatcctcctatctcagcctcccaaagtagttgggaccacaggcacatgccaccatgcctggctaattttttattgttttattatttatttatttgtttatttatttattttttctttaagagatgggggtctctccctatgttgcccagactggtgttgaactcctaggctcaagcaatcctcccaccttggcctcccaaagtgctaggaggcatgagccaccacacctggctcttttctgttgttcattctcttcacccttgtttagatcctaaagtgacccaggcacttcaggatctgaagatagctggatgatgatgagtcttcttaaaaggtagcattttatagcaaacatgatgtagagccactgaagggttttatagttgctgtcctcaggggctggatttttaaactggaatatccatggggactttgaaaattccacctgctggggctctacctcatttgagaaccactaccttaataagttcatggccttacaatgggagtgggaggagaggtgactttggagcagacaattacaatgtgagtgacagttatctctttcatgagtactgctgtacaaactgggaatgcctgatctggttcttggagagggagtggaggttaacctgatttatgtaaagttgtagtggtcatggcgggggaggaggttgcattccatgaagcaccatttggaaagacccaaagtgtggggcctggttatttggaggacctggagatgttgttggaatgcttagaaattacaggaatgaggataggaaggagccagatcccaagtggtcttgacaagtcttgttaaagagttttcatttcatagtgcaagtgatgtagagccactgaagggtttcatgttgtagaatttattagatgtgtgtgagagatagctcactcagttagttttgtggaagatggctgtgtaagcatgagattggaggcaagaacttcaggaaaaattatgatgatgactgggagagaaggtggacaattctagagatgtttagaacacaaaattgacaggacaaagtcaacgagtcaatgtggcagtgatttatagagaggcctcaaggataaccaagtatctgctttattcaaccaagtgagtgctggtacaattcactaagagaggcagtataggggagtgaataagagcacatatttgaatcctagacctgccactcgcctatgagttacattttgggtgtattcatttttaagacgtccatgggatgagcaaagaaagagatcctgtgggagtttgagtctggagctcagagaagcagcctggacctctggtgcacgtgatccatgcagtccatggatcagaactctttcaggaaaaaaaaaatgcggttattaggacaagtgttgagtatgtgtgatttttatttctttgtgatttagctggaggactatagagctgaccagaataaaggcaataaatatataaataatcatctacctatgatatactcaaggcaataaatatataaataatcatctacatatgatatgagtatatcattatctgctgtcattattattagtgaaggcatgttacatatttgtttggaccacagcatactttcaggaaactcttgataaacagctttcttttttatttattgccctgctttcttttgattgcttttgccgtagcatcaacctgcatcttattttaatcatctcctctctgaacattgatgattccgcagctttgttagaatacatcttgggagattccattttttaaaggctctttcaagggcatatggcattagatgattatgatatggcgcatttagaatatgccatgatttctctcctgctgaatccctcacacgtgtttgaagtaattattatcctctctgctagctcatgagacttgttagatcactatttgtgggtgtcataaaatgttggcaagaccccagtgtgaaacgcagtgtgaaatacatgtggttaaacttctctgattttgtatgtcaatcaaaacaaaatggcttaaaacagtagatgaatttcaaaagaaacttcaggattctagagcaaaaatgacacatggaactctttaggtctgtgttttgatatttaattcagggagtcatacacaggaggacgtatgcaatatagtagaatttagatgtgttatgattatatctgataatgttacaaatactgagcagctttttgttacatcatatttggtcccaaaatgtcatgccatgcaatgctgggggtgtttaaataccaaatttatgcatattttcaaggaagaagcagataatcttctaactatacagactgtgttacttatcagaaataatagtttatgaattgtcaaacagtgaaaattttaaaccatgtatccctgataatacttttatgtcttcattaagcatcactaatactgaatatgagtatctatctgatgaggaccttagaatcttattatagttagatataacaagattttatttattgtttttatcatggtgaagggtatataatgtcagcatgatctctcctttagttttacctcttctggtgttttgcagtcttaaatgggtgtctttaggaatatcccttatttctagttttagagctcttacttctagttttagagcttctacctaataaaggtataattagattggtcttttctgcatttattaatcaaagactattcttttacatgtgactttttagcaacatccataatttaagtgatatttgcccaaatattatctgtactcccacctttacaagaggatttaataacttaatagagtatgttatagtaatgagttggatgaccaaatatatttcaactaatagaaagaccatgatgtagctgctgaaatacctgagaaaggtagcttaccatataaagaaagacagctaggattttgatcaccttcttgctttagtgaatgatgctagatcttcctccaacgtaaatctttctgctcactttaattctagatgtgtgaattcttgacttgaggactttgatgtcagatttcacctacttgaaggcccattggaagaataacttctaactcattaaacaattccccatttagccaaagttagtctcatagatgtctgtgatggcttgttaggtggcacagtgactaaatttgatgctcagaaaagatggtcttaacaaagagttctttcttttcacacaagtgtaagctttctgacagttatcacccaaaatgcatcttgttattgttgtcttttctactcatggctgtgagtgtcagacactgtgcttccattcactaacatgaagacatttgtgaaagggccttcatcaatatctgacactggtgaattgaagaataatatactagctacataaaactgtgtttattcttcctaaaccaatcattgctttttgcagcatttccaatgaaattgtgattttttagcagattcttctttgatggagctgtgatttgcaataatcttgtcatgccaggctcaaaatactactaaatgaagacatttgtggaagggaatgattgtaaattgcatgcaaatttcaactcggctggaattaatcaatatggaaacagaacttgtgcgttcctgatataatgatgctgaaactaatcccatggagttctatttccgtgggaattaggcagttattttgctttaaatctatctctctctctcctttttttacccttgaagacaaagtcctgtttttgagttttttaaaagtaacttctttggggatttagagaggttataaaggaaacaggagtaaaatcaagcatctgacttcccctgtggggacatctgacatttcctatttaatttgctgtgcttgtttaatgaatctttcccccaatttttcttgctagtttttttttttcactgaaaattctaaggcttatgagatagtaggtgatgcaatctttattctatgttaaatatgcgacactggtctctaaatgggatgttctttcttttacaccagtttcttagggtgatcccagcttatccttgatgaaagctttttgtttttgttttttaagtcgcttttggaggaacaggtcaccaaccttgactttttaatgcctgcttacattcaaatttctcattttctttgattggcaagattaggtttatggccttttattcttacacttggcaactagatcggttaaccttagattatttgttccccaccttttcttcagctgtttaggtcacaaatttgtagaaaggtcttatcattggcatattttgtaccaccagtgcatcagtgctatactcatatatccttagaggctgacaacttacttcccagcccctttggagtactttaagaatccctttatttatagcccagcttaagccccagtgggtaacactccataaacctgcagtgacatccagtggcctcgtggtgtaattttttacaaacttttctaaaaggaattacaggggcagtatttcctgtcaaagaaaaatactgttggagttattgaagggggtttcctaaatacatttatgtacaatagttactggcatactccttgataggattactaggagaatgattattcattttttggtttttgagtgaaggattaacggcctctgatgaaatcagctttattccaagatcagataaaaaatataaaattgaggacaatatttttaagaggacaatttttaattaaaaaaaatcaacagtgtagaatttcctattctggatagatttaagaaataaaggagaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaaaaaaaaaaaaaagaagtaaaggagaacctttagtttgtgcaactgatcatgaagtttaaaattctatgttgttccccttcttggttcttgtgcagtcaatgtctttgagagtcttcttccactgtgttaactctttaattttctcaaaccacctaagactgctactataaatcagagccaagagattcccaatctgattactgtctttaattgtattattaaacgaaaacatatttttataaaaatgatgccccattattataaaatatttacgtggtagaaaaatgtacgaagaaaatgtgagcacatcagtgcaaatcttacccttttcacagaaataaccagcgttaacatttggtaaacctctttgaaaatgctctctatatgctcttttatattctttccatgcatatatattgatagaacgataaataaattggaagctaagaaataatttcatgatactgaattgaacgacttataacggctgtgtttatttggtttgtaattaccgcaaaatgttatactaggtggggagaggaccaggaagaggtttgctttttttaaaagagatgactttgcctttcttgtgacagggagggctggctaggcaggatcaggtttgggagagggtcaatagagaggagtggtgtgcagccacctcatggctgccagctatgaggtttggtttagataagttaactgaggctggaatgggacagcatagttcatatgtttaaacacccaggacgagatgttcccagagctcagagagttcatacgagtaagtctagcatgtagaaactaagccagtagaatgttccaaactgatgctaggcacattcataccaaagatgagtgttaggttgtggtggtggggggggggggggcagagggggagggagaaggagagggagagatctttagatatctttagcaattgatactgaaccagaaatttgaaatttagatttcgctctgtcatgcccattccccagacacttctcagatacaatgcaaaagccatatgctactgggagagaggcaagaaacctgtttgccattctagtcctaacaaagattagctgctgtgggggaaggactatgaatctccccctgctttgcaaagaaatggggcaaacgtcgtttgcagttgagagagatcattttgcccatgattctgcactaatgcactgatcctctacctctggtagaggaacaggaaactttctcatgcccaagatattccaccaatacaaggcaaaacttggcttccccgtgggagggatgtggggaagaaaactgattgtatttcataccctgaactgagtaggaagcagagattacatgtcattggggtggaggaagaaatgctaagaaagtcatgtacttgagtcccagatgtgcagggctaggctaagactgtgcttggagcaggagaactgagaaattctccttcccccctccaagagccttcaaccataacaaagaaacagtaacaggcttgcagtctactgctagaggagtggcaagagcatgggaagaaacgcagacaccctgcaatgcttatgtgcaggtcctacttaggtcctactgtaagtttagggtggatcctgaacactgagaaaacctttttgacagcaaaaaataaaataaactttcatttctatatagatttagattacaaagttatgcaggtagaattctcgtataaaatcaatctagttttccctgttgttacatcttacacttgtaagatgtagttgttataagtagatgtaattgttataagatgtaattgttataagtagtaaaccaatattgctacattattattaaatgaagtacatactttattcaaattttcttagtttatactttactgatctttttctgttgtagtatcctatctaaagtaggatactatgttgtatgtttagtcattatatctcctcaggtgcctgtaagactgtgacagtttctcagatagtttttctttttgatgatagttttaaggagtactggtcaggtattttagagaatgttcttcgattggttggattaaaaaatttttttgatgtttttctcatgattagaccctcagttggcctctgttttgaatcttctagactcacaaaagactatgtcacagcagtctatcagaggaggaatttttatcctgtggtgcatcaacactagttatagcaacagtaaaatacagacacaattcaactactgagtagatttattcagtccccccatgctaacagcttgaaagaagtagttacccatttccaggtagaaatattatttacctgagtttcttttatacataaagtttgggttcaattaaaaaaattatgacatagacacactcacgtaagataaaaaaaaaaggtgactgttcaagatgtaaaatagtcaacaaaatctgacatgcaaacttcagacagggaccttgaaataactatgattactgtattaaaaggtttaatggaaaaggtggacaatatacataaatcgtgatgtggaattttagtagagtgatggaatctgtaagagtcagaaaaaaatgctagaaatgaaaaacacaatatcatatatgaaaaaattttctgtgggtttatcaacagacttgatacgatagaggaaagaataagtgaccttgaggataggctaataaagcctttcaactgaaatagagcaaaaagagtggaaataaaaaatggagcattgccatagaaaatttcctgaccgcctaacatacttcaagagagagaaaataggctagaagaaacgctagaagagataatggctgagaattttccaaaatgaaagatagccaaccacagactcagaataaatatgaagaaaagcatacctacgtacactgaagtcagactgctgaaaatcaaagataaagaagtcttgaagacagagaaaaaaataaatattcatgcagaggtataatagataaaagctcagtacattttatgtcagaaattatgttagtgaaaagagttggagtgacatctttaaaaaactgaaagaacaaataccctcaacctagaattctgtatccaggaaaaatatattgcaaaacggaaagtaaattaagtcttcgtcagatgaagcaagagaagttttgctagcagaacaggtctatctgaagagcttacaggaagctcttcagacagtaggaaaactcttcagatagcaggagtacgctgctctatagaaagaacattttgttctacacaaaggaatgatggacaccagaaatataaaaatatgaataaacagacaagacattttttcttctaatcttttgaaatgagattagagtatgggttgacaatgagcctggtatggtttgactctgtgtctccacccaaatctcatttcaaattgtaatccccacgtgttggaggaagggcctggtgggaggtgattggatcatgggggcagttccccactgctgttctcatgatagcgagtgagttctcatgagatctggtggtttaaaagtgtgtgacaattcctgcttgcttgctctctcctgctcccctatggtaagacgtgcttgtttccccttcaccttctgccatgattataagtttcctgaggcctctcagtcataatttctgttaaggctgtggaaccatgagtcgattaaacctcttttctttgtaaattacccagtctcaggtagttttttatagcagtgtgagaatggaccaatatgagtcaaatctaacatcaggcttgttttgtgcagcccatgagcaaataatttattttaagggttgtaaaaaatttttttaaatatagaataattaatgcatatgcaacaaagagcatatatggcttgcaaagtctaaattatttactatctggtgctggtttaaagcaaaaataataattctatattatggggtttataacatgttaaaataaaattttggcaataataccttaaaggatgggagggaggaaatggaaatatactgttgtaaggtttaaatggaaatatactgttgtaaggtttctgtacaatacatgaaatagtataataacatttcaaagtagactatgataagttaagaacgtatattgtgaattttagagcagccattggggaaaaagataaagtacaagatataattaacaagccaataaaatgaaatcataaaaatgctcagctaatacaaaagaaggcaaaaaaattaagaaaaaaagggaacaaaagaacagatgactttttttaaagtataatagtacatagataccatatcatccttagcaataattacactaaatataattggtcagttaaaaagcagagattataaaattggatagaaagtaaaacccaattttgtgctgcctgcaaaaaacccattttaaatacagagccatgactattttaaagcaaagaggatggaaaacagtatgtcatgcaaaccctaatcaaaagaaaactggagtggtctgggcttatgcttataatctgagcactttagaagtcggctggatcacttgagttcaggtgtttgagaccagcctggccaacatggtgaaaccctgtctctgctgaaagtataaaaattagccaggtgtggtggctcatgcctgtaatcccagctactctggaggctgaggcaggggaatcacttgaacctgggaggtagaggttgcagtgagccatgattgcaccactgcactccagcctggatgacagagggagactctcaacaaaaacaaacaaacaaaacaaaacaaaaacagaagtggttttgttaatatcaatacagtagacttcacaatattaccaagtataaagcatggtatcacacacaatatagtgataaagggatcagtccatcaagaaaacaagaattcatcaagaaaaaggcctatgtacacaataacagagcttcagaatacataaagcaaaaactaatagaattataggaagaatagacaaatctactaataaagtttgagatttcattgctcatccctcacattgatagaacaagttaacacagattaggaaggacaccaaaaacttgagcaacactaccggtcaccttgactcaatcaacatttatagaatgtgcccttcaacagcaaaatacagttttttgtccaaatgcacatgccatactcattgtagacatattttgagctattaagtaaatttcaataagtgtaaaagcattgaaatgatgcaaattatgttcactgaccacaacagacttaaactagaactcagtaacagaaggatacccggaatgtcctcaaatttttggaaattcgataacatacttttaaataacccatatcaaagagtaagtctcaaatctaatttgatttttacagtttacatgcctcttttttctaggcatttaaaaaatatacagaagtacagtctagactgcacatgtgtatataattgatgacagtgacattctctcggaatttatattaatgtagtgcacaatatatttgaagtacatttggcataaggacgtactaagtcacaagacttgtttggggaatgtgatttctttggataaaattaaattccttgaacttgacaactaatcaggctgaaaaaatacacttgaagctttctgatacattattaaggaagttacagaatatccatgaatttagttagctttacactccagtggtactcctgagtattttgtaattgaactcgttgatcttcagatgtgaattggttcttcagatctgtgaccatcagtctgtctacaaacatttatgcaggctctctgagcaagatgcctttcctcacggtggtttctaaactctcccaatattttcagctgcctgggtaggaagcattagggcagacgcccaggctggaatgcagtggcgtgatcttggctcactgcaatctctgcctcccaggttcaagagattctcctgcctcagcctcccgagtagctgggactacaggcgctgccaccacacctggctaatttttgtatttttagtagagacagggtttcaccatgttgactgggttggtcttgtactcctgaacctgaggtgacctgcccgccttggcttccctaagtgctggaattacaggtgtgagccagtgcacctggcctgctctgcttttaaagaagcagaatttgtctagatgtttttgaagaacattatgtaataaaatagcagtaagagtatgaattctcgatatgtattgaaaattagagtctttaaaagtcttggtgtttagaaattaatattagttttaatatgactctttaataatgaagaatataaagttctctgtgtgctggtgagaggactttttatttttactcctggaaatacatgatttgtaccagtcacttgtgtggccataatatttttgccctaaatattaggtcatcatttcctctttattgttaggtaacccagaatgctaggtattctctaacagaagaaaaaaaaattggtttgcagtcctggtaagctgttggagattttaataatcccaataaaatatttccatttttcaaatgtgtttagatgtccttggcagatttagattagttacatgagatggatagaaaacaggctcagggcttagggtttattttgatgatttttaaaatttgttgaaataagagttgttttatttaaggaaaaaataatatttctggattaagtatttcaaatgcgttatttttggagagatgctacagagcttatgtcaaatgattattaatatatatatattttttttgagacggcatctcactgtgtcacccaggctgaagtgcagtgtcgcgatcttggctcactgcaagctctgcttcctgagttcacgccattctcttgcctcagcctcccgagtagctgcggctacagacacgtgtcaccacacctagctaatttttttgtatttttagtagagacggggtttcactgtgttagccaggacgcttttgatctcccgacctcatgatctgcctgcgtctacctcccaaagtgctgggattacaggcatgagccaccgcatacggcctattaattcttaaaaacaattgtgaccatgatattagcacctaaagcactattccttttcttagccttgggaagacttcatggtcatgaatactattaatttgattttttaaaattatgagtgccatatggctgtagaatgcagaggtttcatgaaatatattcagtgagaaccagaagtgatttactaatgcctcaaactcatttaaatatctaccaattcaacatataaaattgtcttcacgagaaacattacggggtatgattttgtatttgatcataatgcttgctaattatttcctgttagtattactggtaaaatgggggttggcaaattctagatagtgatgccacatatgtgtggtgtgggttccttacaaaactttatttgctgcttaattttgtaacattgcatcattccctaaatagcctcaagatccaaatacaattgcagtaatacttgctgaaaattggaaactattaaaaacattcatttgctgggaatcaggagaggggagggaatttcaaataatagaggtttttttttattaaaaaaaaaaactcacaaaatctttgatccactgtctctcaaaaggcaatttgatagctaaatgcaagtattttttttttttttttttgagacagggtcttacttcttcgcccaggctggagtgcagtggcatgatctcagctcactgcaatctctacctcctgggctcaagcgatcctcccacctcagcctcccaagtagctgggtctacaggcatataccaccgctaatttttgtatttttgtagtgttggggcttcaccgtgttgtcaaggctggtcttgaactcctgagctcaagcaatccgcctgccttggccttcctggtgggattacagggattacagccactgcgcctagcctaaatatattaataagttttaaagttttatattatttccatttctattttggtagtaaaggtaaatgaacaagcattatagatcacagacatttaggttaaaaggtccaagctctttgagatgggatatactagggacacgttatcttttttttttttttttttgagatgaagtcttgctcttgtcccccaggctggagtgcggtggtgcgatctcagctcactgcaacctcactgcaacctccacctcccgggttcaagcgattctcctacctcaccttgccgagtagctgagattacaggtgcctgccaccacgcgtggctaatttttgtatttttagtagagacagggtttcaccattttggccaggctggtcttgaactcctgacctcgtgatccaccttcctcggcctcctagagtgctgggattacaggtgtgagccaccgcccccggccggggcacattgcctttataactctatttaattcccttgcttgcacgttgaatagatctaaatgactgggggaaaagtaaaaacatagtctttagtccctttcattgtggtaaattcactgaatgatagacggaaatttcagccttcttgggtctactgccaggttctgtagttatttgtatgtctcatggagaaatcctcattgattacactgtatggctaaactgacttaaaacagataactgagcctatttcaaaattgaaaattctttaaaatggaaagttagtactctattgttcccaaactgttggattgcatgccattttcccaaactcacagacgttgataagatttcaggcaaggggaacaaggaaggggtcacagtggaagcgaattcttcccctttttctgactgtgtttgcccacctgtcctttacccttcgcagttctattctgagaggtatgtgaggaagatgggagccactgctgctagattgttgccattaaccagctttcatggcttttgtgggagcctccttttcattagtatttgcaacatgttcaccagcaaaatgattatgttaggcagagacatcacatcacttacatttcatagctcagtgcaattttcataaactgcgaggcaacatccaaaaaaaacatgactcagaattagagtttcagaagattattatatagacattatttccctcaggtcacgggctttagtcaaatttggaggagaatgaaattgccaacagtgaaaagcagacagaaaggtatgagttcatgagcagagaaataacattttcatttgttccttccccatgggaaagattcagcattccggtaaatggagacggttataagaaatgaatttttgtcagcagggatgtgattttaaggctcacttatccattggcaatctagatttctaaccccaggaatctgggaaattgctacagaatgtagtctttattataaacaagtttttttttttgggggggggtagtttttccctccttcttttcttggtcagagctttttaagacgaaggactacatttctttctgcatttctggggtcagatgattgcagatttcccatctgccctgagtttctctccattgctgttgctttgtgatggaaaccctttctttcctcctcaccaagcttccctcactctgtcgttgcttttcctaacccccctgtgtttatccagcacgacactgacaatattgaaagctgcaaacttcctatatggccatggagtggtggatctatggcctgatctctctgttccccagcatttacaggatgtcttgtgctgctgctgattctatatcctcagttcttttgtgtctgtggacctgaaagagcaaggcaggaaatacagctttccaggtagctctcattttaccaggtataaagagcgaggatttgcaaggtttctgtaaggtaatcccagacaaccttcttcgtaattaaagaacgttctttcatgggaaattttattttccttcttcgatttcatcagatgcttctcagcccatcactcattcagattctatgcaatggttctttttctagctagagtacatccttgagagtagaaaatatttcatataatctaaacccttcatttctagagatgcagatagattctgtaacattaatctcacctttatattttttcaatttttaataacttgaaaatatgtatatctaatgccttctttccctatgcacttttgcttattttaatatttctcaacaccataagctatttgcccagctgcatccttattagacagtgctattgcctgccaaagctttttgagagcaaattgcattgccttcattattattatgtctacaatataatgattatgaaacatcattattatagttgattaataaatgataattgatgactctcagttcataggatttggcccatgaaattcatcacaatttgtaaacttttctccaaaccttcaaggattctaaaaggattgattttgctgcaaagtatatgcgattacattttttgatacctagtaagtagtagtggttgaggattcactggcctggccagagtgagggtgtatactaaatgtctgtggggtttcaatttcttcctattgaattcttttaaaatgtagagtctcttaccactgggagtttggggaacttcgcacagtggctcatgcctgtaatcccagtactttgggaggccgaggtaggtggatcacgaggtcaggagatcgagaccatcctggctaacacagtgaaaccctgtctctactaaaaatgcaaaaaattagccaggtatggtggtgggtgcctgtagtctgaggcaggagaatggcgtgaacccgggaggcggagcttgcagtgagccgaggtcgtgccactgtactccagcctgggcaacagagcgggaccccgtctcaaaaaaaaaaaaaaagaaagagagaaagaaaatgttgacggaaggcattctatctcagtctctgcaatgagccattcgcattttgtggaatcctttctggcattaattgggggacagaaacagcatctggcatatttacatgacagtagcatgtacttctcttttatatgtcattcattcgtacttccaataagttcttttctaatatgagcatacattgctttattgtgcttggcagatactgtattttttacaaattaaagttttgtgtaaaccttacatcaagcaagtctgtcagcaccgtttttccaacagcatatgctcacttcatgtctctgtgtgacattttggtaattcttgcactatttcaaacttttttattataattataactgttgtggtgatctgtgatcagtgatctttgatgttactattttagttattttggagtgacataaacctcgctatataagaacagtgtgtgttctgtttcaccaacctgcctttcctctctctctctctccttccctggccttcctattccctgagacacaacaatattgaaattaggtcagttaataacactacactggactctaagtgtttgagtgaaaaaagagtctcatgtcactcacttgaataaatcaaactctagaaatgatttagcttagtaaggaaggcatgttgaaagccaagatgggctgaaagctaagtctcttgcacctgttggccaagttgtgaatgcaaaggaaaagtgattaaaggaaataataggtgctactccagtgaacacatgagtgataagaaagtgaaacagcccttttgctgatatggagaaattttaggagtcttgatgggagatgaaaccagttacaacattcccttaagccaaaacctaatccatacaaggctctctgttcaattctgtggagagtgagagaggcaaggaagctgcagaagaaaagctggaagctatcagagtgtggtttaagaggtttaaggaaaggaactatctctagaacagaaaactgcagggtgaaacacaagtgctgatggagtagctgtggcatgttacccagaagatctagctaagatcattgataaaggtggccacgttgaataacagagttttactgtagacaaaacagccttctattagaagaagatgccacctatgactttcaaagctagaaaggagaagtcccatgcctagcttcaaaggacaggctgactcttcgtaggaggctaatgtagctggtgactttaagttgaaaccattgcttattttatcattccaaaaattgtagggcacttaaaaattatgccaaatctgccctgtgctctagaaataaaacaacaaagctgggatgacagcacatctgtttacgacatggtttactaaatattttaagcccgctattgagacctactgcttggaaaaaaagattccttttaaagtattactattcattgataatgtacatgatcacccaagggctctgatggagttgtacaaggagataaatgttgttttcatgcctggtgacagaacatttattttaccattcatggatcaagaagtaatttcaactttcaagtctcattatttaagaaatgcatttcataaggctttagccaccgtaattagtgatttcctctgatggatctgggcaaagtcaattgaaacctttagcaaaggattccccattctagatgccattaagaacattcatgacatataggaggaaatcaaaataccaacatgaacaggaatttggaagaagtttattccaaacttaatggatgtctttgaggtgttcaaggcttcagtagaggaaattgctgcagatgcatggaaatatcaagagaactagcattagaattggggccttgaaggtgttactgaatttctgcaatctcatcaccaaaattgaacagatgaggagttgcttctttatggatgaacaaagaaagtgttttcttgagatggagtctactcctggtgaagatgctgtgaatgttgttgaaactacagcaaagaatttagaatattccataaactcagttgataaatcagtggcggtatttgaggattgacttcactttttaaagaagttctatgtgggtaatatgctatcaaacagcttcccatgctacagagaaatctttcatgaaaggaagagtcagttgatggagcaaacttcattggtgtcttactgcaagaaattgccacagccacccaaccttcagcaaccaccagtctgatcagtcagcaaccatcaacatgtatgcaagaccctccaccagcaaaaagattatgacttgccaaaggatacctgcaaaaatccatccaccagactcaggtgtttgttagcatatttttagcaataaagcatttttaaaattaaggtaactacattgaatttttagacataatgctattatacacatatagcctaatatgtctattagttttagacataatgctatcaattatgttaataacttaacataatttttgtgttcactgggaaaccaaaagttcatgggacttgctttattgcaatattcattttattgtggtggtttggaaccaaatctacaatgtcttaggtattcctgtattttcattaagaagtagtatgactatctcacataaaggctgataacctggaagacacttagatttcaatatagtttggaacctgtctggattccatgtattacttcaacaggagtgaagaatcccatagtctgatgaatttttgcaggtattctcttcaccataatgaggtttcattagggttactgctagaataggattgtttgttattagtttccaatgaaggatggaatattctcaatgtaggaattcatagtacgtacaagaaagctatagatattgttagtataataattatacaatagtagtagtataataaaatattcaagcaatcacttaataattacttcaagtctcactgtctgccctccagaatcaggagcaggatgtctgaactcctcattctttacacttttactcaaaagctcttaactctagagacagtctttaactttttggtatttggtttcttcttttgtgcaatggcaatgattctgcctgtgcaaacaactgtcaactgtttttctcagcagtgctagtgtaaatgaagttgaatattaggaataattaaccttccttgcttacatatgccatttgataatgctcaatcttctttgttaagaaaacaatgcagtaaaatctttgttaattgagatgaagtgttgtttatttaaatttggatcattctgaaaaatatatttgttccaacaggcttattcctgaaaatctttctaaaatatgttcagtgtctgtctgccttagaatggtccccaaatataattgaatctctctctggtgatgggttgtcttgcacagcctaggacccatcatactggagtgcttttctctctgaatcaagcagcagataacggaatttggactgctttgatctcagatcataccctggaagttgtgttttaataagtaaatttcttatatgaattgttttcttagtgttgtacctcattcttcataaaagtaaaaagtatattagcaagttacagaacaagaagtatcatgttgcctaatcaatgcaaaatatcatcatttcctagacaacttcacaggagacatagcatgattagaaggtcagacttgattaaatcccgtgctttgcccttagttttttgaaatttcaaaggaggcaatctctctgtcaataaattttcaaattttataaataatagtaatcctgatgccagcaagcagttattgagctttgtgtgccaagtactgttctaagcatgtttcaagtaataactcacttcttcacaatgagcctttcaaggaggtactgttattgacatcatttttctagtgaggagcctgaggcttagattcagaaacctgtgagtcgccatatagctagtagctggccgagccatgatttgaacttagctgtgctcaaaaccaccacaccatgatacctcagagatgaatgtgtgcgtggtggttatgggagaagagaaccacatttacttattttttgtctgggtcttgcatggtgttttagatcatttcatttctgttatttcattttgaaacatttctactataattattatccatattttacatatagggaatctagtctcagaaaaactgaagcttataaccaatattttacagctagtgataatgagggagcagacatttgaacttgacaacctaaattcaggttctggctaggggtttcgttaaggaaaggaaaaattccctccaacaaaggtcatttttatgatgtgtaagtgatttaagctttctgtataccaccccaccccttacaaagatttgtgttttcatttttaattaaatctgtctgttctgcattctcattgtttggacttttttcaaatcattgctaatacactggttcttcttcctgttagtggtttgtggttgactggttcatcttctaccgttaacataattctgttttttttttttttttgaggtggagtcttgcgctgtcaccaggctggagtgcagtggcatgatcttggctcactgcaacctctgcctcccgggttcaagcgattctcctgcctcagcctcccgagtagctggggctacaggtgtgtgccaccacacccagctaatttttgtattttttgtagagacagggtttcatcattgttcttatttttatttgtcattcctggaaattaattttgctttgagtttgggacccctaacatgatgtcctttagccccgtgaagagtgaatgtccctgtggtgccattagccacttgtacagtgtcctgagaatattttaagagaaatatgaatggcagtaccacttggataccaattaaaaatacttttttttttcagtgaaatacgtctttaaacctgcaagacacagagggttggttctcttggtttccttagtcattattgacatcatctataactttctgttgaaataacaaggatttttatggaaagctgtttttgttcctgttcctgttgccagttttcacatccttatatattattaaagatacagaatgggcttttaatagatcctacaggccaggcacagtggctcatgcctgtaatcccagccctttgggaggctgaggcgggtggatcccatgaggtcaggagtttgagaccagcctggccaacatgacgaatccccgtctctactaaaaatacaaaaattagctgggcgtggtggcaggtgcctgtagtttcagctgttcaggaggctgaggcatgagaatcgcttgaacccagtagatggaggttgcagtgagctgagatggtgctgctcactccaacctgggcgacagagggagactgtctaaaaaaaaaaatgtaggtcttatggagtcacagagtcttaatgaatctccattgttatatgacagggtcttatggatgtcttttggaatgcccagcagcaagtgggcagcttcttaacaacccactgtgactcatgaggaagtgtgtctttgtgttgtttatgactgtgtttttatgggtaggacttcccactgtctcactttcctggcttgccttctcttctgtttaccctggccccacctttggctcagctgggcactacgggttttaccagagtcagttggaatgcaagtgcatcacaccagctctccatctccctgtggcattttatggctcagagaggattggaactaaaccttgggtggctcatgatcggttgtacccagccaagtctggagaaatggagaaaatgcctgggtttgttagtctacatgtccttcacattcttacagacacgtcttttgagtccagagaaatgtaaatcttttcctttttgtttttagtggtttatttctcaggccctgaagcatgagttttggtcacccctacagcaggggagatttcttcaaaaacagctgtgattatccgaaggtgttacattgtgcttttcttttcatgcatttttagcacctgcacatcatagttttcccgggaacctccagcagtgtcacctgctaacttggcagactggagagactctcaaagccatgtctgacttctgtgtccatctggattatttctgtcacatgatgatttggcagatgttttctgcagatctctagctctggtaaacaatggtgaactgggcccatatactcaacttgtaaagagtgatttccccaaaaacaggagacagacatttagcaagataggggctccttcatgtgaaagttgatctctaaggttagtataaattttctgatctagagggaattataggactctgaggcccacccttactagcttgccaccaggcttggtataaccttcattgcaaatgctaggattcatgctttggttgtacatgaaggggattatttctgggtggtattttatctcctactctcagactctttcagatctagctggatgttcaacataagccttttgtgtaattcccatgggctgtagctctgtggcttgagtagtggtcacaggagctctaatgccagaataaatgatgctgctaacagaaaaaagtagggctcatttctctgcaaaatgctgcacaaagaagactttctttgcttcttctggtacatgtggtaagcgtagaaatagtttattatggaagtctttcagccacaggtctttctaaggcaaaattgtatcctccagggaaactaaaataaataccagcctaataaacttcagattttaaaaaataagttatcatattgcatttctgtaagaagaaaaatatgaaaggttgatgtgtgtttttattccactttgatttacttcccaagctgtcctgtcccaattcaatcttaaaatggaagaaaatactttatcatttgaagaaggatgaatgtagtacagaattcaatttttaagaattcaaggtaggggaagtaaattttgatgccaactttcaagtttttaaagaataaaataaaataaacacatacacacacagttggctttgtgttggaagttaatgatagatgtcttctcggtattctttgcaaaggaagtcttccatccaggctttccctcatttgtttttaattacagtcatggtctacctggccttctcactagcactagctccctatgccttttgctttgctcttaggccgggcttttggtccctccctcctcatctctggttctctcgctattccttggctcctcttgtcttgctgcccagtttggctcaggtacatgaactgcaacctacattctgccatccctgcagctgcacaagcctgtcgttttccatactattgtattttcaggtctaacatgtcccctttttactgccctttctcagtctactttagtggttattatcttgtcatcaatctctttaaatatggctaggctccgaagattcctctattgactattgtgtttgctttattttataaaatttattattaaataaagctaggaaatgtaatataataggcttccatttacccaccacccagcttgaaaagcaattctgaatttgctatttatgttactaatttctttatatatttttcacatatgcaaatcaacaaatatatagtatgcttatattttggaaaattgtatcttattctttatgtgcttttttaactttttaaatggaagatgatgcttgtgagattaattcaggttgctatgttttgctcttccactactgcatagtattctattttaagcctatgccaccatttattctatttatgagcattcagattgttttcatttttgttattacgaacaatgtttctgtgaacatgcttgtacagatctccttgcacttctgtcaatttattatttcagcatattttattgagcacctattagtgcttggcgtgattgatacaagactgctaaaacaagtcgtatcttgaagccatatgctttagagagacaaacaggcaaattctgttgtaggagtcttctcacctatcttcttatttttatttcactcctcctttgtcatatttcacagttctgctaaagttaacttttttttttctttttttttttgagatggagttttgctcttgttgcccaggctggagtgcagtggcgccatctcggctcactgtaacctctgcttcctgggttcaaggattctcctgcctcagcctcctgagtagctgagattgcaggcactcgccaccacacccagctaatttttttgtatttttaatagagacggggtttcaccatgttggccaagctggtctggaactcctgacctcaggtgatccgcccccctcggcctcccaaagtgctgggattacaggcgtgagccaccaagcccagctgagctaactttttttttttttttttttgagatggagtctctctctgtcacccaggctggagtgcagtggaatgatcttggctcactgcaagctccacctcccaggttcacgccattctcctgcctcagcctcccgagtagctgggattacaggcacccgccaccacgcctggctaatttttttgtatttttagtagagacggtatttcatcgtgttagccaggatggtctcgatcgatctcctgacctcatgatccgcccatctcggcctcccaaagtgctgggattacaggcgtgagccaccacgcccagctgagctaactttttaaacatagttttaatcattactgttattgtcaaaaacattcaaagtctccctgttgcttatgtgataaagttgatactcctcagcttgccattcaagaaccatcctagcttaaccttttctcctgtttacatctcacccatacacctttcagatgccagtgtcatttccctttcatgcctctcagtgatatttctttacccttagctatcttgcctgttttgaactttatccaggatgttgaggctttactcagttttcaagatccaaatgaaatagtttattattcctcttatacccttcgtctaagtgtttattgcagatagtgggatatgcatttgtttagctgactaggagcaggaaccatatggtaattgcctccaacatagtaggacctcattaattaaaataataatttataatcaaatcgaactgaatggatcatttggttctcagctttgctgttaaaactctttaatggtcctaatgggaggagggagtagaaatagagtgaatgttttagttttctgttgcttttcaaatgtttctgactctcaataagtgcttgtagcttactaaccgagcaaccattctaagcgggatccttaccacatcaaagtgggataggttgagaagaaaactggctttagtaagagagacagattcttcataaaaaaaaaaaaaagaccatattctcaccttagtaggattgaactaaagcatacttaaaccagcttccattctcatctcttggtcacctcctttctgccttttgggtggcaatacacgttgatggcctgtcacctatcatgcccttctacttatctccagtccccagggtagaaggcagatgtggctgcatgtgaataaggggaagcccgagtccactgtgtccgcgtttccattttgaaggaaaatgggagaaatgaggccagtggtttgataaattatatcaaaaatagtcccttcatgctaatggagtgcgaagaagctgatgtactggagatgatctataatatttcatatttctctgaggagaaaaatgataaacttgatgatgtgcaatttattcatgtttcttcagatgagaaaaaaaaatcctcaagtcaactaactgcctgtttctcactcctggaagctggcatgtggattttacactgggattggaggctgggcttgtttagagaaatgcctagagagactttgattaatcaccagacctttggcagttggttgggagagggtaattacgctagcattgccactattttatcatcgctattttatggctctacaccgccaggtgacaaatgtgttaattattgcatttcttatcctggacttctcttgcctgccccctcccctcatggttttggcccttagtccttctctgcagctcagccctggacggcagtaacttgtgcaatcaaagagctgttctttgggagccatgctgagagggacagggctatcagccctgctgtgtgcagacgctaaccacggggagctggttaattccctttcctcttccttctgcccatcaccctttgggtcaagtgctgctcagagccagaagctccactggcttctttaataactgaaaatagcacccctggactgggccatttcactctaaatagccccctggaggaggttagaaacagaggttgtcttaggcaaagagatttaggaggtaaaattgtcctttttctgtctttttcttttttttttttttttgttgccccttctgtctttctgttacccagagaaagcttcacaagcatgcctgtaatttagttgcaccattttattacagctgaaagaattgaatgtaaagaaggaagtttaatagaacatataattcagcagatttattgatggggaggtatctattgtagtttggccagtgaaggcaggtcatagaggaaaatttaggtaagtcggattttctttaaaaagaggcccaagagttagtacctcaggattttgttttcttctgttccttgggcatgctggaaatttgttagctcttaaatcaacaacttgttattgacagtcatctttttgctggagaacgtattaaaataagtataattatggtgcctgacctcaaaaagaaaaccagttggttatataactctaaaaagatgagtagccacagagtgtagaaagccacagagaagagcaaatgccattgttgggaagcagagcctatgctgggtaaagtttcctgggagtttcatcctccaagaacaagaatttcttcttctgaccctccaccttctctggaaatggggtgccacatcttttgccttctggctaaatttttgtttattatatgcctctttcactagaatgcaagaacatgactacttggttatgttcttgcttgtaatccttgtttttagaacaagacctgacaactcgattatggtcagtatatatattttttggatgtatgaatgaataaatgaaatgagatcttaacatgtaactatcttcttttagactacacagggttttgactataattgaaatttttaggcttcttcagctctctcttttttgggtccaaaggatgtctcaaaccaaataagaaattccttcttattgatctagtggttacagacaagagacgccagccttctttgtcttttggaagttaggagtgtgtccctgaggaaactatgccctgggaaggttctttatttataatacaaaatttcttttttgtggttgagctagatacagatatttttcaatttttcctttcttcgaaggctatattttggcttaatctgtacttacagcataactattcatgctaattataattcatatatgaaaatgcaccaaatatgactattagaagcttttgaaatactgtttgatactttgcaatatagttatttatgcatatctgcatttgattttaaacttcttgaagtaatgttttatttatttttgtatctccattgctcagcaaagggtggcacatagtaggtccttcatgaactaatattcactagagcactgtgggaacttatttgcaacacccttggcatctctcttatccattggggatagcaagtaatttgaactgtcaaaaccagtggtgttgctttgggcctaaatgacattaaactttttttttttttttttttttttttttaagaaacgaggatcttcctatgttgcgctcgctagtggtcttcaacctctggcctcaagtgatcctcctaccttggcctcccaaagtgctgggattacagttgtgagccaccgcacctggccccaacattcaactgttttttctgacagtaactaagaatgggataaatgcctctctgaggcctttcccagtttgtgaggccacttgtcttattatttgtgattgcaggaggacatgcatcatattcatctaaaggttgaatacatttatttaattgtggcttgtgaagaaagaagagctaatatgtggtcacgttttatgctatttaggatcgaaaatcagtcagtcatgaagccatttcttttcattctacttttggagatcatattatgataagcttttcagaagcattaataacctagactcaagcctatgtagtttggaccttcatgtctttacatgtgtagaatcaaagagcaataggagttggtgtatatgtgacttgagaagcctcacatcattcttggaatatgttgtcactagtgtcatcagtggggcctacgtgccctgcctgccaactcaggaaaggcgtgagattgagggatctagatttagcatttattgaggaaaaagtgttgtataaactattgaaattttacataaaaaacaaatagatctgttttgggaaatgaagattttcaaaagaaatatggtccattttgaaagagataattgcaggatatattttagtgtggcctggagcttaccaatcagaatgatattttgacattcatggtgtcaaaaggtaatttctttttgccttgaatcttatgcttgaagtatgttattcatgtagctatatataatgggattacattttaggggaacttcgggatgatatgtaaaaatcctgaagaagttgtctttgtgttttaaaacaagaaaaacttgacacaaactggcttacaggaatgtgtttcttgcaggtttcccttagaagccacacaggaggcagttttcattggctgatgatgtttatgggtataaaaaagaaactttgggaggatttgataaagtctcttttcagcttaagataacatcattttactcacgttagagcgtttgtgtgtgattggagttttgatggtggttatatttttggctttttttaatgtttgttgcttactgccattcctgaaccaaaagataagttgttcagataattgcaaagacagattatggtaatagtgatactaatatctaacatactacattaaatatgtggaatttaatttaattttttgagatggagtctcactctgtcacccgggctggagtgcagtggcgtgatgtcagctcactgcaacctccgcctcctgggttgaaggattctcctgcctcagccttctgagtagctggaattacaggcgcccgccaccatgtcccagttaatttttgcatttttagtagagatgaggtttcacctgttggccaggctggtcctgaactcctgacctcaggtgatccacctgcctcagcctcccaaagtgctggcattataggcatgagccaccgtgcccagccaatatgtgtaattttaattatttagcacttatagcaattttataagatgggtactttgtttatccctattttttagataaggaaactgaggcagcagaggttaaagaaacttgcccaaagttaggtagctaataagtagtagaagcaggattcaaactgaggtattctggctctgtaatccatgctcttctatgcactgcctttgcaaatctaatttcaacttgaaatgagttcagtggattgatagtagattagtaggggagccattccaaagagtttcttataattaagtgaacttgagaatgtaactggcaacagtgaagagattcccactctatttcatctgtaactttctgatcttaccgtggtggtcacatttgttgtaagaatatttatggtggtgtttaggataagtttaaggaaatgttgatcactttttgtttgatctgagatattgatagatatttatatactttataaataggtaattaggtatatatgtaaatatgtaagatatatacctattaattacctattaaatcattcatgctggcctctgggtatttacatgaatttttttcagtaagtcttgcctttcagatatatataaactagattatgcttaaatatttatttggacaagtgttttcctctttagttaagaggccatcttctgaaaaattagactgcagtaaagcagtaattccgcctcagttttccatgagggaagatttgtcatggctactcctacttttggcattataatcacgtgaacttattattcaaattaatggcttcttggcataattttcagaggtctctactgcaaatctcagacatctacaaatcagtacatgtcataataaaaggaagaatacagactgtcagacatactcaactagtcttctttttttttttttttttttttgagacggagtcactagtcttcttttggaatcacatcaggaaagggaagttgttagtgcttatgccaggtagctggaagacatctttgtgatatttatgaagatcagccctgttgggcaatcgttgcctctgccagaatgacttacccatttatctaataaagggaaacatctaaattcttgaacatgtaataattcacttgataaaattcaggtttttataaacaaatcatattaaaaccccaaaagttaattaacaggtgataaaccttgcttttacttccttgtcccatcacattcattcatagtcataatacactgacaattattgagtgcctttgatgtgccaaaagcacttgctaaatgctttgtttggaaagggatgtttgttaattggggtggtacctcccaaataatgaaacatacacacttttgttttattgaggatagggttttatcattccacagctgttccttgagtaagatccgggcttgaaaggccaagttcttctacaggggcggatctttgaggaggaagaggcaggtagctaggaagggctaggaggctacagaggttaaaagtggtctgagattagggagaatggctaaaagtgagtgagattttctctcgtgtgtgaataattgtaggaagagattctggacaacatatgcagaggaacaaatggagggatggtctttagtcagtggaagtggaaatccattggatcatccatgagcccatctgaaatcagcagcccgttaggtagaagcttgaaaaaaagaactgttgtgtttggtgaatatatcacgattttggagaatgatgagggcagaatcctgcatcctttctagctttcttgagaactttgtacgagagtcactcttaccatcatctaaatataagtgatgtgtcctgctgttaaggaattccaccatttgctagctagtggacataaatgggcatcttgttttcttttctttctttctttcttttttttttttttgagacggagttgcgctctgtcgcccaggctggagtgcagtggcctcccaaagtgctgagattgcaggtgtgagccaccgcaaccggctgcatctttttttctttattaattatttatatgtctggaagtctagatatatatttgtcttcgggaatggaaaggtaccaataggaaattttgagtaagccagagtattctagcaaatataggaattacgccaagaacagccagaattgcccagcactagtgataacctggtgaaaagaaagaccatcaatttatgtgttccaaaaatgatgtcagcattgcaagaggagagctgactgcgtaggctcatcctcatttctcaggagagtgtgcctgtaaatgaccaaccaattacaagcagatgataatgaagcaaaatgatgtaaatcaagatctgaggagtgacatttatggccaagacttgataaatatggaattggagaaagaagataggaaacaccagaggaggacagcaaggactgtagttttttttactgtggataagcccaactccctactgtggcattgaatcttggccaggcaatagtttgattgctgatttccttagaagggaaggattcttgtgtaggattaaagtaaaagtaattccatgacaacttgttactgaggaagacagccaaatacatatttcatgagtaagcaacagtcattttggtggaatatggtgtgttacgtaaagcttggtgctagattaatgcccaggtgaccacttggaggacaatcagtgtagccctgtgaaagatacaaagtattgcctgcctaagtctcagtttctttgtctgtaaaatgtgtgtttaagtggagctgtgagacaatgagaatatatgtaaggtgcctggcacttaacagttgttcagtttctctctcttgagcatcctcaaagctccttttattgatttctttgatgctgaaagaaagagaataaattttgactgcacgatgagcttcattttttgaaggtgctgattctcacccccatttccagctacattgactatcgttagccacttgttacccatctagtgaagccatcttctatagtgcagtgtgtgttagtaggaaaggcttatttggccttgaagggctcgtttggccttgatccggtactgattgtggtttgaggttgagcatgttaaggatgaatagtagctggaatggtccatgatgtgtgcttagtatccttcagaatgtttacatagtcatatttagattgcttctgagaacaagagaatacagaacaaaatgttatgttccaaataaagatcacaataagaagaaatattgcccttctagcttggcatcctttttctgccatgatttccctttgcattttcttcccataccttagctttagccaaggatacagcagtaagtgttgcttggtatttaatcaaattaaaacctgtgctaggtaatgcctcatagattttattttgccaagatagatgtttgaacggaaaaagaaatagtgtatattaaggactaaagggggtactcttgttttctttcaaatatgataattagtataaaactgtctttttcctgccagttggctcatctcatctcctagcagctgttttaaattccttaattgtctattgcttactcagctatcatttcacaaatttcctcactgccgcattttcgttgaagcaaattctgacagtgggggatgctcacctcacaggctgggttgagctgagttctagttatcctctttgagtaacaggattaactatcattagacagtgcattcgggtaaggtgatggttccctaggtctctttggagttgattactatagaaatgggcatctggtggagcctcaggttgccaattgcattactcttcattttactgatgtttcaattctgtttaacccaacgtagacttttttttatgcttataaagtaataggagtttcctagaggatttgcagcgtacactattgtataatctcattgcttataattttttttcagaatgaaggaagtgggtattttaaccatagcattttcattccagtatcattaaccatttaaatacactttgttaaatctatcacattttctgttaaaataatgtaaaattctagtagaaattttaacagtatcttactgtaaaaatactgtaggtaatagaccctgagataagacagtctgctgctttcagaagcatcaacacagagcattcctcaagcatttgatttaagtaaatattattgaagccttactaaattcaatttcagatattgtgctctttgatagcacaatgacagcttacatatgatgctttcaaatgtcatccacttatttctttttttttttttttttttttttttgagacagagtctcctctgttgcccaggctggagtgcagtggcgcaatctcggctcactgcaagctctgcctcccgggtttacaccattctcccacctcagcctccctagtagctgggactacaggtgctcgccaccatgcctggctaattttgtttttgtatttttagtagagacggggtttaaccatattagccaggatggtctcggtctcctgacctcatgatcctcccaccttggcctcccaaagtgctgggattataggcgtgagccaccacacccagcccacttatttcttaatgatgggaaaactggtaatacaagaccaaatttttgtttatacatcaaattatcaactttcatgtcttatttcatagtcatgcattgcaggaatgtgcgtactgcataaagtgacttgctttatcaggtttgaaattcataatacagtcagaagatgattaacagatttgttcaaatttttatgctacgatatgttcttgtccccatgtgaataaatgcaacagattgtttgtaaccattttaattgctctgattttacatggacaatagttttgtataagaaaagacaaaaaaggccaggcccggtggctcacaactgtaatcctagcactttgggaggccgaggtgggtggatcacttggggttaggagtttaaaaccagcctggctaacatggtaaaatcctgtctctactaaaaatacaaaaaaaaaaattagctaggcgtggtggtgggtgcctataatcccagctattcaggaggctgaggcaggggagaaagaaaaaaaaaaagaaaagagaaaagtagtcacttggtttaaatgcctggattttgaaacctaactccttgttttacctctgtagttttaggcaaatcacttaacttgattgaatctcagttactctcactataaaaatgggaccagtaataccttcttcaatgtgatcttgagaagattcactggaataatggtgaaagtaccctatcacagaatttatagtaggtgctaaaaatgttgtgtaccttcctttccttcccttagaaagacagtctcttttatttattgattgtacttttgccaccacagggggaaaaaaatccctgtttcttataaaactttctaggaaattcatgaatttagtgtgggccctctaattctgacaaatacaatattgattttgagtttgttgctttaaatttgccaaatgaaacgaaagttttacggttttccttttaagtcacttctgatatgtggagcaaacaagtctgtatttaatagtaagtagtttgctaattgcaaagcactaccaacttaacacaacttaaaatgagaagctgagagggggccagagcatgaaataagtaagtaggttaagaactgccacacagtccatcatgcttgcagagaagaatgtgagactgtccgaggctacagtgctggtcaccttagcctgtgtaaactctcactttctcagttatcagtggaagacaggggttaatccttattagtctgaacacatcacattgcaatgatctgaaagctaaagacatggcataaaggaactctgaagaaaccacctccactgagactgctgatgcttcgaatggaatttgggcagatggaatgctcatttaaggagcaaatgacatggacggggggagtcaaaatgataaagggagcctccttgcatttgttgtatcttacttctgtgtgagttctggcaaaaagcaagcatgactagaaccctagaaaaacaaccattaggtagatactagttatagtcaatcagagaaagccagtatgtgcgaagagagaagagaagaaaaccacatggtaaaaatgtaatcaaccagtgggattcttttagttcataattgtaatcatagatggcattccactacctttgtcttccatctggaccaagtatggctgtgtctagaggttctgttgtactatttctgtggtccttgaactctgatggcaacctaccttgacaaggccaaaaacctacacaactctgagcctttcttggtagtggcattatctaaacgtatgcatttgtaccttatcaggcttaatgagggaaaagaaacggcttttgaagacactaatgggaaattattataagtcaatgaagtaaaaatgcaaatagatttgtatcttaaaacaggaatactgctagaagctaaaactgagtaagatcttgctctgtgccaagcacatgctattttgcattaaaagagacccctgccttctacatagtatcctcattttacgggtagaaatcttgaggtttagagacgtaaagtaaagtaactcacctaaagttacatagctcatgagcaatgtggcagatgtttaaggacacctcgtctgatttcagcgcctaaatgaagagccttttacaaggatgatgatttttgcagcaacaagacaaagatgtccagcaataggaaaaagattgtaaagaaatgttaatccctgtagagggcactgttcagatttaactcatccaacataattttctaacatgataaagcagacctgcgccagctcctgactgtttcagataggtttgcctctggggaagaaagtgcagtgattcgtgtaacctactgtcagtgttatttaaatctcagacctaatctagaatttactttaataatcttttattattttcctgtatattcttatgatttctcccttctcaatgaataatgaatttagcataatgaattcagttagttctaggcttcttcatatctatatttaatattcaaagcactttcttctcttttattcctgatttaccaaaatctgtgattgtgccatgaaaagatgataaaggagaccatctcttggatctggaaagtgctgcgtgttagtttataactgggcaaatgtaagcataacgtttggccagggttgggtgcggtggctcacgcctgtaatcccagcactttgggaggtcaagatgggtagatctctttaggtcaggcatttgagaccagcctggccaacatggtgaaaccctgtctctactaaaaatacaaaaattagctggatgtggtgacagacacctgtaattccagctactcaggaggctgaggcaagagaatcacttgaacctgggaggcagaggtggcagtgaaccgagagtggcactgcactctaacctgggcgacagagcgagaccctgtctcaaaaataaataaataaataaaaaataaaaaaagtttgaccagaggactacctccattgtctttcttttctacaatccagtttagatactttctggactaaccataacttacatgcttgtccaggagtattggccagagttagagtggtcacattaattctaggcaagggtgaagatgaaggagtagagccatgtttccttgaaggacagtgatgatgctttttagagcttattacgtgtttgctatctctcccatcccaagcagtcaggggttttaactttgaagataataataactgtcttcagtgggtgaatttacatctgttttgacccaaaagataatttaggatgacttatggaatctgaagctaaatgtcaaatgtaattaaatgttactgttgtgtcttgccttaagaagagagctggtgagttctagcagggtttgggaactatttggattaactgctttgattctttcccacattatataagaggtgttatctcagacagcacagaaattgtccctgggggacagggaggcatcacatttcagaagtacctataatatttcttcagcatgtctttgggcctggctttctcaatatttctaccttttcttgaaatctccacttggatatggctctggaagatggcagaaacgccatcttaaaatatacataatatttttaagaaatcagttttgaaaaacaagaagtctcttttcctgacggtccttcctcaatatgcttaaattattgaataggaaagcttcagtaagacacaactattaacataagtgctaaggattaagaaaaagatctgtcacaaattatgtctgtctgtaggaaggtaaagttgtgcctttgatatgacacctacccctggaaatcatattcttttccaagatataaacccaaatcagaatagggagtgagctgttaatatgaatactgaatctggacaggcacggtggctcacgcctgtaatcccagcactttgggaggctgaggtgggcatatcccttgaggtcaggagttcaagaccagcctggccaacatggtgaaaccctgtctctactaaaaatacaaaagaaaattagtcgggcactgtgctgtgtatcagtagtcccggctacttgggaagctgaggcacaaaaatcgcttgaacttgggaggcagaggttgcagtgacccgagattgtgccgctgcactccagcctgcacgacacagtgaaattctgtctcaaagaacaaaacaaaaccaaaagaattctaaatctgctctgaatagtagaagacaatgggagacatttatctttggtagcaacatattccaaagacttaagagtttaaagaaatcatcattttcctatcgcttccttcctttctctctcaatcctaaaatactctctgggcaatcaatttcggaattctttcaaggaaaggaaaccttgattcgtctgcctgttaactactacaaaatgtgtagattcctgctcttccatgttactactcagagtaataacgaaacacctattattgtcattatctggagaaaagaagctcctatactggattaaatgatgttgctgtgcccataagaaaggcaggtattgggcagtaatgaaggtatggcagcaggaatttatactttgtctctttcatcagagtagctcccccctcccctttttatcctgtaggaggaaattgtggagtgagagaagaggtctgatctgtttggggaaaaagtatcacagcctattagttagaagcaatgaaattgagacagctttgggactccattaagtgtgtggtgtttaggcagactgtgtccctgggtaaagtgtgctgttgaagaggatagtacacaatgaaataattgggcttgggaaatcaactgggcttcagcagcctcatatctccttgtggggaatgggtgagggagctacagctttccctcccttcttttagcataaaagctataccgaataaaatagaagggaatttcttgctgagtagatggactgtgaatatattttgaataacacaaacaatggagataattaaattttgtctggcacaggaaggattcagagcatgtcacttggaaccccctcatgccatgttcttctctaggcgtctggatatatggttgcagcaactgaataaaaataactcagatttgatcagtaatggcagcatctatagggacatgttttaatgcactgatgtgtatgaaattaggttcttaaataaaacattattcctggatattttcatttcaaaggataagctgaaattcacgaacagtgtgaactagactgacttttcccactgagatttactgataggcaaacttttgtgcacattgtggacactggttgagggtaggctcactagttttggtactattaatggtcagttgcctgtagaacttgtgaagtaagaaaaggtatatctatagcaagttcaaggttcagataattgttgttctctcttaagaaaaaggttttgagcggttgtcttctttacacttagtgtatgtaatgatagtttggctaaatatgaagaagaaagagaaatagcattactactgtttattaataacttttctttgtgccacacatttagctattcaggcactttgtgtttgtgtgtatacatatacattctcttatatacatttgcgacatgtggtaaaaggccctactttttggagtcagaaattgtgctcatttctgtatctgccaccttgtagctgttggctcttgaacaacaactaagcctctactttgaacatcaattttctcagtaaaatgagggaactagactaaatagttgccaaaattcttagtccacacacacacacacacacacacacccattttgtacttctaaagacactggaaagaagtttacggatggaggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaatagataaaaccacaaagatggggaaaaaacagaacagaaaaactggaaactctaaaacgcagagcgcctctcctcctccaaaggaacgcagttcctcaccagcaacagaacaaagctggatggagaatgattttgacaagctgagagaagaaggcttcagacgatcaaattactctgagctacgggataacattcaaaccaaaggcaaagaagttgaaaactttgaaaaaaatttagaagaatgtataactagaataaccaatacagagaagtgcttaaaggagctgatggagctgaaaaccaaggctcgagaactaagtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacaccacaaagatactcctcgagaagagcaactccaagacacataattgtcagattcaccaaagttgaaatgaaggaaaaaatgttaagggcaaccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatattctttgaaaccaacgagaacaaagacaccacataccagaatctctgggatgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaactcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagacatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatctctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaagaagtttacggataaaagaatgagaagtagactgacattgtacttttcattaacgtgttgaatgcctaaagaatggaaggaaaataagcttaaaattttgaatctatgataaagaaaactattgattaaccatatgcatatttgacattaaaataattcataattaggactaacagatttctggcttaaaaaatctaacaattactttaagaagcaaaagacatttccagaataaagtagggggatatatagaaaagttggtaccttttttaaacagagtcttcttttgtaaggaagtagaatttattcatcaaaggagatttatgaaaagtatggtggtatagtgagtggcctcactagttttaatgattgatatttgaatatagcttagtcttataacaactccccaaataaaaatttaaaattcatttgtatccctttgattttcagtgctaaaaactagattgtgaatgtcaaggaaatatttaagttatttctgaactaatgtatttgtagagagaagaagggagtgtgcacgtgatcgagaattatgttttgaaaataaatgaatgattggctattaaaaaaatttttaagccttaaaaaaaaaaaaaaaagacactgtataaatgttagttgtttgagcatttttgtatatacgtgtatgtccacacacatatacacaacattttaaaataacatcagttattttccctcttttatgtttttattttcctaataattcataccagtgatgtaagatagtggtacccagaccccataatctaagaggaatttgttgccatttgaacaaggaatgtgttgcctcattcatattttcaaaaggatataaatacattgttgtatatctttaggggaaatatatattcagtattttaaccagagttctcactgctgtgttcccacattgttaatatcaggtagtttgcctagatgttcacagtagaagtacagggatgtagaaacatggtctttcttcccaaagaagtcatttttctttaaaatttgtgaaataaatgaattaattgagtcagcctttaacatagtaatccattttgcattattcagctttgattgaaagagacagagaaaatatgttttgtcggggggtggggagaatgggagatagagatttctcagaattaacagggtgctctatagctcaataagaggccctgtatatacagcaggatagatttgtagttagttaaggaaatcttaagtctaaaggttgtaattcccttagaattcctgtaagttaattgtttttcccccactgtaatgcatacccttgaaaggcaggaaccttctgtttatcattgtatcccaagggcctatcataagcacctggtaaccaataaatgttgaactgatatatgaaattttcctgatcttagagattaagtattatcctcatggtctaggggaataaaacatccacacgtccaaaccatagtaattctgtttccatattctgctatctatgggtttcattattttaagtattctaaacttacagagagcaagactaatactttaaaattttattttggtctatagggaaaaaaaaaggttatttgagtttggtgactgtgtccatcactttggtttaccactgaattcacagcagatactaagaagtatctgcattgttttgtttggtttggttgggtttttaaaacagggtcttgctgtgtcacccaggctggagtgcagtggcatgatcatagcccactgcaacctcaaacccagagtgaatggatcttcctgcctcagcctcccaagaagctgggacttcaggaatgcaccatttgtgcctggctaatttttatttttttattttttgtagacatgggatctcactgtattgcccaggctggtcttgaactcttagcctcaggtgaccctcctgcctctgtctcctgagtagctgcaatcacttaatcctttaatagtcccaccaatctattattatctctgtttgacaacttatgaaactgaggtcagatagggcaaatgcagtcatgcaccatataacaacgtgtcagtcaacaacagaccacatatatagtggagatccaataaattataataacatatttttacagtacttttctgtatttagacacacaaatacttgccattatgttacagtactgtactacataggcaactatgctattcagtacagtaacatgctgtagaggtttgtagcctaggagcaataggctataccatagagcctaggtgtatagcagactgtacaatctaggtttttgtaagtatactctatgaagtttgcacagcaacgagatcacttaacaatacatttctcagaacgtatgcccattgttaagcaaagcgagactgtaattgacctaaggtcacacagttaacaagtagtgaggttttaaactaaggcctttgaccagtgctcttgatcattacagagtggtaccaacatggtagcataagctttaagaggagggaaaacttggttcccgtggctttatcagggaagacttcttagaggaggtagcagttaagctagcccttaaagaataagtcttatcttgaactgaatgtatgctagagtcagaattatagaggattagattcagaataaaaggccatctgtttcaagttcctaatttgcagaggagaaaactgggatctgtgaggttaaataacttgttgtaggacatatggctaattaagtggcattagaactgttctcttccctcctctatcctgtgttattccctgtccccctccgttaatgcacactagctcatgttaagtctgttttttcatcaacactttctaataagagttcctaaaaacattttacagcttgaaagtggaggctttcttgtgtatctatgtatggtgatgaggttaaaccaggaaagggtcagggcaggcatggaaggagatactagagatacgtggagacatggagagacagaccttttctatctgttttttgtttttttttcctagcattttactttattgttacatctgtttccttccataagtatagataattgagtgttgagagaaaggggacaaatgaaattctaatgagaaaaaaatgatttaaaattccacaaaatctatggaatttcagcctcttaagtaacctgggatgtttttaactttcactaatgtttattagccagtgtccttcctgccacccacctacaaggatgtctcaaggatgaaatgaggtcatatatgtgaatacacacttaggatacaactgccatgtattggcagtcttgtctgttccctgggcctacactgttccttgcctcaaaatgtagtactatcaggtagtgttgatgtttcattagccaagtggttatatcagatttatgtactgctaaacaattgatctgggacttgggtaaatactcattggaaaaacatttgttgtattctgagtgctccctgttaatcttctcctcctcagatagcaagctagatctgggacttaaggtggatttttttccttatttttttttcctttgttttacccaatgattgaaaatataaaactaaacctttttcagtaaagtctgaatcagcagatacttacattactttggcataggctttttatagactagctagaagaatacagtaattagcatatgcatttcctcattaaaatgtcattagtgaaggctttgttcttttaaggtccttcaaataaggtttattgcattgcattccatcactaatattttaccaggagtcagatatcttacttaggtgtgttgaagcaagggttactttggactttctatagggtaatgacctaagagcagacctggacacacataaatctctatgcttacattgggtgggccctactttatgtactagtaataattaccagtctcttctcacactgtccattcagaatcctttggatatatagacatttagcaaacctagacttgtttgaaagaataaactgttatctgcactaaactgttttccttggttatcttggtaggatttgatttgaaaaaaatgtatgaagaattagaagaaaagaaatttataatgtactataatcatttgagatacagtattatgcaggagtaagaatacaggctttagaatcagaccattgaggattcaaattcttgcttcatcatttactggttgtgtaactttgtgatacttagcctttataaacctcaattgtctgaatgtaatacggaaatatgagtggtccataccttataggaatgtttgagaattcagttagattatgcatgtaaagtatttagcactgctgcctggaatatatgatctattattacattaccggctgggcatggtggctcacgcctgtattcccagcactttgggaggccgaggagggtggatcacctgagctcaagggtttgagaccagcctgaccaacatggtgaaaccccatctctactaaatataaaaaattagccgggcatggtggtgcatgcctgtaatcccagatacttgggaggctgaggcaggagaatcgcttgaacccaggaggcagaggttgtagggagtcgagattgcgccattgcactccagcctgggcaacaagagtgaaactccatctcaaaaaaaaaaaaaaaaaaaaaaaccaacaaaaaattatctttataatagaaaaaaggagtgtgtgtattttcatatgtattgtatctgctttctacacatctttgacttaagaaatcctaacatgaaatttcaaaacaagtaagaaggtatttaaggagtggtcattaatatcattaattggcttaaggcaaactttctttaaaaagtcacacacatggtgtattcaaaataaactacttcacttaatcattttaacatttctgctatgcagcgtgactagcaacttgaaggagcaagttaggaaatgcctttgatgaccccatgacatcactatgttattaaataactggaaataaactgaaaattatgggatagtctttaaggctttcatgacatttcagcattttagggttgcagtattccaaggacttttagagtaattgcatgtcatcctttgtgtgttgtgggcaaatttgggttagctaaaagttggtcagttaaaaaaaatttatattaagcatctactctgagccaggcattgttcttttttgctgtgaatatagtgctgaacaagaacagaagccttgctgtcaaagacgtaacattccagggtaagaaaatagataactcataaagaaggaaatgattaattcagatacttgtgaggctatggagaagataacctaggctaacgtgatagagatgggtggtgaggatgtgagttaaggggaggccttttgcaggttgttgggaggagatgcaagtgttccaagcagaagaaagaagaagtacaaagtccctgatacactaacaatcttggtgtgttcaagggacaggaaaaaggccggtgtggctggaatttggtgttcaaagcaagagaggagagataaaggaagatgagtcatgcagagccttttgaaggctgtgggtaaaatgtatgttatacggaacttagttctaaatctagttgcagtggattaacctggagagtgatgcaaactgagttttactctggaaaaacactgtgactgttgtgtggagaatatgctcccaagtgtagaaactagatcaccttgcatgggccaagagagatggtggtagtttaagactaggattgtagcagtgaaatgtaaagtggttgcattcggacatattttggatagagatttgacaggaggtaggtggattggacatgggatgtaaagtaaaaagaggaagcaaggatgacttccaggagtttagcttgagcagctggatggctgatatcatgtgtaggcatagggaaaggttgtatgaggaagaatttatagggtgtgagggtgtgaagcagggaataattttgttttgacatgttatgaaagaaatgccaattgacggctaagaaaagatgtcatctgggcaggtaaagaatctaggagattgggaaaatgtccagcgtggaggtataaatgtgaaaaccatcagcatatgggattgaaagctatggggctgtttggattccctaggaagagaatataaataaagaagggggctgagaacagagtctcatttataatatcctgataaggaagaagacccagtgaaggagatgaagaaggagaagccagtgatgtaacacaagcatggatcatggcaaaagagaaaaaggtgtttcataaacaaggatgcttggtatggccacctgtgtcagtactgtgaagttgaatatgatcaggacaaataatattaattggggctttatatttctcctttactacaaccgattaatgaaacaaaaaattaacctagcacccaaggtgtttcttatagttggtctctccagtctgttttagtatcatttgttagttatttccccaaactaatgtttagcttctttctccaaaaagaatatattttttttcctggttctgcttgttggaatccccccctccaccatgatataaaagtaatggggcttattgtaagaaaacagaaaatacaagaaaataagggacaagatttttaaaaatggattcaattctgggaacaacaaatgacattggggtataggaattaaaccgtgtgcattctgtctctcaccccaattttatagtcatttgctggggaccttttctccccagggtacttgcatagcttttgtcaagaataacccttctcacttccccacctccttcttctacatgcagatgcagcacttttctgggtaaagttttagcaatgccttccttctaaaatgaaagcattttctcctcacgattagcatctgtttatagaatagttcgtattttcgtaattagatcctgcatagaaatgcaaaggctgctgtgtaaaaggataatgaatctttattgcacagttgaaatcagatttgtgcaaaaggcactttgaaaacagtaataagcagagacatgtattaaatcacccagataaggcacccactttatattttctatttataaatggaaattatgactacccagtggattccatatgacatttcctattaccagcaaaggtttttagctttgaccataaaagttatctaaattcaaaagcctctgtggattcatggctctaagaatacttctggaaggggccaagacagagtggaaagggtcctttgtctttttcttttgtgtgtgtatgcactctgcagaggggaaggttagcaagtggtagaagaaagaagccatttgaaataaccatgataagatctaatcaggaaacccagtgtccattacacacatgtggtaacattttaagactcttctggttgggctccttgagaaccaagctcgtgttcttataagctcatccttatattttcccattgtatgcatcgttgcatggcaaacacaggatttattcccaagctaaacctgtctcttggggtttcttatcttttacctccttggtgagcctcgggaagctagagcattgctctatggagaaaggagggtggcattgggaggaagggtaggaaaaacattattgggaagcagagaaagtcaatgtcaaatgaactgccaaggatgaatattatggctgctgggagcctcggagagtatcgtgtgtcttatgtgtctatttcacagtcggtgcttcatgtgagatggcagtctcgcctggaccgtgcttagtatcgatttactctcaggcatgccagaccattttagcattgctgaaggaaggaaatcctatgtatttccccttataaacagacatatcaaaagtgtatcttttaaacctttttctttctgtcttcttactgttctttctgtcttactgtaactcctcctccctccctgatttaaaagaatttttttttttttttttaaaagaaaaaagactttctggccgggcgcggtggttcacgcctataatcccagcactttgggaggcagaagcgggcggatcacgaggtcaggagattaagaccatcctgattaacatggtgaaaccccgtctctactaaaaatacaaaaaattagccggatgtggtggtgggcgcctgtagtcccagctactcggaaggctgaggcaggagaatggcgtcaacctgggaggcggaggttgcagtgagccgagatcgcgccactgcactccagcctgggtgacagagcgagactctgtctcaaagaaaaaaaaagaaaaaaagaaaaaagactttcttattaagagagcattatacaggccaggcgcggtggctcatgcctgtaatctcagcactttgggaggccgaggcaggtggatcacgaggtcaggagatcgagaccatcctggctaacatggtgaaatcccgtctctactaaaaatacaaaaaattagcggggcgtgatggcgggcgtctgtagtcccagctactcgggcggctgaggcaggagaatggagtgagcctgggaggcggagcttgcagcgagctgagatctcaccactgcactccagcctgggcaacagagcgagactccgtctcaaagagagagagagacagcattatacagagaacaaattgagtagacttttttagaatgatagagtgtcagtaactactcatacctgtgggggaaagaaaaaggcttcaaactttgcacacttctagcccttccatgaaaatagaaggaccttatttgaggctagttttgtggtggtgggatctgagcactgctgagtgttaacaaaagggaataaattgatgccaaatttagagaccaaaaatgccatcattttcacctgcctgaactcttctgttgttttccctagttgctgccttgcgctttttccgcagtacagggagagaaatcagttgtctggctgtctaaactcacggcatctgcttagcagtttcaccagctcatagttgggactcatccctctgtcagaatcctttgctccattagaagggagactgggaccacgttcctgaattgatttgcatacttctacgttacctagctcagacaacatatggccatgtggagcacttggatttatttctgtttcctcaaattaaattcctaaaaaattggataactccacagtttgtttggtgttacaaaaaattttagttccttttttggtcggcaaagcaacacaattttggcattaaaaaaaaatctctggattactttaaaaagagtgttgatttgatttgcttcccctcttctcttacccctttcaggaaaaaaaaaaatgtatgttgaatcttaaaacactgcatcatgttgcaaaatgtccatttaggcacactgaatagaaagtatcatcgagtcatttttattcttgtaattcagtaatcttgtatcttttgcctttttctttttccttaatgttaattgtgtaactaaatgtctcaaacttgggacttttcactttacacatccatgtgtaaaaatacatagatacatacagtcagatagaagaaataagactcagtgttaatagatcagtggttggggtgggggaactatacttaacaatagtatgttgtacatttcacagtagccaaaagagaacaattcaaatgttcttaacataaagaaaagataaatatatcaggtgataggcattctaattactctgatttgatcttcccacattatataaatgtatcaaattatcacgtactccccattaataatactgtatatcaacgaatttttttaaaaaaagaaatagatatcatacaatgaataactggattaatgtgaaatgatagaaaaagttaccattttaggctggatgtggtgacccacgcctgtaataccagtactttgtgagtctgaggcagtaggattgcttgaggccaggagtttgagaccagcctggttaacgatacaagaccccctttctaaaaaaaaaaaaaaaaaagccaagtgcagcagcatatgcctgtagtcccaactactgagggcatagaggtaggaggatcatggatcactggatcacttgaggagtttgaagttgcaggaagctatgatcctatcactgcactccagccgaggtgacagagcagcaagaccctgtctcaaaaaaaaaaaaaaaagttactattttaaatgcacttcaactttgaacagtactaatgtatgaaaatcatcttgtcttctttaggaaattctttgttgcctaaattagggataggtatcatacactggaatgagctctaaaacgatggctcttgctatgggaaacagttttatttgggtactcatgtcttctctcttaagggatcttaggaagaggctacatggtaaagaagaaatagcatgggctttagagtcaagaggcctgagttttaattctcaggctttatttgtccttctgcagtggccttagcaaatattataacctccctaaagttagagttattgtaattgtcgtacatacaatgttatcataagaaaacagtgagataacagatatcaaagtacctgggcagtgtttgacacttggtggtctataaatataaatatcatttcattcctgaaggtaactgcagcacttttgaaaggctggtttgatgctaacacaggaggattagacctaattatatatttctaaggtcttagaaatggggagctaggtttttcagacaatatactgtattttgtttttcctcccttttgctttaaaacagaaggcaatttgtttcaaactctgtgctccaaactggtggcttaattaggcaagtttattgactgtcacagaggctgtggttaaaaactggcaaatatcatgtgactatattagtatctctgagcaaataaagggaaaagacaggattccacccaaccacatttttttctttctcttttctcccaagctcattcttgcactgcaacattccacttataatctgttaattaaatcatttcactccattttatataatttttaatttagcattcattttcaacttagcttttggcttcatttactgataataaacagtgttgcatacaacacatgttccacaaaacactcagtcacacacatacagatgccaataattttttccagtatgtcaggcatattaaaattaaaggcagcatctcccctcaccctttccattactgaatgtgcaccctgtttgaataatacatactccccgacagccagcagtggtctaatgtgtaaaaattatgtgtagcgtgtcactagtacctttttttaaattcgtggttttctcagacatgctctgtggaaggtttctggaatggtcacttcgataccttggatctgtatatttggcttaatgtatacaaacagtaatattttctagacttattactttatgggtttatagctatgtgatagttattgagaaagaaaactctagtgtagcattcaaattacttttcttgtagcttattttttgaatcatagtctgaattctaaatatatgaatatctttaaccgtagatgatatccagaagtttccaagactgcaagctcaggggtttatggaccacttttaaaagatagatactaagccaggcacagtggctcacgccagtaatgccagcactttgagcaagcaagatggactgatcccttgaggccaggagttcaagactagcctgggcaacatactgagaccccgtctctacaaaaagtacaaaaattagctaggtgcggtgacatcttttagtcctagctactcaggaggctgagaggagaatcactggagtccaggagtttgaggctgcagtgaggtatgatcatgccactgcagtccagcctgggtaacagagtaagaccctttctctaaagaaaataaaaataaaacatagatacctgtgttgttgttatagctgttcatatccttagaattaatttaccttgtctgctcctgcatattatttgtctcctcataattagcaaagttccacagggccagatatcaccaaatatgaatagtagattttattctaaggtcagtgagaactgaagaatgttaggggctgactcaatcagatttgtttgtatttatatttggaaaaatattactctccggagaatgttttggaatgtttggcagggtggttggagagacatactacaggaaagaaatgatggtaacttagttggcagtgggaaaagtgagtagtgaattactcagagctctttgggggtgaaatggactggacttatatcagttgaacttgagaaaaggagaagcatcaaggatgatgtaacttttaggtttctggcttgagcagttgtgtaggtggtagtaatttttcatggtgaagatgatgaaatactttttgtacctgtctcatgattgctttctgtacatcaaggtcagaggtcataagctcataaaatgcttggtattagaattcttacataaaggatgtcttctgttttagtttagtaatacaatttggcttaaatcacagactttctctaatctttgttttgattgtcatctgccgagagcttaagacagcaactcacaggttggcccattgagaatctgacaaatgaaaaattataaaaaaaattcagaatccctatattgtagcccaactttctttagcacttctatccttgaatgctagggcagtgttgtatactgtgaagatctttgtagatttttctactctgtaacattttaatagttccattttggggtattacagctgttcagtcctccccatacctcaaattatagttagtctccttcaagtcccaaatttccagtgtacatatgtttcatcttatgtttaatctggacagagtgttggaacgaaatatggaccctgaaaggtgtatgacgggcttgaagtctcagccctactacttgcttaatgtttgatttgctaatccaaacaattataatctgttaattaaatcatttcactccatttcatataatttttaatttagcattcattttcaacttagcagatgctcctggtgtcccacccatacccctctttcccttccactttagttcacaatggccctccttcctcccgctaggccttatattcattcatcttcagggtttgtctagtcaatgaattctgctttgcctaaggagtaggcaggaagtaggtgaaatgaactgctacctgagcaacccacagtcaatgactaatgagagttgttgtataaatacaccagcttccttgcttcttaagtgggataactttgaggtatacattctacactggcttccggagtcctcccagtggcatttgcttctagttgcccatagtggtagttggctgaataattacataccctttattccctgtctgctgtcatgatcttactttcccagtctcctgctattgtttacctcctaaataaacttctcattgtctgcttctgggagaaccccagactaagacaaccactgcgaacattggtttcctcatctttatttattattactgttttttgagacagaatcttgcgctgtcacccaggctggagtgcagtggcacgatctcagctcactgtgacctccacctcccaggttcaagcaattttcgtgtttctgtgggacgtcttacataggcgtattttttttttccggctactaccactatttggactaattattctgaaattttacttgccaagtttcagcttttattagcaagaaaaaatgttatgtccacagtttagaataaaatcacagagaagaaaagttggatgaggatattggtttgcagtcttctgtctgtgtttctgtcttctgagcattcacagatgttcctatccttctttccactggtgttcacataacctgggatcttgtgttgtatgcagtcactctcaaggtaggaactggaagataaagtatgtgggtgacatggactacttagaaggaaactgaagtttacatgttgagcccaattagaagcagctgaagagaggagagaaaaaattaactgagaagtttaataggcacttagagcatggcgaataaagctgagtggcacccacttttcatttcctagttcattctagttgtgcttttttaactgcaaagactaaaaaacgaaagcctttatttcccagtctgtcttgcagctaggattctgggtgtgaatcaggtatatttgctcaagatttggaaggtcgacatgaggtaaaggttattcatcttcagctttagctctttttatctgattagccagggcaggagaagtatgatttttctgtggtgatgtttcagttttcaactcagcttcctagatgttgaaaggcagttatgatgcgatttcctgatcccaggttgcagcttcgctagtgcatttgtagctgggctgctgcaacaatggacttctgtttatggcagaagaaaggccatactttaaccttgtctagtgattttttgtaagaggttggttctctgtattaaatcacttcctacagaaaatttcttaagtgttttctggtttttgtttgtttgtttgtttgtttttaccagaaccctaactgatatagatggttgaagcaaactttatgctgtaaaggtccagacccagataaaaacgagagacaggaaagatgcagcaagatggtctgcaggcctgcccatgcatacactactccatgatctggtgtctgcaagaaaacaaagcaactgctcattaagtaacagggcagctaatgctttagctcttgaggccctgtgtcatataacttctaattcctctaattcatccaccaagggggcagtgaggcagttctctgtttgaatgctacatcgtttctgacttagtgctttgaagtggatgacatcttacttttttttcttatcttagagataaggtgaacagaggaaaaggagaatgatttgcccaacctttggctaaaggagaaaggaaagatttagagtccagtgcttctgacttccctctgatgcggtaacaaggataatatgagtatctaatatgctggggcacagtaagatggctctgaaggtatgcacagtagagaaagccatggtccttgccctcagggtctgtgatcggccactgaggcacacatttccacttcctgtgttccattaattatgctaattttccaacaagccccagccccacctctgtcaattatttttgtctcagccttctaattacaacattatatgaccattcagactggtactaattaaatcattacttaattcacaaagtgtgcgataatgctaatgcttcttgtcagctgaaattacaacatggcacctactttcttcattcttggtagatggggccagggggttgctcttttaccaaacatcttttgcttaccctctgatagccacctgaccatcagccagaacctaccttcttccagaactgggaaaacagtgcagtagacctagcgatatgtacctgtaattcatcactatcatatgaaatcatcatcccagttttgtttgtggagtaaatcttgatactcaagaaaaaaaaatagtagtaagatttagagtactatttgctacattttttgtcatttgttctgcgtattatttttaacagagtaaacagtagcttgtctctttttctcatttctaaaacagatttgttttccactcaattagacttgtgatcacgagaacacaaagtagtatttttctccttctggagagagacataccgtatgatgggcaaattgtcaggaataattataccaaatgatggaataaaatccaatggaaaacatctctctcattgctagtgatacatttttatttaagacacaatgagcatcaagcacatttatgacaaggtgaaattgacaagtggccctctgccatgattttatttttaattgctagtaaactaattagccagaacaacatgttgtataatccacaaaactgtcgctcatgcgttctccaataaaagcaagatatatgatgtggaaaagttctctaagagctagccaaaaaaaaaattatttcagaattttgagtgtatagacatcacagtaaaagatgtctcctcaccagtggaagaacatttgtatataacatttgttttgagatctgaacagaaattaaggacaaacagtaaatttttttcttttccttttttttttttttttgagagagagtctcgctctgttgcctaggctggagtgcagtggcatgatcttggctcactgcagcctctgcctcccgggttcaagcgattctcctaccgcagcctctcaaatagctgggattacaggtgcttaccaccatacccagctaatttttgtatttttagtagagacagggtttcaccacattggtcaggctgatctcgaactcctgacctcttgatccacccgcctcggcctcccaaagtgctgggattacaggtgtgagccactgtacccagcctgttttttccctttttaagatcaaagtatgcatcaaaatagccaaccactttcttacatgtaattaagttttatgtagttgagtcacattaagtctaagacatacattctaggactaagactttacagtcattcagtagttacttatttgtgcaaggcttggcaaccttttcctttaaagggacagataatacatatttttgtctttgtgggctgttcagtctttgccacaaccactcagctctgatgtagagcagccgcagtcatagataacgcaaaaataaatgtggcagtgttccaataaaactttatttatggacacaaaaatttgattttatgtaatttttatttgtcacaaaagataattctttgatttttttcaatcatttaaaaatataaaagccattcttagctcatgggttatacaaaaggcaggggtgtggatttggcctacaggctgtagttgccaacctttcctctgtacctgctgcatgccagcgtcactcctcattctttagtatcagacgtgtgttaggcagggtgctaagcatcgagggatattcagagatagagcaaagtcccttccctgatgaagcttacagttaagctagaaaggaaccatagatgggacagagacacataatattagatgttaaatggtgtccctctgtgacaaaagccaccattgctttacaagtttaagagagagggaagtcacttcagctgatttaggtgatctgctaagtaagacatgacctggctagctacggatgcatggaaatgatgggatatcagctggatcctgaagaaaaaggctgtggacctttgaaaaggtaacagggcataatgcctccttttagaggaagggggaactgaggatggcgaaaatgtcaaccatgagtcacttattcctatcatttttcccccaattctttctttcatgtcttctcatgaaaatttcaaacatatagcagttttaaagaatgttacagttaatacccaaatactcaccatatagattctaccattactattttgctatactgttttattgtatatctatcctatcctcttttgttttagaattctggtctcgctctgtcacccaggctggagtgcagtggtcactacagcctgcaactgctgggctctgcctcctgagtggccaggaccctatgtgtgtttcaccaccatgtttggctaattgtaaataatgttttgtagagatgaagtctcactatgttgcccagagtggtctcaaactcctgggctcaagctgtccccctgtctcagcctcctgcattgttgggattacaggcatgagccaccacacctggctgctttattatatatctgtccttctgtctattcattaatccattttatttttggtttattttaaattaaatttcagacatcaagatacattttcataaatatttaagcatgcatatcattaactaaaatttaatgttggcttatagtttttcttcttttggtgtaaaatttatatacaattaatcgtaccaacattaaatgtacattctctgagatttggaaaggctgatccttttgtagcctaaattggaagatacataaagttttcatcacctcaggaagttccttctgtcagtccttgcccccagcctacccctggaggaaccactactctaattttctctgctttaggttagtttgcctgttctagaatttcagagaaatggaatcatacagaacctatcattcggtgactcacgcctgtattcccagtactttgggaggctgaggtgggcagatcacctgaggtcaggagtttgaggccagcttggccaacatggcgaaacctcgcctctactaaaaatataaaaattagccgagcgtggtggtgggcatctgtaatcccagctactcgggaggctgaggccggagaattacttgaacctgggaggcagggattgcagtgagccgaaatcatgccattgcactccagcctaggtgacaagagcagaactgtgtctcaaaaaaataataataaataaagaatctatcatttgggtttggctttttatcatcatatattttgtctttacttgcttagtatctagcaagaatataaatgcaattattttgccagagaaaagtatatgtttgattaaggaaaacataaaatacaactttgtttaaatatctgtatgtatattcttaaattattgtaaaattaaattacctatggattaaatttttcacattaacattacttagtctattatgctccagcattttacatatttatgttatttaattaaaatctttgcagtagatatttcccattttgaagaagaggaaactaagacagcgaataaaataataaacaatattatttcttacctcttactgttgccacttcagtgtcagggaggaagagggatagcaaatgtaggaagggtgtttgcaaggtgagtgaaggtgaagctgctttgttacaagttttcttatcaagaaatggatagaacataggagtagagaagttcaataggaacatgcaaaatttgtctattgtaaaagaaggaagaaaactggagaatttaaggactattttttaacatctatgattaaaatattatgaaacaatatctttttaaaaagtgatatttttcctctagtataacacaagttgttagaaactaaggaatcaccctatcttctttagtaaaagcctacaactggtagagtttttttttttttaaggatctcaagatacttcatgaacctcaaaagactttaagttctctgcaatgttaggaaatgacttcatgaatatcacagttcaaggttctgctactgcttttagaagcccccaaagtgtgaagacatctagtacagtatacagtaagaggagaactggcttttattgctcacaataggaatgttcccatctatctgtttgcaaaccaactcataaaatatttgaatattcttcactctgctttatgataatatttcttggcttggaaatttgctttttttttttttttttgagacaaagtctcgccctgtcacccaggctggagtgcaatggcgtgatctcagctcactgcaacctctgcctcttgggttcaggcggttctcctgcctcagtctcctgagtagctgggattacaggtgcccgccaccacacccggctaattttttgtatttttagtagagacggggtttcaccatgttggccaggctggtcttgaattcctaaccttgtgatcctcctgccttggcctcccaaagtgctgtgattacaggtgtgagccactgcgcctggctgaaatttgcattttcattaatagatcatccttatttaacaatgaacttcctatgtgtttgtgacacatggaaaataagtaggcagcatttaatgtcatttgggaagcagtgcttatagtagttcggtttacattcctcatacagccatgtgccgtatagtgatgtttccatcaatgactgcatatgcaacagagtcccacgagattataatggagctgaaaaattcctattgcctcatgacatcatagcctggtaaggttatagtgcaacaaattactctcacttctgtgctgatgctggtgtaaacaaacctactgcgctgccagttgtataaaagtacagcatatacagttatatacggtatataatacttgatagtaaaagactatgttactggtttatgtatttactatactgtaattttacacttattttagtgtagtccttctactagttaaaaagaaaaaagttaactttagaacatctcaggcaggttcttcaggaagtatttcagaagaggcattgttatcataggggatggtagctccatgcatgttattgcccctgaagaccttgcagtgtgacaagatgtgcagctggaagacagtgttattgatgatcctgttcctgtgtagtcctcggctagtgtgcatgtttgtatctttgtttttttttttttttggttggtttgtttcttagaaggggtcttgctattttgcccaggctagtcttgaactcctgggctcagtggtcctcttacctcagcctcccaagtatctgggattacccacatgcaccactgcacctgtctgtgtcatagtttttaacaaaaacatttataaagtaggccatgtgcagtggctcacgcctgtaatcccaacattttaagaggctgaggcaggtggatcacttgagcccaggagttcaagatcagcctgtgcaatgtggtgaaatcttgtctctacaaaaaatacaaaaattaagtgggcatgatggtgtgtgcctgtagactcagctactctggaagctgaggtgtgaggatcacttgagctcaggaagtagaggctgcagtgaactgagatagtgccactgctatccagagtgaagccctgtctcaaagtataatacaatacaatacagtacagtacaatacaatacaatacaatacaatacaatacaatacaatacaatacaatacaatacaatacaatacaatataataccatacaatacaatttaataaaagaaaggttatagaatatggatataaaggaagaaagtatttttatacagctgtacatttttaagctaaatgttattaaaaaggattcaaaatttgaacaatatataaagtaaaaaacattacagtaggctaaggttaatttgttattgaagaaagaaatttttaaataattttagtgtaaccaacatgtacaatgtttataacatctacagtagtatacaataatgtcctaggccttcacattcatgcactgctcactcactcactcacctagagctacttccagtcctgtaagctccattcatggtaagtgccctatacaggtgtaccattttttaatcttttatactatatttttattacgtcttttctgagtttagatatgtttagatacacaaatacttgccatcaggttacagttgcctacagtattcagtacagtcacatgcaagtttatagcctaggagcaataggttatgctatgttgcctaggtgtatagtaggctataccatttaggtttgtcgaagtgtattctatgagttcatacaatgacagaatcatctaatgacacatttctcagaacatattcccatcgttaagcaacacatgactgtgcttagtcttctacacaggcttagtcttccttgttaattgaaactctatgtttcttctcagtttaagaagcttatttcaggactaattttcccccttttagaataagtttcccacatcacttggttacatgacaaaacaagttaaatcactgtccctttttgggtttaatatgtccagatgcaaattaaagaaataaaatcccttagatttttctgtatcttgtctcccttcctcattttctgcagaacagtttttaaaagttaatttaggaaatctccaaaatattagattagcatgacttcagagctataaggttcctgaaaagtttatgtagaaatgttgtttttagtgctttaatttctcttatagcatcttgatgggtagtcattctgcctaaaggagaactgaactcatcctgtgtcccaggagctttgtcatatgaaaagttgtaatccattctggtgcttcagatgttgaaggcccagtgaaattctacaagatggctgccacttgagctttggccttgcaagtggttaggaagatgttggtcctttaatctctgtacaggggttcagaagtagttgatagtttactaatgaaaaatgttatatgtagcaaaacacaagcaaaaaaatcaaaaacactgatgacttatataaattattaacttaaggaagattatggtacttgaaaaattattttacaaaaaaagattgtattaggaattttttctgctcttttttctcaagttagtaccaatgtaacatggctgtgttcatgtaatttcttttctcaatttggttcaagatttgtgtagctcccagtggtagattttgcggttgtattgcatgattaaagtgtccatcaaaatcttacagttggtaaacagtattaaaaatccatctccagcctctgtaaactgtacagagagctatgaatactagaagaaatggaagtattttaattaacccaagtaggactaatcaaagcagagcaaccagtttattcaattgaacatgtaaatgtctattcattcttgacatggcagaacatttatgtcatctattaaaagctattctgttgcttgtatgattataagctattgttcaacggggaactgaatcttgtaaaggcttccccaccccactttttgtttttttgagagggagtctcactctgtcacccagtctggagtacagtagagcaatcttggctcactgcaagctccacctcccaggttcatgccattctcttgcctcagcctcagcctcccaagtagctgggactacaggcgcccaccaccatgcccggctaattttttttttttttttttgtattttcagtagagatggggtttcactgtgttactcaggatggtctcaatctcctgaccttgtgatccgccctccttggcctgctgaagtgctgggattagagtcgtgagccaccatacctggcccccccttttaataattacatattacagattattttttaacatgctttttgctgtattcaggccacttcagataacccagcttcttgcatgaaagaatacagacttgggtaacttggttcagctaccctgccatcacctctttccttcaaagggttttctcttcttcatttcttcataataattcttagtaaatatctactacatgctgggtacatgtattctaagcatgttatatgcagtatatcatttaatttttgcaactatattgttattttttccattgtatgatgaagacatggaggaagagtgttgcatagtgctgtaagtggtagaaataggatatgaacacaaatctcagaagatccattgtgttgaaatgaatttgagttgtaccaaaggtgattgacattagacaccaggaagaaatttttgaaatgagtggatgctctaaggagccttttaagtgagtacagctaaaaggggttggggtgaaggtagtttcctgggattttttattaccattaagacacgtaaaaacagtttgtataaaatcccatttttcatgaattagttacattcttaccttgagccaggaagttaaactagatggctgtctgaagacccgggtaatacatttaatacagtcttatatgtgtataaaaagtggaaacaatgattcttttaacttttaaatatgaatttttattgcaacaacaattagaaaatataaataatacttacacccctgccattctaatgtaacacttagttttgggcctacttttttctggtcacttttctcatgcatttaaaaaaaaaaaaacaacctttttaaaggttttaaaaacgtttcttaaaatgtagtgtattatatttatgcccaaaaatctatccatgttaagcatataattcaatgagttttagtaaatttgcagagatttgtaaccatcaccacaatatgatacagaacatttgcatcattccagaaaggttcatgagcagtctctcttcttctccattctttgatttcttaaggtggaagtgtctgttactggtttactgtttcttcctttccaacataggtgtttatggaacttctttagctgaagtcatgaaaatttgtatattctatttttatttctattccgttcaaaatatcttctgatcgctcatgtgattcattctcttaactcattggctatttagaagtctattgacatatttcaaaatatttgtgaatttcccagattttcttgttgtttgtttctaatttaattagcaatacagaaaatatactttatgtgatattagtcattttaaatttatagatagttatggcctagcatatgatctattttgatgatgtaccatgtgtgcttaaaaggagtatgtactatactcatttggggtggagtgttcttaggtcagtttgtttgatagtgttggtcaagtctactatattcttgttggttttctatctaggtgtcctgtttattatttagagtggtatatcacagtctccagttatttttgcattgtttgtgtctccctttagttccgttagattttgctccatctgtttcggggtttgtagttaggtatatccatgtatatcattgtatcttcttggtgggtagacccttttatcattataaaatctctttgtctctagtaacagttttgctttaaagtctgttttgtcggacagtattctctctcccctttattattaaactacatttaatttgtattaaactacatttattgttcacatactgtttttcaatcttttttaaacttatttttgcatttgtatgtaaaatgtatcgcttttagaaagcatatcattgggtctcttttgaaaaaaatccagtctaacaatctcttttttttgaattttaaatttatttatagttaatattattattgatttgattggatttatgtctccattttgattttcatctttttttgttcagttgattttcctttactgcttcttttgtaactaaataggtgtgttttagtgtatcatttttattacttagttcatttttgctctatgaaaatatttttttctgaatgggttagggtttatacatgcattctaccttaacacagtctattttagtttaatactgactttgtattaaactttgtcagtttaataatgactttgtattaaagtctgtgcagtagtatgcacaaactttgcttcactatagatccatgtcaccatcttttatagctattattatcacatacatctatatatcttatatacccaacaatgcagtattgtaattattgctttgtataacctatgcttaaagaagttaagacaaagacaagaaaatagaaaaatgtatgtatgatttctttcaacatataaaaacctatatgcttactgtttccattactcttcattttttaaatgtggaattgatttatggcttggtagcatttctttggcacacataactatattctttctctctttctttgtgctactattattatatatattaatctttctatattatatgtcctacaacacaattttacaagtactgatttatgtagctcttttttaaatcgttagagacaagaaaagacaaaaattatatagcctcctatagttacctacatagttacctttaacaatgtttatttttcttcatgtggatttgaattaaggtctgttgtcattttgtttaatcctaatgaactttatgttttgtaaagcaggtgtgctaacagtgaattctttcagtctttaataggggatttcttaattttgccttcattttgaggaatatttttgctagatacagaaattttggttgacatctatttgtttctttgagcacttgaagacatcctcccactgtcttctgccttccattatttctgattggaagttggctgttcatcttattttgggtgccttgtacatagtgagtcatttttacccttgatactttctagatctcctctttttctttgcctttcaacagttatatatgaaatgtgtagatgtggatctctttgtgtttatcctacttagaattatttgataattttggaagtttagattaatgtttttcattaaattgggggaggtttttaccattatttcttcaaatactttttcagaacctttttctcctcttcttggaatctccattatgtgtgtgtttgttatatttgaggtgtgctacaggtctgttatgttctgtttattttcttcattttttccccctgttcttcagatttacaacctggatcaatctgtgttgaaatgcactgattctttcttctgccgttcaaatctcctggtgaggttctctagtgaattttttatttgttactgtactttcagatttcagaatgtccaattggttctatttaagaatttctacccttttattgctattctctatttgatgaattatgacatcatgcttcccattaaatctccaaactttttcggaaggggatctttgaatgtgtttataacagctgatttgaagtctttttctgttgagtccatcatgtaggctccctcagagatagtatctattgacttttttttccttttggaatggtaaaattttaattttttgcatgcctaatatttttgctgaaaactgaacattttagataatatattgtagcaactgtataatctgatttccccatctcttccctcacacatacctagagttaatggttgtttcttttttgttttttgtttttgcttgttttgggtttattactttagtttcttactggaatggttctgtgcagcatgtttccctcataatgtgtggctgctgttgtctctactccattgagtttgccaccacccttaccacttatataagcctagctttctagggaccacccctgaaatcaaaatagttgagtgctcagttaaagattggctagagattgtatctaaacacttagaacccctaaatcactgccttctgcttttatgatggatccataaatgatttggggaatgaatcagcagtcagcctatttaccagtctggcccaaatcttaatttttgtgttgtaaggcctcatgctcagcagaaataagtagcttactaaggctttctgcaggctctctgagcaagtgtgcagctttgtgcatatgcacagctttccaggccatcagagataagtaggatcgcatcaatgccctctttcagttcctggatctgcctattaattttctgactggcctactggtttgttgcttgcttcagtcagttatgagatttcagggtagctgcagtgttgtcctttcctgattgtttgcattaagatcactattgtttttgacaataccctttgtcatagaattttccacataaaatcagtcatttctaggatcagagccttcatcttcacagcacacccaccccgacagcacttctgcatcaggaagcaggggtggaactagggagtgggagtagcaccgcactaaagtgctatagactctcactgttgtcaatgaggttcggtgagttttcttgaagaaacacttctcagtttattgcatgcctttggtcaatttccagtgtcctttagagattgtttttgacaattttgttctgtttcattgtttatttttgtggcaaggatttgccaacctcctcactcagccattttggaaggtctgctgtcttgggtatgttgttgttgtttagaaacatacatgctacaaagtacactcttgagtatacagctaaagatttcttacatgtgaaaacacactcgtaatcaccacccagattaagatacaggacatgtccagcacccgttaatctttccttcctagccttctagtttcatcccagagttaaccactgtcctgacctctgtcattacagattactttttgtaatctgtgtggtttttttgttttttgttttttgtttttgagacagagtctcactctgtcgcccaggctggagtgcagtggcacgatcttggctcactgcaagctccacctcacaggttcacaccattctcctgcctcagcctcccgagtagctgggactacaggcgcccaccaccatgtccaactaatttttttgtatttttagtagacacagcgtttcgccatgttagccaggatgatctcaatctcctgacctcgtgatctgcccgcctcagcgtccaaagtgctaggattacaggtgtgagccaccacacctggcctagatatgaggtttttttgtttgtttgtttgtttgttttgttttttttcttgagacagagcattgctctgtagccaggctggagtgcagtggcgcgatcttggctcactgcaacctccacctcccaagttcaagcgattctcctgcctcagcttcccgagtagctgggagtacaagcatgtgccaccatgcctggctaatttttttgtattttagtagagacagggtttcaccatggtagccaggatggtctcaatctcctgacctcatgatccgcccacctcagcctccctaagtgctgagattacaggcatgagccactgcatccagcctataatctgtgtgtggtttttaaacttcatttgaatgaatatttaaaatatgtcctctttttcctctagcttcttttactcaacatagtaacttttgaaatttatccatgttttaggtgtagcagggatttttaattttttaattgttgtataatactttattaatagatatgccacagtttccttattgtgggacatttgggttatttccagtttgtggctattattaatgaagctgctatgaacatcctcctctttgtctttctatgagcatacatacgtacagttttaacgtggtcagcaacataatgcatgtgtaatttaggctcttgctcttttttttttttgagagacagagtcccactctgtcacgcaggctggagtgcagtggcacgatcttggtgcactgcaacttcccccttccaggttcaaatgattctcgaacctcagactccccagtagctgggactacaggcgcataccaccatgcccagctaatttttgtatccttagtagaggtggtcttgaactcctgacctcaggtgatccgcttgcctcggcctctcaaagtgttgaggattacaggtgtgagccactgcgcccagcctggggtcttgcttttttaaacttagcattatatcaagtgtttttccttatctctgtcattgtcatgacaagagtcattattttttcaggtaggtataccgaaagctatttccatttctatttttagaaaaagtcaaaggcctgtatttaataattactcttgacaacacaggtagcagttgatgctcaattcaataaatatttgttttcaacttttaaagaaaaactccagaatcgtatgctttttaaaaatagtatttgattgaagattaaacaaaacttactgctttttctgccccttgaaatgttccataactctatgcaattcacatattagtagtatcactttttaaatgtacaaaagcagacattactgagagccttggcctcaaaacattcatttgattgcctttctttaaaaacatatttcatactgggttatggaaaactcagcatttggttttggatataaataaagccatatgacctttcatatttaggagctgaatccctcttgtagaaacttgtgatgttgctttgcccactttcctaccctccctaccacgtcatccaacacatgtgcacttatgctcattcacatacacctcgcaggctctctgtgtcctgggacctacacttcacatagtacttggaaatattttctcttgaggaaatggatattagagttgcaatggtataggaactgtatacgtttttcctatctatactgtggtttttcttttcaaacattgtcgagatttctgatggataacagtagttgtgaaagacacaaggagaatgggagggaaaggaattgcttaatggacctcacataattgtgactatgactccaggtctgctgcgtttagaaatggaattgcgggcagatacatttgtcaaatttaacttaatcccttggcttttatctgatgtatatttttccattaacacagtatacctttcatctctactttcacacagtcaaacagcgtctaatttttggtggactttcttttcttcttttttgatgctaacattatccccgtagggtcctaatcaggttttagactatggagagaagaccataagaatcaccaaagcggaatttcccattgctggtaaagagatgcccaagatgcagaaggcttgaaataaatcgggcatgaaataagtggcgttacagccctatactggctttaccgcaagggttaaatttgctcagtgtctgcaatttcacctttcctgattgtcatacagagtgagatcattgtccaaaggttgatcatgtggaggatgtatgtgcttttgaagtgatcaaactaaaagagaaaacaaagctcatggctgaagtcatcacacctgaataccatcttgtgatgtcatggttttattggtatgaattctaaccaagctgtgggcatttaagtcatatttgtggatcagaagccatagatatttgcgcttctcataggctgtgcttttctgatactttgatcattattatatggtaactaacatatattaatatattaatgtattatatcatatttatttagaccccagtatggatactaaatgggataaagcatatgccaagattttttaggtcttgggattatttaatttttttagaactggcgttcattgattgtcattcacgtttctcttcacttccttatgaaaagtttctcaactcttctctcagtattttcttttcccctgtgagatatgtttccttttacactttttcattcctctaccaaatagtaataattgcaaacatttattgcatgtttatgtgtgtaccaggtgctatgccagttgtttttatgtgtattttctcagttgctgtcttaacggctctgtggtatttttatccttggtttacagatgaggagactgagcctcttttggtctctttccccctttaaagataaactcctcctatctccttaaactgagcttgtaacctggacctctgattcaacagcccacaccccaatttgtatttggctatttgtattgggctatttgggtggtggtcctttgaatgttgttgtgctaatggaggcctaaacgttgaatcccgtgaatggaaacctcttcacatctttactgcttgtcctgggatcttcacacctggaatattgatcttcaccgagtaatttgggaaaaacagaggcagaggctggaagctgctcaccgtcctatggcagggcaggtaatgtccttaatgagatgggcttattccagtggagcagtggtggggaagcaaaagcttggtgttctctcctcatggttgcgaaaatattcacataaaagattcactagctactgttaataattgaaggactttcctcaaaatccatgtattataacggtttaatatactaaaatgatttggaggaaatcggcctcagcattggtgaatgtgttgacatatgaagctattatttttataattcttattttagagatggagtctcactgtctcacccagcctagagtgtgttggcaagatcatagctcactgtaacctggaactcctgggctcaagtggtccttctgcttcagcctcctgattagctgggactgtagtcacatgctaccacccatggctaattaaaaaaaaaaaaatgtgtggagacaggatctgactatattgcccaggctggtcttgaactccgggcctcaagtgatcctccagccttgtccttccaaagtgctgagattacaagtgtgagccaccccacccaacctaaagttgttttaagcttattgtgtgcatgttggttgtgtcaccagccgggaggggcttataggctgcaacactgttttctttcctatactacctttattatcacgtaataactaaaatacgtactatctgtttttaggtggatgctctgcttctcttgatagatatgaaagcaggatacctatcttccacccctgtgtttttcttttttcttttcttttctttttttttttgagacagagtctcacactgttgcctgggctggagtgcaatggtatgatttcggctcactccaacctctgcctcccaggttcaagtgattctcctgcctcagcccaccatgtagctgggagtacgggcacccaccaccatgccgggctaattttttgtgtttttagtagagacgggggacgtgatttcactgtgttggccaggcttgtctcgaactcctgacctcgtggtccgcccaccttgggctcccatctactcagatgtcctgtcttcacaggggccctctttgaccaccctctgtaaaactgtactcatattattcactattctttaccttgaccctgtattttcttagcacttatcactattcgatataacattttatattcttcaccaccaacccagactagaatgtcaggtccctgaaagtgaggtatgtgccatactcaccactttctccccagtatccagagtggtgtgtggtacatagcgaaactcagtaagtattattgaatgaatgaatgaacacagatgactagaaaaatttctagaaaattttaaaacatgggcatattagccatgaatttaatttatagttttgttgttttcttttgggtattcaaaaatataatttcatttgtttatatctctaatgagatagtacagtatttgtgattcttctagtgtgatggcatgtacagtttcattggtgagtatatgtgacctactgtgccaggtggaaatggagtgaatgaacattttggggggaactaaaaagcaattttcaacctttttgataagctaggttaatactgtcttctcaataaaaagtactttttcttcctcttataatgttcatggtcttcatctgtatgtgtatattgccgatttaggaactaaagccgaaatggatctcagactatttcccacagactggtagctgtatcccctctgtcagcaagtatttgatatcttcagtgaaaattgtttctttttccacttttagcttctgtttagttttacaagtctaaacaatttttggcaagtgctaggggctcacctgatgcactttttaatgcattccactcctcgttgttattttctctgtccagtacacatggtgctccttccccctcattgccatcccactttggcagaaagcattatggatgctgtgtatgtagactcatcacccaagccagcatgcatgggagagggggcctctagaataataattgttacttggtgttctctgtactactctgtttaatctccctgcttaccacttactgccttcgtaaagtaagctcaatacaattatttattgcaatttgtgtagaatgtcagatgtggaacagactttgcacactcatcagatccagcccctttgttatttagatacaaagactgagccctcagagaggagtcttgcactagactctagacctcccttgggcaggggactttcttgttcactgttgattcctgcttgtctaatacagtgtctccatgtaataggtgctcaataaaaaatattgcatttttcaaagtctcatatgtaagtagtgatggcagggccagaacttgaaccttgcatctcctagttatttgttcattgtcactgccacaattatctcattgtagtttaaagagagtcagcttccagtcttttaaaatacaattacctttaattcatctgtggtaaacaaacagcagctgtctctcattggcatggccgcagttccaccactgagcaattctagaaactgacactattaaccattctgctaaaaaggactcttctactcatatgatatcctggctgtgtccaaagtgtaatatttaattgcattttcttaatctttaccactgtattgctaagctttctaataccttcaaaataccaaatctcaggcttatcctaattaaagaatctcaatttaatccataatgcatgacaattcaatttgttgattgctttttctccccctctttgtgaaattcccgtcaaatgtattaattcaacatgatgaatcctgtattcaacccactggagtgaataattaaaattagctgataaaactttcagcagaattactttgtgaaattgctgaacagatgtgtcattttaatgaaaatccacagacaagctccttctccccctcggcaggataaaaatattatcccctcggcacatacttaatttggtggtaaatacactcggagcgattgctggaagggaagaaaaagcaacttgtcacacttagtaacttgatttttccccagcatgcagtaacagctatctacagtaattcatagtgctctattgttgctgcaagtcccaaagagaacttattaaaatgcaataatctcctatttaaacagaaacaataaccattaaatttcctgtggatccaaaattgagcacaagccccatctggtaagagtgattagaggcctgatgagggaatttaatttgcaacattcaaagactaaatctgagcagatcttgtcacctgggactcgagtgctgcttgctgtcttcttaaaaatctcgacctaaactgaaaatggaatgtagaagtgaaaatgttacccaggggccacccccaacagtattgtgtttcattatgtctccagcaggcctagtgagcagaggggattttagtgctgtccgctttagctttgccggcaaggccttttgacaggaccaacactaatgctgtcatttcctctactgccctgtgcatctgtcatgtggctgcccctcttagatcgtggactgcctgctccctcccttcttatttactttcctcttttagcttagcaagtcctctctctaactttaagagttctctagatctcaccagtctccctttcctgtccaaggagtcagatgctttcagcaggctactttgagcaccactgtatcatgctttacattttatgtctcctccttgcctatagacagtaccccctctgagtttattattagtgttttttttttaactgtaggaggactaagatttattgcatgttattagtaaatacaaattgtcattttcctcctcttcttagcttttctcttacaatcccccaccttatttatattacttctgagctccagagaaacaagatatgcgtgcactcatcatcagagagatgtgtttctgtgtatgtgtgtttgtgtgtgtgtgtgtacatgcacttgtttgtgtgtggttataggcctgatcagacagatgtcagtttatcaattagtagaactccctaattaagtatttgctttgagcaatagagctcttattggttgtgaggtaacttggcaggagggaggcagttaccgatgtaatagagatgcctgagcagatagtttcgttgagcagatactatttgatgtcctttaatcatcagactcctccacttttccttcttctgggctcctgatttatccctaaacaatcagagcctctcctccataattttatgaactacaaaatttacaaaaatgttttacaaaccctctgcctccccagtatcttctccagcccccatgtcttggggcaggccacatcaggtctctctggctgcttcctttcccaggccctactacctactctggcccatcatatgtcttttgagaagatgatttttcagttcttttctttagtttagaaaatcagaattaattgattaatttttaaccccttctacctttctcctcccctaccatatgaattcatgcagagccagccctgcaacctaattttttttgttttgtttttgagacagagtttccctctttttgcccaggctggagtgcaatggtgcgatcttggctcactgcaacctctacctccggagttcaagggattctcctgcctaagcctcctgagtagctgaaattacaggcacccaccaccatgcctggctaattttgtatttttagtagagacagggtttccccatgttggccaggctggtcttgaactcctgacctcaggtgatctgcccacctgggactcccaaagtgttgggattacaggcgtgagccaccatacccggcccctgcaacctaatttttaaggagaggtggtaaggttcattccatgaatcataccacttggaattcttgaaaaattaattgcatttattgcacacctactctctgtaaggcaatgtacataagaatggaggagatactaagaaaattgagtcccactcctattgccgatcgggaaagtacggcataagcacatgaatatttagaggtcctgtggtttaagtaacggtaggtaaggaatcattgggccagatgggatcagtgactcactgaatattataatcagagatgtgagtgcagaataaggaggagatatgactggggactggtgtagttcttagaggttgcctgagctggctagcgtgacattcctactaagcaatgagcctagcaaccagaatctcccagccccggtagccaaggagcacaggtggtaggctatagaaggagatttaatgcaacacagctgggttcaatatggtgcctctttcagagccctggctacaattgatgtaacctggtaactagtagctttgactttgatgtcagacacatctggttgtgaatattccctgaaccactcttaagagtttctcaactctttgagtctgagttttcttgattgtaaaatggtgtttgataatacatatgtggttttcatggggattttgtaaagtgcctggcatatggaaggagctgggtaaatgatggtagtacacttataatcttaagggcagaaggaatgaattaaatacagagtgaggcctagggactcttgctatgctccctcctgactccggtctagtattactaacatctttccagaaaccattcttctttatgttggttttggccctttgtgtccccatctctagccctttattcagttggtctgctcaaggcttgcatgccatttttggcattgaacatgtgatcctctagtttaatatagcatgtgcaatatggtaatttaagaaaataaatgtctgtatgcatagaaaacacagcatcctcctttaattcatgggtttatgggagattacagttttcttttagtttaagcctacaaagtgtttatagtaaaaaagtttcaatgaaatgatttccaatttatatttccttttcactcaccaccacaagtcagaaatcaaatcttatgcttagaagaaagcaactccaggactgtatccacttcgggttttgaataacaacagtaaggtggtctgactccaagattaggtccttgttgtttggacatatctaacaaggaactccatccccaagtgctggagaatccatgaagtcagtggtgtcttatgaagcttgagcaattgggaagccttcccagtcagctttttggcctcctctaggtcttaattacaaagcggattcatggtcctgcctgaaatctgattgagacatagactcctctatcccaaatgatatcattatcaacattggttccctgtggtacacatttgtcatattcattatgatttgtacctaagattccaggccacaataatagggtaagagtgtataatgggaaaaataacacaaatcgttttgattttctttaaggaaattcattgccttaacattacatacttgcctttgttttaaaactcactctatgccttatctaagaggagtcaatataaaagattttaattttagccccatatgctgtagctatatataaatgttctgtaaaatatatcccctagataaaagtacttactacttttttgaagttttttttaaaacctttcttttggtaaataaaagtctttttagctttgatgtgactattacacccttggtttgggttctttctccattccttcatccctagcccctgtgggacccctgtaagaaaaatgggaggggagagaagcatgaattccttaataagtcccaaaggtaatcaaaagaaagaaatgcagtatgaacaaactcacaaaatattcttgtgcttctttggggaatacttaatgcacataaggtcaggcctttgtaatgttaatttgagagtgttaggaagaaagccatcattttacaggcaatgttgctctctgaaaaaagctttgatttacagagaaatgctgttctaacacacctgcattaaaccagtgcctgccgactttgagaggcctgagttgcttgagcagaggaaatgcttcattgaggatgcttagggcatttggctgaagtggtaggaagtttgccagaggtcctattttcctgtggtcaaaacaacctgttcagtttggatatggtacagcccctattctttagacatgtgcagagtgacagcacaattccgcaatggcctcctttccaagattggccttagggagggaagtcttaccagacacagtggcaacatagttagtataggtatcttggttatagaggttagacatgaatagcctggtttccacctcaggtggttgcccgtgccttctcatcaacttgtaaacctccatactgtgtagaggagattgtgtggctagaaggaatggattcatcccaaacccccaaaacaggattcggataagtgaccatccagcctgcaccagagcattgccagagactggccattaattatcttcagaggcctctcagttcatctttggctctcctctctcatccatttctgtttcttccttcttccatccatacttcccctgctctttcctcctgccttttatattggtctgtattctacttttgggtgttatacaaatcagaaaacatttttatgttaaaacaaattaaatatgaatactctttgtgaagtgcctgacatgcagtaggcactcaattacttcctctcttccatcctactgtgtgataactcttctagtaattgagattatgttatcatgagactacatgaaaatattatcatgccccttctgagttaatcttattcaacctggtttctcatcccttcatcttcttagtctccctgccctcaaatagtccactgtgtgtgcacgtgcgcacatgtgagtgtatcttaaagtacagttttcaaaactagctgcacttccctatgttgggtctgatttgccaattttttatgaaggaataagcaaaaagaaagagagcaagagaggaagaggggagaaatgccgtgcttttctagaggagcaaatatatggaaattacccttgtttcttctctaaagtagtaaaggtcacagcagtagttgcaaaacccgtaggccgcctactgccttccacacattcagcattactattcttgcctattttacccttaggcatcctttatttcttgcacagatggtctcactcaggcctaacaaaatgttttaagctttgcataaattaaaacgaggtctctgagtacaaaagtgcaacttgttttttacttgaaaacaactatgctggcatcttttacaaaattacagcctcaagccaggtttccataatcagttttcctttaaaaaatagagaggaaagaatgtatccttgtgtgtgtgtgtgtgtgtgtgtgtgtgtgtgtgtgtgtgtgtgtgtgtatgagtatatatataatatatgtatgtataccaaacacaaatggtcctaatcaatgggattatggcttttatgatgttctgtgttcctttgaaggttgatcaggcatgagtggtggatgattcagtttgaataaatagatttggaaatattattttgggggtccaggatttctgagtttcttcattagtttagtacatgataacaactgttgagacatttcagtgtgcggagactccctcctagaactctttactatgtaccttataacagggttttactcaggctaaccttgactgtgctcaattgaaagaaagtgatgagtcagctcaaagagaaatagtctgtttctcccaactctgcgataatgtgtcccaaagtagtgacacatggcatattccattcttaagataactggcagacaatttgtacaatcttctagacacattgcttccctttgattcacacatcatcaccaaaagggtaatgctacaaatcttttctctattcatgactactcttaacagggatatggcttgtaaagaagcttattgatgtgctttgcttgaaatagaatcattagactgggcctgccctctcatttttaccttgacagtaatagtaagagtatgggagatactcttactcttattattactataactataatagtaatactattacagtatagtaatactattacagtaatagtaagagtatgggagatactcctattcttactgttactgtcaaggtaaaaatgagagggtactgtgtgagttattttttatatattgtcatcttttaataaccctatgtgcccactatagagaagttggaaaatatagaatagaaagaagaaaaagttatttttttattttccacagttaatattttcacatattatttcattatgtttatttcctcacacactagtgatcatactttcaacagatcatactgtagatattactgtagatgttatattcatttgttcacttaaactaataatttgaatatactttactattattaagaactctttgttaaagatcaaattgttttaaaacttaagttagagaggcatttatagcattagataatgccagccaggacatatacactatctttaaaaatgaatctaacccttaaatgaaatccagcagccaatctaatgtttctttgtaataagcaaaatatttttctgtgttattgcatctcacaggaatctattcctaaaggattcaatagtaaagatgctcagtaatcatgctctagagtttctcatccctctaaagaacacacagcagttctgtgaatgactaaggatcagcaggaatggatgtcaggtgaatgttggcactactggatacaattgatatgctttatggattttttgtttcaatgtgattctgcatagatggcacctgtaattatgaccatttggatcatgtgaaaaatgataaattttcggtgaaagggaatggtgcttgatccttttctttgtctttgaactgtttagaaacactaaacttaactgataaaagtaagtgcaagatggccgggtgcggcggttcacacctataatcccagcactttgggaggctgagacaggtggatcacttaaggtgaggagtttgtgaccagtctggccaacatggtaaaaccccgtctctactaaaaatacaaaaattagctgggtgtggtggcgcatgcctgtaatcccagctacttgggaggctgaggcaggagaatcacttgaacccaggagatgaaggttgcagtgagccaaggttgcaccactgcactccagcctgggtgacagagtgagatcctgcctcaaaaaaaaaaaaaagtgtgtgtgtgtatatatatatatatatatatatataaaaaataaaaaataaacaaaaattaaaaagtaagtgcaagacatcttagaagtattgcagttttttaaagctcttgacagagtaactttattcatgcaggtaaattctagctcttttgagcaatatgttaataagtcactgctaatggcctaatagtttttaacttacaattaaagacccatgatggaaactggcagcaatttcataacccaccagtctaattgtttcacagtgaacaattatttgccttgcgaatacttacagtaaacatttctgtaaagtttatctttgtttcctaaacagtgatatttgttttgtacattctgtagatggaatatattctgcagtttggtttttctgctgcttagttgctgagaattgactgtgttgttgcacatagctgtaatgcattcattttcactgccctgtagtgttccattgtatgaatatactatggtttacatataccttgtattgatggacagtggacatacaggttgtttccatttttgatttgttagaaatagtgctgtatgactgttcttttatgtgtctcctggcacatatccttgaaatttacttagcattagaattgcttgggtttagggtatgcacataaggaacattactagataacgctaagttgatttcaaaattaattgtaccaatttccactctaactagcagtgtagaattgttgccatcgtttccacattttcatgaatactcttatcatacttcatatgaaataatcttgtgcacatgtgtatgtgtgtgtgttcaacagcctcattgtggttttaatttgaatttttctgccctggtttcctcttctgagcatgttcttttgggttttttaatctatgtctttattttaatgttgaactttttcttattcagttataagagtgctttatatattttgatcactattcctttgtgaataatgtgtgttccaaaacatttcctaagttatggtttatcagcgcattctgtttatggtgtcttgtgataaaaagttcttaatgatagaatagttgagtttatcaaacttttcctgtatagtttgagtcttgttttgagaattcatccctactctgaggtcataaaagcattcttacatgttgttttctaaaagtgttctagttttatcttttacacttaattcattgctttatctggaattaatcttcatgtatgatgtgaggtaaggtaagggttcaactttatttttctccatatggacaagcaactataataccattaccataatatattttaaaagtttcttcatctctcagtgatctgatggaccaactgtcataaattatgcctccaaatttgcctaggtttatttctgagttttctctttcatttgtttgctaatttatataacaacacaacactgttgaaattattacaacttttaattattgcttgatattttaaaattcagtctccctcccccacctcttattatttttcaggtacacattggtgactcttgtcttactactcttccgtgtaaattttagaatcaactcatcaagtttcatattctcaaaaaagtgaaattttcattggaattgcattgtttattggataatttagaaggaattggcatctttatgatattgattcttctagtccttgaatataatatttatctttatttatttaaatcttttttctccttccggaaaattttatggtttttctctatatgttttttttattacctatttgcaaatttctattagatttgttcccaggtacttgattttttttggtcctattataaatggtgtcttgaaaaaccatgttagcagcagttctcgttcttcgtatatacccaaaatcattcatagcagggactcaaacagatatttgttcaccaatgttcatagcagcactattcagaatagtcaaaaggtagaaataactcacatatccattgactgataaaaggataaacaaaatgtagtatatttatacaatggaatattattcagccttagaaaggaaggaaatgttgacccatgctacaatatagatgaactttgaagacattatggtaagtgacacaagtcagtcactaaaagaatactgtataatttcacttatatccagtgcctaccactgtcaaagtcatagagacagaaagtagaatggtgattgtcagaggctggtgggaagagggaatgggctcttattgtttaacaggtatgaggtttcagtttgggaagatgaaaaaatttctggagctggatggtggtgataattgaacaatattatgatataattaatactattaagctacacacttaatggttaaaatggtaaatttcattttaatgtatattttaccacaataaaaattatgtgttctaaaatttactgctggtgtatagaaatacacttgatttttgtatattgattttgaatctagcaaccttgccaaacttaccagttatagtaagttttttgcagctcgtctagatttctgtatatgcagtaatgtcataatgagcattttgtttcatcttttccaatcttcatacttttatttatttatcttgggttatccagttacctatgacattcaataatgtcaaatagaataataatagcaggatttcttgccttgatcttaaaagaagcgcttagaatgtttcccattaaatatggtattttgttttgttttgtttttaggtagcttttatcagattaaggaagttcccttcatttctagtttgctgagatttaatttttatcatgaatgactgtcagatgatttattgaaatgatgatgtgattttcttctaatctgttagtgtgataaactacagtaattgattttccaatgttaaatcaatctgtaattcgggggttaaacacaaattgattatgacatattatgcctttcacacaatgctagattcagtttgctgacattttacttaggatttttcatccaagttcatgagtccagttgtcttgtagtgtttttctcaaatcatcattttgaggattggtatcaagattctcccacctcagccttcctagtagctgggactacaggcacccactaccacgcccagctaatttttgtatttttagtaaagatgttcagtaaaaaaacatcattttgccatgttggccagattggcctcaaactcctgacctcaagtgatctgcctgcctcgacctcccaaagtgctgagattacaggcatgagccaccgtgcccagccatgtctctgtgttttaggtatgtttcttataggtactatatagattgattttttttaaaatttttttctcagacctcacagggatgaagatgttttaaaaagctcttctgaccagataatatttgtctgttaaatggagctttttgtctatttataattatagatcagttagaatttattttgtgcattctatttttgccctttctacattttttttctgatttcctgcttttctttgaattgtttcttcttacttcatttttttcttctgcaatttcagaaattctgtaaaccattttcattcttttggttgttactctagaaatttaataaaaacatttcaaagtctaaagttactcaggaggaaaggaaagataatgatgaatacagggacttttgaacactttaattcccatcagtttgttatcatttaccttaattctgttgtatacacccagcagatgatattgttcagaattaaccacatattttcccatgttctactcttcatttttattgctttcagaccattcatgttggatcacttttattctagataaattatattttttagagaatttttactatggaaagatactttttactctatgatattttaagttaacaagtttcactttgaatattgaagatgtcattctagtgtcttcaagattctacactgttactattgaaatataaggtgttatttaattgttgcttcctttaatgtaatttgttctttttctggctgcttttaagtctttcttttgtctttggtgttctgcagtttaaggtgcatttaggttgaaattattttttgcgtaacctgcttaggatttgttgtcttctttttttaattttaaattacgttttatttaacccggtaggtccaaaatatcatttcaatatgtgtcatcaaccacgctgcaagccctcaaaagccacatgtggccagtggctaccacactggaaaccatatgggacagttctatagaatggagtttagtgcgcattagaataaatgggaaatcttacttaaatgcaagctcctggggcgcgttcttagaggctatgattcagtaggtcagcaaagagaccctgggatcttcatttttaacaagtttccccaagtgactccaatgagagtggtctgcagaacactctttgagaaacactgatgtaggagattgttcagggcaaagcagaaggttcacctgactctcagggaaccagaataacctagtaaccatgggatcattgttacaggatccacatccctaagaggatgttccactgcagttttcatttttctctgactcaaactcagtaagtggattagatacatgcaggtgatgatgcaggtgcccatatgggacataaaaatttcaagttgggtccatttgttcttgcatcaaattatgttttaagtaaaatattaatattttaagtaaaatattttaagtaaaatattaatattttaagtaaaattttattttacttttaaaatattaattttttacttaaaacattaatttacttaaaatattaatattttacttaaaacataatttgatgcaagaacaaaatattaatattttacttaaaacatttaatattaagtaaagtattaatgatcctaataaatggggaaggagctcagacagaaccccattcccttcaaagcaagacaactttgaatagctgtgaatcttcataatggcttctctttatgaagccattgttttattcaaggatctactaattgggtaacaccatctcctatgcacaaacatgccctaaacttggactcagttacaaatagggatgaaggtaagaatggtcagactgtctggattttccttctcttagtgtttctcaaagcatggtctaaggaccagatagggccatgataccagacatgcaatagacagacctgcacatttgcagcattctcctccagagacagattcacatggtcaggtacagacccagaatctgcaaggtctgccacccacctccattctctgcccctggataattctgatacaggggattagggtgaaactagtggaacccatatataccacgctgttctcatcagaatgaaactacaaaattcactaacatctctcttgtttttaattttaattatacatgtactatttacaatagcaaagaaatggaatccacccaaatgcccatcagtggtagactggacaaagcaaacatggtacatatacatcatggaacaccatgcagccactaaagaatgagatcataccctttgcagcaacattgacagaggtagaggtcaccatcctaggcagaccaacacaggaacagaaaaccaaatactgcaagttctcacctatgagtgggagctaaacaacaacaacacacagacactaggaggggaataacagacactggggcctacttgagggtggagggtggtaggagggagaggatcaaaaaactatcaggtactatgcttattacccaggtgacaaaattatctgtacaccaaacctctgtggcacgcagcttacccatataacaaacctgcacatgtacccctgaacccaaaacaaaaattaaaaaagtatacatgtcatatgaataaatttccagttataaaatatttctttttttttttgttgagacggagtctcactctgtcgcttgggctggagtgcactggcacaatcttggctcactgcaacctctgcctcccaggttcatacagttctcctgcctcggcctcccaagtagctgggattacaggcgcctgccactacacacagctaattttttgtatttttagtaaagagagtgtttcaccatgttggccaggctggtcttgaactcctgacctcatgatttgcccacttcggcctccaaagtgctgggattacaggcgtgaaccaccacacccggccaatataaaatatttcaacaaatacaagtaaattaagtaaaaagttccctcacctcttctctaaatgtactcttcccccggggtgaccacttttatcagttaaatttaaggatttcttgtcttcttgtatctttggattgatatttttcatcagttttggaaaattgtctattcagtttcttttcaagtattgccaactcctcattctctctttcccttcctcttctctgggaactaagattatatgtttgttagaccttctttctcactgtctcttccttgactgtcataatttctgtactacattccagatgatgttttattttagcttccagtttgcttgttggctcttcaccagtacctaatctattgttaattctgattactgagattttcaattttgattaatatagtttttgtttttataatttttttaaatttaactttttatttggaagtgatttcaaatttgaaaatcattgtaaggtcagaaactgtgtgaataataccatataccctttacctagagcctctgattcttatttcactccatttgatttataatttgttttttctctctcggatatatttttttctgaccatttaaagataaatttcatacattatgacctttttcactaaataatttaggttatatatttcttaataggcatattctcttacctgattacagtatagttatcaactgtgaatattgctgcaacgaacatgagaatatagctacctctttggcatactgatttcagtttctttgaatttatatcagaagtaagactactggatgataatgtaattctatttttaattttctgaggaactttcatactgttttccttcatggctgtattaagttacattcccatgaacaatgcacaagggttctcatttctccacaccactgccaacccttacctttcatccttttgatatctcattgtggctttaactttaatttccctgttgatcagtgatgatgagcattttttcatatgtctgatggccatttgtatgccttctttggagaagtatctatttaggccctttgcccattttttgactgggttatttgttttattgctattgagttatttgagttccttatatattttggatattaaccccatattaaatatatggtttgcaaatattttctcccaatctgcaagctatttcttaactctgctaatcgcttttttttgccatgaagaagatttttagtttgatacaatcccacttgttaatttttgcttttgtagtcatattcaagaaatcttttcctagaccaatgttgtggaacgttttcctatgtttttttccagtagttttacagtttcagatcttacatttaagttttcagtccattttgagtttatttttgtaaaaggtgtgaagtaagcatccagtttcattgttctgcttgtggatatccaattttcccaataccagttattaaagagactatcttttctccattgtgtgctattggcatctttgtagaaaatcagctaaccaaaagtgtgtgggtttatgtctgtgttctctatcctgtttcattggtaatttgtctttctgccagtaccatacctttatgatcactgtagctttgtgatagatcttgaagtctaggtaacgtgatgtttctttttcattttttctttatgtagtcaatttatgaattcctattttcctaagcagtcttgaattcattactaaataattttagtactcatttcatatttggccagtggtgtccacatctaaaatggctcctgtaacctagtgatgtgctcatgtcattgatttgagcagttgtttatgttatggcataacaagatgtcattttgtatctactctgccttagtcctggaatggaaaaaagaaattttttgaattcaaaactgttgattctttatttaaaatctttaactctgttagtacatactaggtggtgttgattttttttgagactgttattcttcttgagacattacatatacttagcgtgtctgaaatttcaatgtctgaagcatttccaatgatttatgtatctgattgttgttatctgccagctttcactcatccttttgcctttccttacttgtttggtaatttttactgtgaattgcttatttccctgagaactttgtgtgagtattgcttgtttttcctggaatttttaggaattctttgacacctgggagaaggtggtttttaccagatatttgattatttcatgcctctagtgaaactacctgtgtgagaccatcttatattctcagggtgaggtttttcttttcagaccattttatgtaaattaaggctttaaaactctatgagagtcagcttgtcattatgcattatcagaagagattttttttttctgccggcaatactatttgagatgagaaattttcattgcaatttacttgagggagagggtagtttatttttagttcatctagcactgaatgtgtagtaggtcttttgtgtatagctctgttgggatcttctactagatgtcttacctggggtgggggccatgtgctatgctcttgatccctggatttgtgaagacttgaagccaaagctgaagttctaactagtttgggaaatattcataagaggaaacaaaaactaaattttttttcttctctttgctttatttttgacctgagtattgcttactttctgtctagctcatggatgtagattagaataatattttaaacttcattctgtttagtttttaaatcgttttcagtggaagtatcagtcttagtacctaatctcccatggcataaggctggaaatagccatgatcctgccaaacacggacactctgcaacctggaacaaaatattctactctaaaaatcaagtaattatgtcttttttcaataaaatataaagtataatcattaatgtaatttacttctttcattccagtcttcactcatgctttcaaacatagattatattattccaacccttcttaagtggaattagtatttcattattccataaggttctacaaatacctacaaagaccatcatgaattccaggtgctctgtaacctgatcaggttggagaactgctgatgcaaccaaatttaatcacttaatgttcttactaagcactcatttgtttttctgcttctatgacttgctctcactgcttgctatcccaaacactgtccgtttgtacatgttccaatgtcaccattcctttttcgggcaaatgcttcaaaagctactgtttctataaaactttcctttacccttctcttttgacttgttatgagctccttttgtagtttgtaatctccttaagagcaaatttcacaaatgttatatttgtaatatcttatgtagcagagtattctcacagtctagaacagatggttcttctgtatctgttgaaagaaatgggaagatagcaaagcaacataataggataattttatttttgcctactagactatctcaggatgtatgtgttttaaatcctaaaactggttagtggtatttcagttgaaaaggtcttgaccctttcccttctaacataacaatcctcatcataagtgagagagaagattgggtgagtagggctcagtgggggaagctggttcctttcacccaccttcagaaatccaggtatggaatacaggggttgttctggacctcaaaattacctttttttttttttttttttgacggagtctcactctgtcgcccaggctggagtacaatggtatgatcttggctcactgcaacctatgcctcctgggttcaggggattctcctgcctcagcctcccgagtagtggggattacagggatgtgccaccacgcctggctaatttttgtatttttagtagagacagggtttcaccatgttggtcaggctggtctcgaactcctgacctcgttatccgcccgcctcagcctcccaaagtgccgggattataggcgtgagccaccacgcccagccacgaaattacctttaaaaaggtggtctttaaaaggcaaatagggagatactaattgcaaaaaaaaataatgatgaaataagttatctttctgttttccactttttctgtggtgttccttttgacatttgcattccaaaccagagccccacaaataactgagtttgcactcttttggcaagcaaggactgctctcagatgtattttataacttcagcttatatgggaagaacttttctttccagagacggtttcatagtaatatccttcaaaagctcacattgtagaatatgacttttttttttctttgttgttatgtttgctttgttttggtgggttttattcatcatttcagccagcttatagaaagagatagaacttttgttggatactaaatcatgtctatcaaaagcactattgaccttgtgttgttaaaactaaaaatgtaagaacaaaccattttctaaggtttttaattatatgcactaaaacagagtaaggcctagatttattaatcattgggttatggtttgatgtggaaagaaccagcctataacttttccctttgtttaacaacgttattgctgaaaactttaatagacttaagtgtactggaactagggagtgaaatcttatctttccctgaacaccagggctgctttgttatggtgtttccatttgtggcataatgaatgtgtaggacgctaatgatgtggtctctaggtgttctcctactacacagagcactgataatgagctgcgagtaatctagtacgagtccctgaagatgaatcctgattaccttcatggggccattccgctctgctcccttcctccttgatgtttctgtaaagagcatttggattttgaagagagtattgtgtatttgacttttaattagatttgcagtgtgttgggttaataaactagggcttcttcttcttcagtttcctctaaagggatgtgtgtaaatgttgcacagtgggccaagagaacagagggtcataacaggcagcaatggtggtgtcgcccacttcatgccccagtcctgaaaagaaggcttatagtggctgaaggttgatttcatcccatggtccatagttacaaatggcttccaagctgccaaggacctgctaaacctattgcatctgttctgtacgaggaagcagtctcagaatgaaatatgacagttgtctgtcagggctgccccagagtcctgcaagttggtattatctgcttgcgttcagaaaacacatcaccgtggctgaccacagctttgtacttactgtgatcttagggctcgcatttttagggacaacttgccctttatgcctttggtccctttctgccttctgcttttgtttttctgccagttgggttcatttatcttctttcctgtgtgttttgccatgcttttcttattatagctttcagattcatcatggacagagatagaaagtactctagtgtctttatcccacctcagctctcagtctggtgtagagctaagggaaggagaattgccttcacagtcaactttcagtgtggtccctgaactttttattttgttcagtgaatccagcacatctcatattgtgccccagctataatgggtagtcctttcctgatcttctaagaaaattagatgcctggcttctgccttgctcttcattgttttttaagcatagtccttacatgatggtccgggccttccttacaggtctaattgtgtggctgggccttccttctgcatgcctattctgttttttagtttttgtttttcttttaagaattggggtctcactctattacccaggctggagatcagtggcataatcataactcattgcaacctcgacctcctggactcaagagatcctgccacttcagcctctcaagtagctgggactacaggcacacgccaccacacccagttcattttgaattttgtttttgttgttgttttgagacagagtcttgctctgtccccctggctggagtgcagtggcacaatctcggctcactgcaatctccgcctcccgggttcaagccattttcccacctaagccttcttagtagctgggattacaggcacatgctaccatgccgagctaatttttgtattttaagtagagaagagatttcggcatgttggccaggctggtcttgaactcctgacctcaagtgagccgaccgcctcgacctgccaaagtgctgggattacaggtgtgagccactgtgcctggcctgaagttttttttttttttttgtagagacggggcctcactgtgttacccaggctggtctcaaacttctgggcctgagcgatcctcccaccttggcctctcaaagtgctgggattacaggagtgagccatcatgcccagcctgcctatcctattttattctgaggctactactactccttatgggtagatccaaggatctgacatcattttcatacatcctgttcagtgtgtgagtatagaattgaggtaggctgacaacacaaaagtgggcagaggtttcccactcatccccgacagggattctctgttggcataggtgggctctggtccaactcctggccgacatgagcatggacaatgtggcacagttgtggctctgcatcttgtgtgtgactgctgccctgtttttgtttagcaagctgctgtgccaatttactatgcatgttgttacatattctgctctaatttgactgccattttgcttcagcgagacgatgattgtttatggcagggctgtaatgtgttgtcagcacaggttactcgctacttgttggcaatggcctaacattgcctgagacatggtgtcactgtgaaatggtttgacaatgttgagactgtagttatgttgagcagtaacaactgtagaggtcaagaaagggcatctaagaggaactgtgttcataggggaaagatggagaaggaatactaagtaggacagtagcaaatgtcatcaaagagcttcattttcacgcaattttcataattcagtctgttttctgtgaacagtgttggttcagctgttgctcgggagtagaagcacatttctgagttagaaatgaattgtgctgatcatgaccctatcattttcttctttgaacatttttagaaagttatccagcttgctgaagaatgcactagatccttgtccatgtgtgaggcaagggactcattgggccaccttcacagggtttcatttttggaacatttatctaaggactatcttactaccctgagagaccaagatgtaggctaccttaagtcgtatgaggctgctgtgaaaatggcatttgtttttttggctctaagaaattttcaggacctagtcaagcatgtgacaacaaatatttaatgatagtggacaaggtaaacttcaaaagtgactagaaacccttgtggaatctaagacagagggactctaacaagcttgatgacattttgaatacgttttgtattgattactgactcttttcccaataatctgtgaagctggctttctgtttggcaaggcagccccaaaaggaaccttcatcccatacctccatgcaggagtagcacagaacagcacccagcatcgggccctccagagtctgggagggttcggttgtctcatgaattatgtggtgcccttcaggaactcactttgacctctgatgcctttcctttcaagcaagtggtgtggaaaaatattaaaactctcagtaatgacagtttccagatatgcatatctttgagtggacaatgaaggcaacatttatattctgtccacgatgcgagcatggtatgcattctgcagctgtcacagagccttccttctggtaccaaataccttacttcctgacaggtatgacctctgagacctccctaacccctttctttcatttcatacaaaaatctagagcttggcttttttttttttccttctttttttgtaaaaagaggtttttccattttaaaaagccttttcagttcttaaacttgatcattgatatgttccacctcatcaaaaagaggagtgcagctaaactgacaatcagttcatgccattggcctcactcatcatcatgtcaaggacctggcatgcccattgagaagggcctctgtgcattctgtcctcaccaagcctaattccttcccctgttgatggttttgccagattctttgcctgttgatgcccatgccagggccacggtgcttatgccaaagcctttgacagaatgagtcaaatctggtgccagtcacccttggcatatgccaccttgttcttgaccacttcctaccagggatgggctgaaaagaatagtgtctgctaagagcttgtagaggacttttctgttaagtgctaagtgttgacattactccagtttgaatcagatcatttggaactcttgcttggatctctcaaagctgttgactcatttgtatcttggcctcacattagtggggtagataggagccaaaaagtttgagtgaagtcagaataaatatattttaagtgtggatctgtggagaagaaagaggtcccaagagcataatgaaaactgtggttaaaactgtgaatcaagaggtttgttttaatttgccattttcttacgaagttttaaaatattttctaataaagcttcttatttattgccttagtacattttctgttacttataacagaatacctaaaactagataatttatggccaggcgcggtggctcacacctgtaatcccagcactttgggaggctgcagcaggcggatcatgaggtcaggagatcaagaccatcctggccaatatggtgaaaccctgtctctactaaaaatacaaaaaaattagccaggcgtggtgttgcgcacctgtggtcccagctactcgggaggctgagacaggagaattatgtgaacccaggaggtggagcttgcagtgagctgagatcacgccactgtactcctgcctgggtgacagagcaagactccatctcaaaaaaaaagaaaaaatactagatagtttataaagaatgggaatttatttctgcagttatggaggctgaaaagtctaaggtagaggggctggggctgcatctggtgagaggcttcttggtggtggggactttctgaacagctccaaggcagcacagggtgtcacatggtgagggggtgagcatgctaacatgctagctcagttctcttccttttcttataaagctacctgtctctcaatattgctgcattggagattaagtttcaacacgagttttggagggggcatttaaacgatagcatatatatagtgcagcagtcccactcctaggtatttacccaagagaaatggaactatatgcttacacaaagacctgtaccctttttacactttttttttttttaagacagagtctcactctgtcgccctggctagagtgcagtggtgcaatctcggctcactgcaacctccgcctcccgggttcaagcgattctactgcctcagcctcctgagtagctgggactacaggcacgtgccaccacagctggctaatttttgtatttttagtagagacaggtttcaccatgttggccaggatggtctcgatcccctaaccttgtgatccacccgcctcgggctcccaaagtgctgggattacaggtgtgagccaccgcgcccggccaacctgtacactttttgtaatagccaaaaactggaaagaagcagtatacattactaggtgaaaattacagcatatagagataatggttatttctaagcacaaaaaagaatcaaactgatattcctaacaacatggatgaatttcagaaacattgtgctaagtaagagaaggcacacacaaaaaggtacatacttaataattccacttgtgttaaattctagaaccaacaaaacttatctgtagtaacaaaaagtagttccatgttcacctgggtgcaggggtgggaacactggctacagagttgcatgagggaacattgtgggtgatggaaatgttgtttcttgattgtggtggcagttatatagatacagacatatttgtccaaactcatcaaactgtatacttcaagtgggtacattttttcttttatgtgtattatacctcaagtataatgaagttgattttaaaaatatatttgttgtaatcccacttttgccacataaacagggtccagagaaatattaggtattccttctctctctctcatgtatatcctgatcaaaacatttatatgaacatattgaaatcagatttaaatatcagtttccctaatggactcagctggactcaagttaattgacttaataaaatttcgaatctcatttgttcctattttctcctccctacagttgttatctttactgttatttgaaggacttgaataagtgaattttgaattcagataatacactatagggagtaggaaagcagacccctggcctcaggagcgcctctttgatcatgaatgtctatgactgccattttgttctctagattcatgtctttatattgtctatttggcttatagttttttctatcaccatttttgttttcaactgttttttcactaaaagacaaaatttgattttcatgctattaatttcgtactaaaaagagcacagcaggcataattaaagcattttaagatgtagtaatttgatttaaaatattttactaagcgatatattacaaaaagttatttaattatctgtaaactttaaaagcaggtattagcattctatggctattgtctttaataattacattttaattttaattttagttttttaaatgtatgtttctttttgttgttgttgttctgagatggagtctcgctctgtcacccaggctggagtgcagtggtgcgatcttggctcactgcaacctctgcctcctgggttcaagcaattctcctgcctcagtctccggagtagctgggattacaggcacctgccaccacacccaaccaatttttgtatttttactagagacgaggtttcaccatgttagaaaggcttgtctcaaactcctgacgtcaagtgatccacccccctccgccttttaaagacctgacatcttagttgttactgtgaaattgattttcttgttttctcctcatcttaaccttgttttatatatcaaagtaaagaagaggaactgttaaaacttatatgaagtatggctgaatcttcaaaaagatatcaaatatttagaaactaattttaagctgcatatgttttatgaatggtagcaatacaatttataactgtcatttctgaaatctccggatttaggtctccattgccaaaaaatgtaaaaaatagaattatgacaagtgatctcttgaattaaaaccaaatgtttttgtattacaatacctgtgatgatgattccaaacaggcttctctttaataagtggccacagtagagtcatgatgttagcccttatatttataatgaggacaattctgggtcaccaagggcctggatatgggacccttggggcccactgtgatatttatggacatgaaatacagtcataggccatttatcagatttatcaaatttggaaacttccaaataaattaatttgacaaatatacataaacttcagtaaattttattagttttattttttgccctgtgtatttgcataaatgttactaggaaatatatttaataaaagtagaaggattttttttttttgcgtgatactcagctatattcttccaatagttgtggaacagcttagtgccttcagcagtggcagtctcctaaaacgattgtctatcagttaaaggttaactgagtatttggaccaagtagcaaactagaattcttttcatctaatctctgtttaatatagggatatccaatataacatccttgggtcagtgtagtacatcttacgttaagttttgtctctaatgaatatttatattacataaatgggaaaattggtgggttcccttggtagaaacatgatattggtatttttaaagtaaacttaaataggtcagaatttttatcctctagagaaaatttcacgtctgattaaatagtttacataaacttaatctttttctgctagatgcattataatctcagatattattcatgtagctattcctctgtgaaccataaaatgttcatttcttcaaaatgaatatgaagctcaaagcattagtggtcttaagagcataaaaactttattactttgtgcttcacatttttcaagtgactttggaaagccgaaacaaattttgcatttagattaatggaagatgttttccatgtgaaggaactggcaagggagcaacaataacaaaaatcccccaaggttaaaaatgtagtgcttttgattcttcccagaactgtgttagcagaacaatcatttctcagcatggaaaggtatcataattggtctatacagtggcaatactgaaaacgagtatgcttcagagaaagctaatatgactctacttaataatttccttcaagagcctgaatttgaatgtatgttccacccagcttgaggcaaacaatttgttcctataagttctagtggaagttaccggggggtcatgtaatttatttttgtcttgaagttttcaaaactgtgtagaaataaagacacgtttacttgcattgttccactagtaatttgatccaattggcaatgctcctttctcttcttctcaattctattatgttggaagagtggaagcgttcataaaatgttgtgacaaacaattcttcctagagacgtttcctctttctgtttgaacctctgatccacttgcgaatgttagcattctttttgtttgtttgtttgtttttgagatggagtcttgttctgttgccagactgcagtacagtggcacgatcttggctcactgcaaccttcacctcctgggttcaagcgatcctcctgcctcagcctcccgagtagctgtgactacaggcatgcaccactacacccagctagttgttgtatttttagtagagagagggtttcaccatgttggccaggatggtcttgatctcttgacctcgtgatctgcctgcctcagcctcccaaaatgctgggattacaggcatgagccactgcacccagccaaatgtttgcattatttagtaagtggttttttattatgggtctttacttacatgtgctgttattgtccttttcactgggattatctaggttttcaatctgtttctttgtattaattttttggctatgggactagttttaaagccctaccacagaagtagagggtctgtagttggagtacggtgagtaacatgagagaatgtttcctttttttccttgaagaatggatagttttaggggaatgtgtgcagatgtcagaagatggctacatagagaatgaagcatcagaaggtagacacaggtctctgcattgcaaatatcagtaacagggatgaagaaagaacagcaaaatttttagaaaaagtgtaaaggatggttagacacttagaccctctcttttataagtttgattgtgtacttctaagaagcagcaataagttgaaggtaaagttatctcaatactctgataagatgtggtctctggattcataccaaacattagagttcaaggcattccccttcagtttattttatattcctcaaatgtatctaattccttaggattaatgatttgtttctcttaaaaacagcatttattgctttaatctgagaaaaaaataagacttccagtgtttatatctacaaacacaaggattgaaaaaaattttataatcagcctcgctgctaattcttataggtgaagcaatgacttagaagaatggggagactggagtacatgatagttttgtagacagccacagttggcaaaagatggtggtgaggctgtccccgttgtaaatcctttatctccatgagagcaactgttgctggctagtttcttgtgaattaagtatgcagtttgtcttttttttaatgtgataaatgaacgtattttctaactggctatttgcttaataaaaatgagtaatataataaggaattaggggagcattggaaagataatcactgggaggtgagaaaaaaagttatctctctgcttcagtcccttattctcatctttatagatcagttctcccagtgagaagccaaatgggatgtcattctttgtttgtttgtttcattaattctttgcaatctatagtaggactgttgaggagaatgtataaactgcaggttaccagcaggtggaaggaggggaatgagggcaggtggtccataagcagaaatattaattcttgactgattgggacagtgaatattgaccaacattgaaaacattatattatggtcttatttaggcctgaacactgacagccagttgacaagtctaattttttataacttaaatgtggttcatttaggaaaaactgccatcaagggcaattcaattctattatgacaattaactctgactttgaagtaagtagaataaatcagtttatttctcagtaaggcccaaataaactgagattgttgtgaaaattatgcagtttgtgactacagtgtggatgttgtgtgttgggttgtgcagtgtacaacctgcaaagctgtatgaggcaacctggacattctactcctagctatatacccaaaagaaaatacatgtttctacaaaaccttgtacagaatgtttatagtaccatcattcataatagctaaaaagtgaaaacaacccaaatgttcataaactaataagtggataaacaaaatgtggtgtatccataaagtagaatattatgtagccataagaaagaatggagtaccacacgtgctacagcatggctgaaccttggaaacattatgctaagtgaaagaagccagacaccaaacggcacatactgattgtatgagtacatttagatatgaaatatctaaaataggtaaatccattgccagtggctgaaatggggagtgattgcttaatgggtatagggttttcctttgggggtgatgaaatgttctggaatcagacagtggtggggttgcacaaccttgaaaactactgaaaaccctgtgaaatgtacagtttaaaatggttaaaatgatacattttatgttgcataaaagaacatttaaaaaaattaatccagtggggtctgatggcaaattgacatgagggaacttttttgagggtgatggaagtgttatcaatctagattagagtgatggttgcacaactgtataaatttataaaaactcatcaaactgtactcttaaaatgtgggtgtattttatggtatgcaattatacctcaataaagctgtttaaaaaaaaccctctctgagtcattactgaaatcagtgccattttctgaatttcagaaatatcaaaggagagctttcctagtgtgaatttatcataaataatgtttggtattttttttcctttgacttaacgagagcctgagatgcagaaacaaatctgcacttccatgttgtgttacccgctttgggccatggcccatttgccagttgcagattgcctccttgtctgaaaatgggtgtgtttcttcatagtaactctcaattctattgttggtgacagcgcaataatggaactttcttctgtgtggataagccccttcagtgatatttgcaaatcaaatcatatctgctttttgtgctacattgtcctcaaaatcttctgattggtttggttatagacatccctatatcagctttcctgttctctttcagtttaaatatctgtatgctgtagcaaattgcattatgaaatcctctcacatttatcgctgtttagtgcatggaaatggcatttcctcattaccagtcaaagataaactctaaatgtttctttttttttttttcctgaagtatcaaattatgtattcaaaaaacttttctctatagcattatttctctgagctgtttcttttttccctcctgaatgctgacaccagatgcagtctgcatggacattagtcccagggaaatcttgtcttctacccaggacaaggagattataggaagcaatgctgactcttgttgtagattcacaatgtgctgacacgataataggacatgaatgggcttttggaatgccttttcctttgagctgggctgagagggggacagaggcagacagctccatggcctgaatttcgttagctgtgtgacaatgggagagataagtagatgtgacagttatgaatgatcctctgtcatgcactttcacgttcagattcagataaactgacactgctgtcaaacacaagctatggagagctgagacctctgatgaaccttctaatatggtaaatgggagtcttaattcttcattaactgaaaaaaggagatttggccatgtaattttctccttgctgcctgttttaaagattccaataacccagcatttacagttgactaggcagggattgcttttccccccctacacttgcaacatgcagactgtgaaatctgaggaaacgctgcttaaacccagacttattgccttggttatctttaatgactttgaaatgtattggcctcattatggaacagtgcagttatcaattcctctaattaggtgatgtgctcccataagaaatttaacattaaagcacaaaaatgaactcgttagaggcatctattgctgggaacttcagtatcaatggtgaattgaagatactgtgtttcgttaccaactcttctgcaccatacatctgactcctccttgaagactagagcatgggcatttttttctttttccttaagggtttaatcctcatatagcacctctaacacctttgatgacattttagtgcttctggatagtaaactgtgtgcctttgactaaatcgactaggagtctagggaagggaggaggtgagcagtttacatttaaatgctccacatatcagcccatctttctttcttggaatttaacccatggctatttactctttcttatgtaagtccaataaacttcctttctataagtagcttagtacagtctttgtttttatcacgatagggaccattatttgtttattaaatagtgatgctgtttcactcataaatatttcagctgtatttctagagaagtaggatggggtttctgggtttaggcttcagtgaagggactttaagtctcttaacccttctttacctcaatcatccatctgaacaaaaaaaatcattatagcctcccctttggggaaactacatagtttaattagtgttttctaataacttacaaatccttagagaaaagttatagtagaagcataagaaattatctttggggttagtttattattattgctattattatcattattactatatgggactagttgtttttttaaattggctacttgaaaatgtgtttcagatctcatggagtgaaatttacctttcatttaccttagggctcaaataagagtatactgaatataaaaatatggaacactaatttctttaaaatacctgaacctattaatagccaggagtgttaacttcgtcacctggaagaagatcctgtcctaacttgaaaatgttagaatgaaaaccttaatcgtctcctctcaaagggtcattgaggaagctgggcttgagtctgtgcagctgttcttcaataatgttatatcattctgaaccaattatcatccttaacccagatttgctttgaatctctgtggcatcttgactactgtctataacaacggtgattgccagacactgcctgatgctcaggtttctatcaatcctcttcttctcctcacagcaggtaggagcttcttggtgttccgctccttacccaggcttgaggaatagtcctactttttgccatgatgccttgctgcagttctggctcttcccttgtgctgttgttctctttgtcatgcaggtttcccagtatcttagtagaagccttgaacaattcctattaccttttcagaccttccttccaagaactgggggatgggggtgttctggtcttgtcacaggtgggtgccacatgtaaggacccactggttcatgggattctttgagagagtctgacgctcacttgtctgggttaaaagtctggtgctgacacctgctttctgaatgactttaagcaagttatttgacttctctttgcctcagtttcctgcctacaaaatgaagataatagcgcctgtcttatcaaggttcttagagaagattagatgcattaacacatgtaaagcacttagaacgctttaagtcacatagtaagcattaataaatatcagttgctaacagcttttgcttctgctctgttaccattttactatctcacctctctcatagcccataacagcaaaccaaactctttggctcttggtagatatattattcttaatgtttgagccctactatttgctattgcttccttttttactcctataatgtgtgaaattgaaataaaaaacagaattgaggccaggcacagcagcttgttcctataattccagtgctttgggaggccaaagtggaaggatcgcttaagcataggagtttgaggctgcagtgggctatgatagcaccactgtactccagcttaggtgacagagcgggaccttgtctcaaaaaaaacaaacaaaaacagaattggtcaccatgatattaaagagccatgaaatatattagcatgtcttttttctgcctatcccctctatcctaaacattccatgtagtcttgggaaataaattctttaaggtaggccagttattatgaatataacatgattatctattgtgttatgtttactgggttgatgccaaggaaaaatgaatatggcaggtcccagcaaataacaacaacaacaaaaatagtattgtctactatttcacagagggtgtggagttagtattgggttttgaaggatgaataggagtttatcagatgaggaggattgagaagagcattcagggcaaaggtatgtggaaaaattggtgtggtagtacacgccaatcctgggaccttcaagttgaacatttaggagtgtagtgtttatgtttcagaagcagaggatgagtggagagggcagcaatagaatggcattaagacccttgtacagtatactaaggagtttggacttaatcctgtgggcatgcaggaccctttgaaagatttgcagtgggaaagtgatcggatctgatttgctaactcattgcaatggctctgtggaagaatatcttggagaggggttcaagacttgagccaggggacatatcaagtagtgtttcaaatgctaactaccccctcctgcttctcacattgctaaatagagtgcagcagaatgaggtgtacttctgaagacaggtttttgaatcagctttccagcagtcccttgagtacattgagagggtgcatggagggaagacatatcatctttaccctgccctctccccatgttaatctattaaaagagatgggagcaaagctgctatcacattgggcttgactgaagacagaagtccttgagcatccttcccctgagtgcgggcaagcctcgtgcttgcagaggagaggagattagaataacatcttcactcttcggtgagagggcaggcagaccctcacactagatggttccaccccggagttcaggcttctcctgacaagtgttgcgagcatctgatgtccttggcctctcttctgcactgcttaccttacagcagttaagcatgagggcattctgtgtcttcctttctttcccttcagttgcttaaagaagatgagaatttgctttaaagaaaaatattaataaatctttataaaatggcattaaatagaaaatctcacactcttttcttcagaatgcttttcttcaattgccattgtatctttttgccccttccaaagtcttaccaattattattaatatatattatcataattacttgtagaaaatcaatagaattgcttgtctttatcagcagtgctacctttctacctctctctcccttttcatcctctcttcgtctcttgcgaattgttgtttctgggggtattattattgtaattacggaaattgataaaaataccatgacaatttcatgcctcagaattattacacagggtttataaaaaaagattattatacatcaatgcagtatttgttattcctaaatgattattccagaaatactaatcaaaaacatctccctgcagaatagtactgtggctttaatatcagctgctgtttctttgaatggggttgcccaatctttcatcaaagaaacacatcacccatatccctgtctttaaaaacagcaattatgtgtaaatgcctcctgatttatttgagccagggccactggccagtatgagtcaccacaatttattgctaaccgtcacttttacatgataggtctgtaacaaatatctgccgcatattgttaaattaatcttccatttaaaattaatggagttagactccccaggttcaatgtaatttcatgttcacgggcagggagggatgtgtgctgcatacaaaatgagacaaggcccaacgccctaatctttcatcaccttgaacctggagactaggacgcgtctcagcaccaactaatgagattgagcctgcgtctctcctgaggatgccggctcaaagaggcttttctgctcagaaatagcaggctctgtcttattttaataattcctcagatatgacaagtctgatgttatgtatgaaagagccaggcttgaaaaagagataaaatgaattttatatcattacttcaaaaccaaaccaagggaagtgtgttgtagttaaattaaaaaaaaaaaaagataggacacattttagtcatgaaatatactgactgtaaaccaggagtcatcctttcatttattttaatgcacaatcaccttagatttctcttctgtaatttttaaacctattcatgcgttaatcaaaataatgtggatgaaagcaggagcttgttcaataaacatttagatgaaaatatcagaggggacatgtaattcctgatggggtatgtcatactgaacctctgaagtcccatcgcttcttttggtggcatcttttgaaaatgcatcttttttctgtgtaccactaacctattactgtttagtctcttagactttaaaaatgcctaagccaaattactcaggggtattgggttctctcgtttttttttctgtctttttcacaaaccaggtaactattttgcatccatggaaaagaaggttttacagaacagatttcggctctcatacatctatagtacttctggcaaatggttgctgtttttttgtttgtttgtttgtttgttttaattcttagggaggactgagccccagagacaatgggacccttttcctaggtaaagaaaacgtctctagaaagacactaagttaagagccaggcaaggtggtgcacacttgtagtcccagctacttggaaggctgtgacagagaattgcttgagcctaggagttcaagaccaatctagacaaacatagcaagacctccagataaggtaaacttcctggtttttaaaaattctgtgagttgagttctgcttcctcagaggggaattctaagtatctgcactttgtgtctgatttatttattttatttttttgagacagggtctcactctgtctcccagtctggagtgcagtggcacgatcttggctcactgcaacctccacctcctaggctcaaacaatcctcccacctcaggagggagctgggactacaggtgcctgccacaacacctggctaattttatatgtttttgtagagacaggatttcatcatgttgcccaggctggtcttgaattcctgggttcaagcaatctgccggcctcagccactgtgcctggcctgtgtctgatttataatacaacatatgattgattttaaagctcttttttgtgatttgttgtaatttgggaccacaataattttttttccaaccccttcttcagacatacataataaaatttctaaagaagtagtattggtattatactacctatagcttttattattattattattattattttactggcattctataacttagaattctattttcttacaatctttgtatatttaaatgaacattagggatagaaaaaatgtaaactctaatacaagaatcaagtatagtcacttaattgacacgtgcagttttaaaaattatagtcaccccttggtatactgagggaattggttccagtaccccctcaccttcacccccatatatattcaagtcctgcagtgggtcctgcagagccctgtgtatgaaaagtcggccctctgtatgtgtgggttttgcatcttttgaatactgtattttaaatctgcatttggttgaaaaaagtctgcatgtaagtggatcaaaacccatgtggttcaagggtcaactgtgtatcactttgataggctatttataagagaagattttaaaaatattgctccatgtctgtacttgaataagatttagaaaatcttaggggtattttagaaccagataaattagtaaaaataatgatactgtaaattggaaaataaatgaataatagtagggcatctttctccatgaacctgaattgctttgctttcctctcttttgatgtctgtaagctgttgcgttttgtacagtgggcctcagggtgcttcgtgagtcccaaataccagatttctttttctctcttctacttatagtatatttgccttaagttcttgatattttcttctgccctcttttcttcttttaatatcttcagcatttttcttcttttttctttctctccctctttccttcccttaaaagggcttctttattttatatagaaactcatctttttttgttttgagacagggtcttgctttgttgctcaggctagagtgcagtagtatgaatcatgactctactgcagtctaaacctccctggctcaagcgatcctcccacctcagcctccaaagtagcctggacctcaggcatgcaccaccatgcccagctaacttttgtatttttttagagacagggttttgccatattgcccaggctggtcttgaactgagctcaagcaatctgcctgcctcagcctcccaaagggctggggttacaggaataagacactgtgcccagccttcaatttttttgttattgttgtgagtgagtgagtgagaaagagagagagagcgcaggttgatatgctcaagcttaaggtctgtaatgggtttaaagctccaagttttataatcggaatggtagagacggaaaggatctctgatctaatccatcctccatttcataggtaatgccatggaggcctgaaaaggttaaggttctcaaagatcaaaaatgtatccttttggaaagtattatagtggttcctcaaaaaaatttaacagataattaccatatatgattcagcagtcacacttctgggtatataatcggaattaaaaacagggacttggacagatacttatattccaatgttcatagaagcattattcataatagctaaaaagtggaaacagtccacatgtatatcagtttgtaaatgaataaataaaatgtggtatatccatagaacagaatattgttgttacttttgtttttgagttgcattttattctgtcactggggctgaagtacagtggcacaatcacacctcgctgcagcctcaaactatggggctcaagaagtcctcctgcctggtactacagacatgagctaccatgctcagcctggaacattattacctagccttaaaaaggatgataattctgacagtctgcaatacgaatgaatcaatgtaatttgaaaacattatgctgattgaaataaactacacacaaaaggataaatattgtgggatttcactgctatgaggtacctagagtagtcaaactcacagagacaaaaagtcaccaggaactgggaagaacagtgggatagggagttacccattcatgggcacaaggtttcattttgggatgatgaaaaagttctgcaaatgaatgttggtgatgattaataatgtgaatactcttaatgccactgaccatatacttaaaaatggttagaatggtaaaaaaaaatttgtatatttgccacaataaaatacacagacactggtatgatttggctctgtccccacccaagtcttatctcaaattttagttcccataatccccatgtgttgtgggagggatctggtggagagaattgaatcatgggggcagtttcccccattctgttcttgtgatagtgagtactcacaaggtctaatcattttataaggggcttttttcttctctgggcactcattcttctctctcctgccaccttgtaaaaaaggatgtgtttgcttccccttctgccatgatcgtaagtttcctgaggcctccccagccatgcagaactgtgagtcacttaagcctctttcctttataaattacccagtcttgggcagttctttatagcagcatgagaacgtattaatacagacacgcacacattcttttattacctgagaaaatttctggcaattagtatgtctgtcctcctctgcctccatctctgtagctaacatttggacattcctctgtttcagtttcagatttgctctcataatgtttttgaatgttacatctttccctttcttatttcagttttctttttttctgacattgagtacgtgctttgtgatagtcactagagatacaaatagctcagaatcaaagaaagagtgtacatgaagtattttcaagaatatgcctataaaatattcaacgatttctcagaaaatatcaattgtaaaataaataaaatacaacaaaactttcttatttgcacaaatgcgtaaagtacatgtagtctaatttaagtagtttttattttttttctctaaagtaaattttgtgactttttttttttttttgagatggagtcttgctctgtcacccaggctggagtgcaatggtgtgtgtgatttcggctcactgcaacctctgcctcccgggttcaagtgattctcccacctcagcctcccgagtagctgggattagaggtcccagctaccacacccaactaatttttgtatttttagtagagatagggttttgccatgttggccaggctggtccctaactcctgaattcaggtgacctgcctgcctcagcctgccaaggtgctgggattacaggtgtgagccactgtgcctggcccaattttgtgaccatttcatataatattataagtattcctttactaaggcaacctgttaatataggtctctcagttgcaggcttttcttattctatggattgactaagaagcccccaaaaatccttatgaggaaagatagagtcatgtgtcataagagaaggctagtaataggcttgagtttcaaagaaaagagtttatcagactgaggagtaaagaacgttggtaactggccttcaaaagatagttaagattgcatccggaaagatgtggggaaggggatgtaaaatggatagcaaggcaggatagcaacagggcattcttggaatagacaaccatccatttgttctcagtgtgaaatatacatggttttgtaatgggaattaaggccgaaatggcatgtcaaggccagtagttgagagctttgtaggtcacattgaagagtttgtatttggagtttgatggactcctaggatggatctgtccagtggacaactggatttcagacctaggagagcctctatagaggtattaattgaagcctttggatgatcgagattgtgaagatagaatataagacagagcctcttgagcatttctcccttagtgagaagaaggtggtgatacacagaaggaaccttcagcaaggtgagaatgatagataaaggatggactttccccaagaaacctggcaagggagtgatcaggagtgttaatactgtcacagagactttaaagaggatcacaaatgaggggaaaccttggattttaatcttgactcttagtactcaaggaaactgcatgttaagatgtggtaattaaagtattaaaatattctaagggtcccttgcactctccctttctgtgcccattgtgacagcatggtcacatcattgcttgaggcatgcaagagtgctttattgaagatagtattacggggggagattttattttgatagagagtaacaaatagactaataatctatcttaaagtaagtatcttaaagtcagtaggcaaaggagaaaaaaagatattgataaggaaagcatctgcaggacagattctagatttctgttttttgttgttgtgtatgtcagggcccagactatgtaaatgatagggcaaaatgtgagtagcaacatagtcttattagaaacctaaatatctacaaagagagcaaaaaactatcaagtcaagaatatgttacccattttagtaaaaaggttagatttcatttgccttgtgtatttgtgtgtgtgtgtgtgtgtgtgtatgtatgtatgtgtgtgtgtgtgtgtgtgtgtgtatgacagtactgtattaggaatgcttagtaggcatttggagaagttttgggtgattggtaacatgaaccattcttccctttaatctggtgcatctgaacatattcctgggcagaaggtatacctgtgcacattacagacgtttgtgggtacttttatttcattatcctcaagcaagaatacgagattgctatattctacattagaccaacttgttcttagcaagcacagaataataacctttcagtgtgaatgtttgtacataatagtagtaggatgtattttgtggtattttttaaatgaggattcattttaggcttggcacagtggctcacgcctataatcccagcactttgggaggctgaggcaggaggatcgcttgattgagcccaggagtttgaagccagcctgggcaacatagtaaaacttcatctctacgaaaagtacaaaaattagctgggtgtagtggcacatacctgtggtcccagctacttgggaggctgaggtgggaggcttgagcctgggtggtggaggctgagtgagtgagagtgtgtcactgcactccagcctgggtgacagagtaagacagtctctcaaaaacatacatacatacatacatacatacatacatacatacatacatatgtacatgcatacatacatgcatacaaatgaggattcactttaaaaagcattgaaatgtaaatatcagctatacctgaatgtttataatttaaaggtaagattgtcattaaaggaaaccttaggaatttctcagacatactgaaaatcagcccgaaagtgttttctgttgtttggttgttgtcgttcttttaggattttatggagtactctcattacttatcacttagaccaaaagagaatgtcaaactgccaacaaagttgttttttctacatttctactaaataatgttaagtagtcaggttcatctttggaaggaagattcttaagtgctttggcctccagtagtttagatgagacttcttaaaactcaaaatcattttattggaaaatgctttattttctgtctttgtgaattatatttataataatgcatttaatttaggccttgggattttgtatacctttgggtgggcctcttcctcttctccccctgcatctctaataagcactgaatatcaaattgaaaccatgatattctgaaatcggaaagtttctgccttttgcagcttatttgatgggaataaaaatgactgatggcactctctcttggacccttttgttcaactcacctatgattatggagcctattagctggagttacaacctatttaagagcagtgcttaccagtaatgggggccaaatgattttggaaagttcagatgtactggactccctgcagaaatgaattcagcactgaacatattgatgcagaacccgaacgaggctactccagtgggacaaagagaattgtgagctctgcaagaaatgagtgggtagtagaattaaagatcagatagatgttcggctcaagggcagtctcagctcttaagttcatcacagcaatttaatcaggcccaaatgagcgttgcccagaaaggaatcagccttcggtgtgacaggaaatggagtttatttaaaagattctttgtttctagtaattgtgtgttaaggttttccaagtctacactaaaattacggaactactacatttgataggtgatagcactttggtttaccttggttcagaagatgtactgttgagaagatttatacaagtcatgatcttgtccagaaggagcctgccacctcaaaagttccagctctatcgtcttttggattaagtaggccagagtgcatctttggctatagctatctgatgcccccttccattgtaaaattattttcacaaaaatatatttgtctacagtaagagttatataatatagcagtaaagaccacaaactttagaatgaggcacacctgggttggaatcccacctcctccacttgttagctatatgaccttgagcaaattacaactgtagttgaacacatagttctttacttacgaaatgagaataataattcctgcctcacaagattatggggagaggtcaattaaatgatgtagtatgtatcagttgcttcacaatgtctgcacataataagggctcaataaatagtagttacagctctagagctctctcatcttgtccctcacctcatttgcccactcctctactctcttcatgagccagagtgttcactgctttaggaataagtgagggaaactttttttttcttttttctttctttcttttttttttttttttccgagacagagtctcgctctgtccccaggctggagtgcagtggcacgatgtcagctcactgcaacttctgcctcccgggttcaagcgattctcatgcctcagcctcctgagtagctgggattataggtgcccgccaccatgcccggctgatttttttttttttttttttgtatttttagcagagacagggtttcaccatgttggtcaggctagtctcgatcttttgaccttgtgatccacctgcctcggcctcgtaaagtgctgggattacaggcgtgagccactgtgcccggccaaataagggaaactttttagaggatctttggcttcagtcatggagaaaaagaagaaactataaacacttggaggtctgaacagttcattgattgttaagaacccaaacaaaaacactccgtccccaaccccgacacaacaatacagtggggtattttggattgacacattattagcctggaaacctatattgacagccaggttatgattttacacatgtaataagaagagtctattggtttttcttctttgttgctcactagttcttaagtttgctcactaatgtataggtatttttgtctaacactgacaaaatttgaaaagaagtataataaatttattaggattttacttctctccttcatggacctggcaaatagtgtatctatgtctccatacccatatccacgttcttattttttttatctgtatctattatctgtctctgtgtgtgtggaaagtgataatgaatgaatgaatgaatgataaaagatccaaactatgaactttatggatatcggggtaaacatccaacaatcccttaaatttggtgcactcaagtaaaagctgaactggagagagttgaccagatcctcttaaagttaagctttttatccctctgcccataatttgtaccttgagatcctatagggatgtgcctaggcctgtgtgaatggcagcctcatctatgctgtacctgcagtacagaccagcctcatctgtgctttacctgtaatacagagcgaaacatatctagagaaagagattagtttgcaattagggggatcccacccattccacagcttggcccagtggaggttccctgctttgatcgtctcttggtgaagagaagaagagacagcaagtgctgtagaaagttttcttctttgtagttaaagtgatagggtggaaacaggagcatagaaaagacattcagagaatagaaagtgaccaaccatttgaaaacctaaaggaagacctgggttcaaacatttgttaacatacagagaagaaaaatatgatctgtttggggtattacaatccagtgtgtattttctatcatacttaccaaatgtacttacttgttgtaaacatttaatatttgtttagtgctttgaagattcggagtaatgtttcagatctacatattgtatcaataagcaaataacatatgctaagcacttaaaggctattgtcattctccagctagtacagagcaaatgtgaaagggtaaagactatgtaatttcaggtgcggtttcagtgaggaagccagaacagcagtctactcttatctgctgctttcttccaccccaaccccctgacccataacaacaaaaatcaaacccagaacaaaccgcatagattgatcaaagagcataacatgcattgttaggatttcagatatgtagacagaaagtcagattaagctttaatgataattttgagttcttggagcaatgctcattgattacaatgtgtgtgtgctggggagcaatatttggggtacccataccttccctgggcatgttaaccttgtggggcttgccttgtttcagaacatgtttcctattaaaaaaagatgactgtaaaatcgtaggccttttctagcatgcacctcaaaactcttccagcctctacccatcacccagttccaaagccacttctgcttccacattttagttatttgttacagcagtaccctcccttcttggtaccagtttttgtcttagtccactcaggctgctataacaaaataccaaaaactaggtagcttataaacaacagaaatttatttctgacagttgtggaggctgggaattacaagatcaagatgctggcaggttcactgtcttgtgaggcctagtttctggttgtagatggcaccttctagctgtgtcctttacatggtagaaggggtacacgagctcctagggccttttttctaaaggcactaattcactcatgaaggcttcaccctcatgacctaaccacctccactaaaggcccacctcctaataccatcaccttggtagttaggatttcaacatgtagattttgagtggacataaacattcagaccacagtccctgtgaagaaggtatttgttattctggcagtgcaggagcaagctagcacacttgccatatttagctgatagaagtaatgtgaaatgaaccgttaggaggagggattttgtggaagaaggaatggcggactgagcaagataaaatatggagaattgctccctcttcaagaaacgcctccatcctgatgtatatcagctttcatatccccatggatattttacaggcattgctacctctttaaacatttatgctattaaaaaaatcagaccaattgttgacataaagctaacatagcagcttctatatagacagaatatgaattttttatgctgttgatgagaagtttatgtcatttatatactatagtagggtagaagatggatttggaatcctgaaaaagctactgtttgtaccattcagaatattagcttgtgctttgaatcgaaatattaagatacctgtattgtcaatgtgagtgtttctgtgcaaagtggcttacatatgggtggaatgggagaaattgctctacctggagaaaatagcaatagttttctttcgtttatgttttgttttgtgaaaggaagggttaatagcatttaatacctgatttatctgtgcttctctgcaccattaaaagaatgaactgttgtggtaataaaaccatatttcattgaattaaaagtgccatcacttgcaagatgcaacattattttatgtacctctaaaaaactacactaacaaactgacatgtcaaactgacatgccattgatgttaagatgcattccaatttcagagatgtaaatatactttaaaatgtatatcttggaatcaatgaaatactgcatatagttcttttgtggtatgtgtatatatgtatgtatacacacacatatatacatatgccacaagagaataaagtatacttctatttggttatagtctataatattttgaatcattttactgagttaggttttacttattttttaaagttgctgttgacatctgtttgataccattcatttaacatggcatgaatttagaatctctacttagaatagtcctttggaagccctagtttgttgagttttcaaaagaaaaaagagtctggtgcaaggaggcagactgacattcaagtcagatcattttttaaaaaaggaaagaaaggagggagggaggaaggaagaaaggaaggaagaggttcatcctgtcagttaggaaccagctatcttacttttcaaagacaaaatcagatcatactagtatatcacaatcccgtagtttatctaattgcatatttataattcttcttggatggtgtctctcatcttggattacctctctcacccaaaatcatattttattttgttttgtcattataaaatttactatatgatcattgcaaaacaaaaacaaaaaattaccagtacatataacaatactggatgtcatatattaagttcacaataaattatggcgatttttccacatcaataccttatcttcatgtttcacatcaatacataatcttaatttttagtgactgcatattatatcattgtatagtaaaacataatttttaaccatttccctattgatggacatttagattggttgcagtttatcactttaatggcatggctgccatgtactttctttttgtcacacttacccagtgatcattttaggatcaattcctagcaatttctggattgctggatcaaaggctctgtcttcatgttattatgtgttgggaagggaccatttcctcatctgttcaccaatacaggatatcagccatctcccaccccaccccatctttacctacttgattggttaaaaaaaaaatctatttttgtttttattagcatttttaaaattgtagttgaggttgaacaccttttcatatgttttggccttttcagagtggttcttgataatagaaagcacagcaggtcagagagcaaaaggtcttaatgaacttccattctgcttcacagaagcctatgaggttttgaggtaactttctcaagttcgttataaagaagatgaaactgatagaaaataactgtgatgtagagatggggtctggcccactttcagctggtctactctccagcactggaaaggaagactgagcatcagaaagccagggaagatccctccagaggtccaggattgttctgaggaatactgaaatcaaaaactctagactccttcctgctttctgagatgcagggatttgacagagaggtcaaaaaagggcccctttcctctgcatgtgcagcttttatttactattgtttcctttttgttgtattgaaatgtcttcattgcttgcctttatggatacaaataaccggatactgtaatttgaaagtagttaacaatgaaactgcatagtatgagccatgctgatttttttttttagtgggcaaatggggtgatttctctatgagcctctctgctgtcagaagctcttaacatttgagtcaacatgggaattatatttggaataaattagtaaattcccattcagcatgcctataccatgtaatcttcaggaaccgtaatgactgtgtagtagagtatatttccaacttggtatttataaaacacatttgctctgagaaacccttcagtatttgttcctcaaggcccagccctcatgctgcctcctttgttagtcagtgtttattttgtaatagttgggacagtgttgtacagtggaaacccatttgtctttggagttagcccagacataaatggactcttaggcctgctatttactagcagtattctcatgtttggaaatcaggagcaatgtaattgttgagacaatttattttaatgagagtaagtcatgcagtaagcatcaatcttagcacatatacatgttgtctttttttgtctccctgaaatcttcttcagctgcttccatgtactgatatcttcttccaaattccttaagagccttcatctgggtcatacattgacatttatttgatacttaatattgatagttatctcttgatgtttgtgtatgtctttgtatccataggatcctccattagcacatgtattcattcatcaaatatttattgagccacttctgtatattaggcatagagtaagatgctggaatatgttaatgaacaggagatgtggtcactgtgccctcctaatgcttacatcccagcaggcaagacctatatgaaacaaagtttgaattactaaatgaaagacatggcagttgctattagcaatgttgtaaggggctgtgaatgtagactagcttgtacatgacatttgagctgatatctattggctgagtaagagttagccaggtagaggtgggagtgataagtctttaggcagagaaagcagcacgttcaaagactctgaaacaggaaaggacttgtttcagtggtgcaatagaggatgagcaaaatgttctcagagaatggagtgcagaaagcaggccttcagagaggtcattggcagcgtaaaaatggggtaagaacggcaaccttgtgcagggtcttgaaggccaggtgtaggttccagtctgtcacctgagagcaacaggaagatactgaagggttaaaggtttacctgtggaagagtatcagtaaaacataaatggatagattctaagtgagtctactttaagctggagtttggagtcgcagggtcctgcgtgtgtaccaccatactctctacacttttaaaactaaaacagaaagtattctaaaacataaaacaaaactggattgtattttcaactgttccttcaactctgaaatactatgattatgctagagtatgagaaattttattttccaaacaaatataaagatgtatttctgatgaaaaacattttcaacctaagctaaaaggaaatctaatgaaaactttaaggatcctttaaaatactaatattgtgtttaaagagaaaatgatacttgtctttaaaatgttttaaaacatttaaaatatgctactgaatataagtgaagagtggtagatcctaaagtagtatttcttagaagagtagaataggttatttccaaaatctttttcatggaattttagtgaaagctaccatagggatcatgttgtccagcctctttgtccttataaaaacatcaatatcttcataaatcaagaaaatgagtcccaaaattggacacatgagctacccattttctaagattttgctgaacggaactttgatcataggggtctctttctaaggcaacgtattagaaactcccagcatcactgtattccttataagaatcatattttttacattaatctccagaatcaaactacaagacaattaagttgttgcttttaccaggttgaaacttgccttgatttactatgaatgttggttgccttgatttcttctactttttgtctcagttctacatgttgttgttcttctggttttgctccttatgagattcgctggatctctgtatctcttcaactgtggtgagtttcatggacagggtcagaacttagggaaatgttgagaatagggtgtggtcctatgatgggtcctcctcttcttacaccttcgactgttgtaccactctttgatgttacaaagatgaatgacttgtggtccttggcccagagtttcatattctggataaattattatttatttgtagtgtacttctatatttttacatgctgtcagaatattagaaatacagtgtttcctgtcagaaatgccagctgagcaaaagccagtaagtcagatactaatgaatggattagcaaattatagggactaatgaaattaaataaagattattcaactaaactagtggctcctcccagtagtttagagcgttgctgaccaccttctttttgtccactcacatattagaattaaaaatgtcaaagtaaaattaaaataacattctcacctacaagaggtagggagaaggaaagtaatatttatctttaatgttattttcagttgtgcatttattatgtatatttttgcataaaataacttgtagtttttgtttggacaagccaatcaaatgagtctttaagatgaagaaggagagcgaacccacaagagatgagtttcgtatgtcttctcaaaaaaaaaaaaaaatttttttttagctcaccaaaaaatgttatgaaatgagaattttgaaaccttacctgtggaaatcacagtggtaatacttatatttcagcccttagatattcccagtggtgttttgatcttagatattcccccaaaggtgttgattagattctggctacagctgaaggaagagaatttttgctttttagctgaatagtaaaacaagcctctaaagatatgaggcatgggggaaaaaaactaaaggcttcttcaaggtggtgtaagggcataatttttgtcatctttattttaagagctctaccaggccagacgcggtgactcacgcctgtaatcccagcactttgggaggccgaggcgagtggatcacgaggtcaggatattgagaccacggtgaaaccccatctctactaaaaatacaaaaaaaattagccaggcatggtggcgggtgcctgtagtcccagctactcaggaggctgaggcaggaaaatggcgtgaacccgggaggcggaggttgcagtgagcccagatcgtgccactgcactccagcctgggcgacagagcaagactccgtctcaaaaaacaaaaaaaaagctttgccaaaggtttccccttagtaaagaatttaatacttgaagtcatcagattagatttcagacttcatttacccgctctatgcatttttttcgtcttcctgggtttggtctgcctgtgcttcttagtctacaggtgtcttttctctgtactgccaacctctaattggagatttattaggtgctcttaagtaagagaggaggaaggccaaaggagacagaaaatggagaagcaagaagaaactgatcaaggcaggagagggaggaactggagaggatggagataaaagatgtataaatgaagacaaatggaagaacaatgagatagagaggcctgaatggtagaaaaattctaaaactgagctagtgagaatgcatataaaataggggtctggtagaagaacttcagcaaaagtggtgtaaatcaatgatgagtaaattaatagggcaattgtgcaaatgggactcactcatttatactaagcgtaatacatcatgaatgatttagagataatgcaacccgtagggcataccttttaatctacccaggacccggtagagaatgctgtcacttcaagagtaaaaaggcagaggatcagaatattgggtgtgtctcttcattctaacagtgttaatgagatagattctgagcaacatgaaaattaaccagactcacaagcttagtttgtgatttatagattgaaaagaagcttaatatattccaaacatcttcctacaaacccaaaatatttaagtgttttgaaagtattcatttgaataggttaacatgtgtgattgccatggatggaaatgaaagtaaaatgagtcactgcacatatgatccaaggaacatctgagtgttaagtgggttgtaactgcataagaatccagtgctattggaagatgcatcagagtattctgagaccagggaataaaattctcttccatgtgctcccttctctttcattcgtgtgcctattcactcaccattcaataggtgtctatcgacagccttctgtgtggaaggtactgaggaatgtcctatgggttgctgcttctacctgaaacagaaacataagatttacatccctcaggccctcttaccagtatttttatgggaggatattgaggaagggaagggagaaagtgaatataagaagtggagagaagtcttggtttatagagctgttagggttccaagtctgctgttctttcttgattcagaaatggaagctcacaaaggttgtgtctggaccaaagacccaagatagttggagtgttgaggattagatgattttgggcttcccttctagttcattcttagaatttattcccagtttttgtgtttatgaaagttagagatacagtcttcaaccattaggagttagaggtgaaaataatagtaattggatgttaccaagtatgtaaacacttgtagggaagggaaatacataaataactaaattctctattaaattctgattctgaaaacttcaaaacagacctaatttagtaagaggggctgcatttttatatgtgatcccacagaatgcttctagacttctgtcactgatggggaaaaatcaaattattcaaagtcttgcaccatataacaaaaaagctaaactaagacgagatttcagggagtatagaaaccagcaatttgtgaaaaatcttgtgtatgaagagtcatgatgtagaacattcaaacaaatggatcacaagagatttctcaaagcatgtcttagaggtgagcaggcaggcatcaattttaaaattctctgttataaatgatcataagcttatgtttttctgtgtaaaggagaaataatttcccaattttataaaacaaattaccaatgatgtaaaaaaaacatttagcacagtattatatcagagggcatttaacattcttttgaatcatttgagattttcatgtttccatttcagagatcagggaagatgtgccttggagaggaagcatgtcttaaatctggaaatgatatgaagagggatgtcagcaacacttcatcctgggccagtaatagggagagtttcttttctctcgtcaaattgcttaaaggattctagttccgtttggtgtggtcactcacatttgaattctaatactctatgtgatatagattctgttgactactgttagcgtgaccccaatgagaaattaaacacttccctccttttcatttgcagtgtgttttagtttaaccttcatttgtttctcttttctccattcctcatcccaattcaggtatcagatcctttgacaattgttaacctgcccagctgggatttttggcattaagctatgactgtaacgtttctactaataaattagattttttaaaagagtgctgcttgccaagaagcaaagtcattacatagtgtgtatatgttcaatgtatggctataaaagtctccttagccaaacataatcgacagttaaaataaatttaaaataaccgtgctacctctagattttaaaattgttaaggtgaagataggtggtctaattttactctatttccatttttcttattcacagggtatatttgttctgtaaaaccacatatgtatcttatagtctgcagctgatgtatttatctgcctaaatacacatttctccaatggaatattctgtaatatcaagcatttcttttttagatggaaattaattttataacagttgaacatcatctttgtcaatcagcagctttatctaccataaagaacaaaaacgtacttggcgtggcctgctttaacttttgtagttcctatgtttaaactgaacagaggaatattatgtgaacaaattggaaaattatataaagaaataaaaatctttttactattatagttatctttaccccatagctttcaaaaaggcatttgaagcaatttaataaaataggaataacagtaagtactagatgtgagaggtgagaaaacaactttgtaaatcacccatctcacgaagttgcacagaggttcctgatagcccagacaatgaaataatgtgataattcctattttcagaaaagataactagctccttattttgttttgggtgtagaatgggggaagtggtatatttttgctaagttctaaattcttaggaaaatgttcacatgggttttgagagtcactgtataactgacaatgtccccagttacagatttccagaaaattcagacatggaattcatgttactcattttagttctaacctttgatgaaagattagggcattagattgaagcttaagtaagcaaaggcattcttcaggtgatgtggttcattctaatcagtaattttatgatggtgttcatattccattccaatgatcaaatggactagtaagcttgagaaataagacaaactagagagagagattattttataaatatgaaggaggctagtgaaattttggtccagatggaaagccacccactctcccaggtcaggactgcatagatgaagtataagcaaaaccgtcattcacactttgaaggtgctgctttagagagatgtcattatatgtggtgtcagatttttcaccctgttcagtactgggcactgatttttaaaaccacttatctatattttttaaatgtcttctgactcattggattgattttgtggacctactggtagtctttggatatcccccagttaatctttgcttccatgatgagcatttattgaattctattcttatgccaggcactgtactagattttaggagtacagtagtcaggttttccttgccttcatggagtctctggtcaaatactttggttcttatatagcggttcatgttccgacacgtggttacccacacaggctttagttaacatctgcatcacctgctgcacattctcatctaaaatgcgtatgtgaaagtacagttgtagccactcagtgtcactcaccagtggggctttaggcctgagactttccgatagcctctaattatgtaaaaccatgcctgtattcaggagtcagaagtgatcaaaatgttttaggaagcacaccgtcagcatagatgtgtcaactcagcagcaagatttttcattcttttaaagttacacatttcataaagaagaagggtatcagtgtaaacttctaaatgcaggacaaaatgcatgattggggatggagattggagtggacttgttcaaagagcagcagcaaatgagacattaaaggaatacataggaagccacttccaagtacttccatttttctttagttgtgattgtgagatggttccctactagttagagaaggaaaattttaaaatgctttgctaaacagatgatccttaaattggtcactgtataccgtgatgcagcctaatcaaaatggtattcctttgagtgagtgagccacagagactctcgccaaccccttgtgcagctttctattaacagtataaatactccattgttgtaaagcagtttatggttaacaaagcgctgtcacagacacgttatcttagttttgcagattgcctttgtacatgttattctcatttcctagcatgccctctatccctgctttgcctgcttagcaagctcattcttatccttcaggacataacaccaactctgcaaagtcctcttgagacccttctgagcaggtagatggtcccttccccgtacttacacaagccctgatctcatctctgttgtcatttgttcacatcactgtttctccctggagactgagtctctcaagggtaaggacactgtgtgctcttcatttttcttcccagtgcctttgtaaccagtcttcctgggggatactttgtaagtaaaggtgaatactgtatggtgtgcagcttaggagagcttaagccacttcctaagttaagatactaagtagtagataagagtaaaacttaagtgtcttaactcctgtttttatcggtttttctggtttatcagtttattgctcatctgaaaacaagctgtccacatcatactcatgctgttctacctgtcagagatatattacatggtaaatgtgagtgataaaggaggataagttctttgtcagaatgaggacatttcggttctgtcatcatgcctgaaatgcatgatttcacatgatttccatgtgaaataaaacattggtataaaagggatatggacaaatttgtggatgttagaaccacacctttttctctgaatttattttcttctcactcctacttggcatattccctgtcattgtttgagagtgtgcaccaatgtcctcgtctcagggacaccatttctttcccgctattagagtgtctggatgatgccgtacccttagtgcactgtcctgttgaaaatttggtacattagttattttaaggtttaaaaacattgctgcctacataatattccacctctttggagcatttgcattggagtgaccagtggcttgaagctctgtatggtggagtgactgatggtagttgaagactgcaaaagtaggtatctgagggctggaaggcattcctggcacccctaaaactaccccactgggggccatccaagcctgtgattaacaaaccctagttatttgctaggtagtttccacatggcatagtaggatatatatatgtgaggcacaatacagtgtttatgtgagaataatatagattatttgaatctaggctgcagaacctacctgaaaatgggttttacagttttgtgtaattgccttttctttgtgtttgcatagaaggcattgcatagctggaagatgatggcaattataatttattatgctgtaattgttacctaaatgtttttgaataagcaaaaatcacatctgtttaggaataagttgcacagcaagagaattccctttgaaatgaataccgtgttctcatattctgtaactgtacacataaaacaacatatttatttccccactgagtccattacattcccaagtcaaactgcatcctctcttcctttcccatattaaaccctttgatttaatggaggttttaactactggttctttagggaattttcagtaggctttgcacagattaggttattggaaagtatagttatttgcttgtaaagtggcagttctgtgtcaaaattgcttttctctggagctgcaacagtaaaaacgataagcttctgctttgcatccaaaatgccctgatgttcctagcatgatcgtttttcctttgcttcttgctcagcaccattcggtcacaggctggtttggacaggcgaatatgagcacatgtagcccagaggactttgatatccagtggtgataatagacaaggcctgtcttccattctggttgccactggtctgtgacaaccagtgttccgggcatggtgagcatagtgctgcttcccttctccgttaaataggaaatgcataagcctggagtcgttttgtttgttccacagaaacgtagcagttgaaataattgccttgccatgcccaggctaacaggatttatcttccattatagatcatgaagacataggcaagaatagtttactcctctaaatttactaggctactcacttcgaaatgatttcactgtgtaaaagagaacagtcctagctgtggcttagcctagaaaggctttgatacctagaaagatgaagggcagaagtgtattctctatttttctgctcccagctcataaaatagaattggagtttatgtaaatagcagatagcctgattttattttttatgccccagttgcaagttagtgtctccttaagatgggtcttaatcactgacgttgtgtgcttccattcagcacctatctgtctattaagtggcattctagtggcctccaagagttgagtactttattctgatcagagtcagcctgggtgaccaagatgggctgtatcaatctgttacacctcagacccactggaggccacaatctttgagtgtcttttggaagatactgtcctatgttgttctagaatgctgactcctactgcttaaacctccgttctctctctgtttttatcttaggccagatgtcctttataaattttgattttttgttttttgggttttgtttttggagtttggatctcttagttttcatcctgaatactgttccacactgcatatttaatcagttaaatcttggtctcctggctttgaccatcaaatgttactctattgcctcaactctattgagttactccaactcaactgctcccacctcagggtctttcactacccattcataggcagtagccccttgtttctcttcttcgtgaaacctgagttttccttattgtacttatctcaggcattaatggatctgtgaagaagtatgacgttaagcttaaaggatcaaaaactgggcttccctatgtatgtttcaagtttcatttgtgtgaccaagagagttcatagtatagatttgaagagttcaatcaagaagctaagatattaactcatcttagtaatagccttttgtctacttcatccatctgcccatctgtctgtcaatctgtatacattattgataacttccaatgttgtaaacactgggaataccaaaaaaaaaagaatgagccatgcacctttccttcgtaatgactacattaaagccccaagacatgaagctacttgctgagccttgcagctgacctgtggcatagtggagactagaacccatttctagagggatcttcctcatacttcccaaggtcagttctctttaggcctttggtattcctgtcttagttgttgtaagagtagatttcgactcatcaaacatttgtgatttggaagtatcgcatagttgaagaattgaagaaagctgatgggaacaaagtcattttcaagtttacttgagcacatagatatcatgttgactactttgctgaatattcagaatcatttatatttagtatagtaaaagtgaaaagtatctgtttttaaaatttggaaaacacacgaaatacaatgaagaaaactaaagtaacaaccattttactactctttttatgtatttcctttgagtagatatcaaatatatcagcattttcagcatatacgtacagttttgtgtcctgcctttttcccttcaactatataatcagcatcttcccacatcgtgagatgtgaattttttgaaaacatgataattaatgcaatatgttatttcaaagtaaaaactttttatttaactattattgtgtgtgtaactttattttctgtgtttaggttgtttctgatttttcacccttatcaaccatgctgaggcatgaacttcctattaataaatcattgtgtacatctgtcagtatttccttaggataaatttcttttagttctattactgcatctgaggaaattaacatatcaaagctattgatatgtatttccctgggtatacatttttttttttttttttttgagacagtgtcttgctctgtcacccaggctggagttcagtggtgttatcacagctcgctgcagcctggactgcttgggctcaagtgattctcccaccttagcctcctgagtagctgggaccacaggtgtgcaccataatgcctgactttttttttttttttttttcaatttatagagacaaggtctcactatgttgcccaggctggtttcgaacttttggactcaagccatcctcccaccttgacctcccaaacttctgggattacagatgtaagctgctatgctaggcctcccagggtatacttttaaccctgccttacaccacccagaattcaaagcatggaatccttgacccagtagccagagtatttcttatcttaagtttaggaaagactactctgtggtcaaatgtagtcacagaatttctttccaacaaagctgtctacgtagttaactgagaaccgtctccaaagggttgttcctcttgagggaggtttcagagaagagatggcattgatgtaagtcttgaagaagttagagctcaaaatattgtgaagaggaagataatttttttttttttttttttatcgagacagagtctcgctctgtcacccagactggagtgcagtgacgcatctcggcccactgcaagctctgcctcccgggttcacgccattctcctgccccagcctcccaagtagctgggactacaggcgcctgccaccacacccgggtaatttttttttttatatttgtagtagagatggggtttcaccgtgttagccaggatagtctcgatctcctgacctcgtgatcctcccgcctcagcctcccaaagtgttgggattacaggcgtgagccaccacacctgaacgatgaatttttctaccaggacaaacaggatgttcagaaggaagacattgttagaactgtacataatcttagacatcatctatcccagtggtttatcaaatattttcacagacaaaacattttttcaagccaaatcttgtctagagtactacaaactgattgaagtgaaatgtctccagttaaatcacagtggatgggagagctcggaattgagggtagaacctcctttgctcagctttcttagagcttcctatgcacctgaaaaacccaaagcctctttttttggttttttttgggttttttttgttttgttttttgagacggaatctcacttttttgctgaggctggagtgcagtggcactgtgtcagctcactgcaacctctgtctcctggattcaagcaattcttctgcctcagcctcccgagtagctgggattacaggcggccaccaccacgcccagctagtttttatatttttagtagagatggggtttcaccatgttggccagactggtctcgaactcctgaccttaggtgatccacccacctcagccccgcaaagtgctgggattccaggtgtaagccactgcacctggcccaaagtctctttaaaaaacaaattttaagtcactccagtttgaagtttaggacacagagacaaactgtgactttcctcaaggtcagtcagaagtgattctgaaaccacctttcagtactttaaccctgtccaaaagcagccattttagtgcttttatcactagatgttcccatgcaggttgagagagattatttctgttctgttaggttatgcattgttgcagtgtcccaagagataaagtcccaagatattaatgtaagtattagcttctgtaagatgttaccccaatccatattaaccatgtctggctgaggcatgaaggatctattaaattatatccaggttcctattaaatcactacactggcagtaatacctgggctcaccttctccttaacccaaattaacacatgctgttagtggtctcaagtctaaggcaagttcctgagatgaacaagtgactgggaaaacaggagaggagaaaattaaaataaatgataggctgaccttctcacaccacttgtggtttctcaattaaccaaaagccagacagctccacgttgctgttctctcagtaataggtttcaccctcccatttaatgccagcccacacgggtgcacacacagacacacactttgctaatcagattggcagcaaatagaattaaaccattaaggcaattaagcaattcttagataacatttgatcagttcaatgaaaatgcaaattcattcttcttttggagaaataagttgatggaaagtcatttcgtgttctataatcataattaactcttttccaaataaagattgcaatgttttgggcttggagctacacagatggaaatgatttttttcattttttgcttcactctgttcatccttttgtaatgcaccatgtttttctgcctccagactctttgggacatttaggtcatcttacctacaatctcttccttgtgcctcaaggcaaactctgttatttactctcacacatgatgactcatgcattaaacacctccttagaccctgagttcggaatagatcctacagcattctggaatgattttggtcggatattcatgtgttgtagatgcactacttggctgcttctcatttctctctattccccacacttacggtttctcctctctcacaagctggtggggaagagaatgttgcacccaaaaataggtgcttgaaaatgagcgtgtggtgtctgcattttcatttctagattggtatcattgaagcctacgttccattctgccaccacagcctgaactttcagcaagaaaatgatgagcaccttgcagcccgtgcttccctcacctgccaaggtgcctttgtgctctagctcagggtttccaaacctggtacatcatcagctggggacatttggaaatatttatagtccacagggttttaatccagacctatagaatcggtatgtcccaggtttggcttagggattttcttttgcttttgtttttttcctttaaaaaaaaaaaaatctttctgtttgataatagggatcagccagtcttaagtctagatgccattttttttctacattggagaccataacatgtagtctgatgcatgatctgtcaatgacacagaaatcacttggatccaaagaattttatgatagccttgcttataaagaaaaataacaccttatgtggcaggtcattttatagatacacacatatgaatagtccactgcatcatgcgtgtgtatatgtgtatatcaagtgtctttagaggtaggtaaaacataagaggcagctgttatcacctagggcaggggtgtccaatcttttggcttccttgggctacattggaagaagaattgtcttaggccacgcataaaatacagtaacactaacgatagctgatgagctagaaaaataataataataatggcagaaacatctcaaaatgttttaacaaagtttacaaatttgttgggccacattcagagctgtcctgagccacgtgcgggctgcgggttccacaagcttggcctagctagatattatatttaatgtatctccttttcagtcttaataaagtattgcagccaactcccatccagcaggacacatggacttagtgtgcctacctgcaggtttttgagcatgaatgtaaatattaatagaaaaattgtgaatgcttctcaggaatgtcaccagtgatttttttcccccaaagaaacctttagttttgctaatccctttactagtacatgtttgtagaacacatctttttgagaattttttggggatactgatcagctactattaaagccatcaagccagcggtgccaccagtgtcacaaggaagaacgatgttttgggaagggattgagctcagcattccaggaaatattttttacctattcattactgcatgcataggcttacattttctcaatttaaaaatacttctaaagggtgggcttttgggatgtagacacataatgttctcagcaatactgtaaagcctcattaatttgctaaacaaataagtgagatggtaaaggatattgcatagattgtaagggcacatttaatcatctgaggtttaactggctctaaaggcaacaccttttcaagctcttaagagtctatatttacatggatagtaggtcttcttccttcattaaacttgccctctaagaccttttagctgttagttagaattacattttgaacttcaggataattctatatttctttcttaaaataaattctttatatgagcatttagaccataattcaaactgaggtttcctataagttctgtgttatattttatttgcgtgcatagtgatattcataccacatctgttaaagtatgaagggaggaaaatgtcagcaagtgtattgtgtctctgctcacaataattttccaatgaaagttcacttaaatgagggattcatatatattaaggactgttgttggtgattagtacataaaaatgtgggtttttctcataagtggttttaaaacttcagactgagtacctcttttgtttaatttttgcacttcttggaggcataaggtattttagtatgtgtggatcttttttattgagtttgcatagtttaggagttttttggcttaaaataaaatagggaaaaaaagctctcttaaaatagtatcctttcttgaacccataaagtagggctttgaagacgtgcaacatttgtgaggttctaaagaggggattttgtggtgttctttccagtgcttccttccttccgtcctcaccaccctgctgtaatctgataacaaataactttccagtcagtcaatttaaattatatgtaggctgcaattttttaaaatttcataatggatgctatttaaacacaaacatacatttaaaaaaaatgccatactaaagtccaaaaggaatggtgacagacattttatttatttagagacaagttctcgccctgtcacccaggatacagtggtgtgatcttggctcactgcaacttctgcctcccaggctcaagcaatcctcccacctcagcctcccaagtagctgggaccacaagtgtgcaccacgatgcctgtgttttgttttttgtggtttttttttttggtattttttgtagaggcgcattctcgccatattgcccaggcttatctggaactcctgagctcaagctgtctgcccaccgcacccagctgacattttaaatatttatttatagagcttcattatttgtacagtgcccttaaagccaaaggcattgattaggcttatagaaattgcaattaggccatgcacagtggctcatgcttgtaatcccagcactttgggaggccaacgtgggaggatcgcttgagctgaggagttcgagactagcctgggcaacatagcaagaccttgtctctagtaaaaattcagtttaaaaaagtgggcatggtggtgcaggctggtattcccaggaggctagggtgagaggattgcttaagctggggagattgaggctgcagtgagctatgattgtgccactgcacttctgcctaggtgacagcaagaccttgtctcaaaaaaaaaacaatgtagtgagtcatagttatactaaatgggcttgaatactataactagttttagtgttatagtcattaaaaaacaccataattccaaatggatataccaattactgcttgcttatcttatgcatccttttcctctcctctctatcccccaaaaccactcttgaaatcttcctgtccttttgctcttatcctacctggccatctatccaccatttatctagtataatttccataataaaaccaccagcttgcattagtgtgttggttacttcaaaggtggctaaattagagactttggttaaggacaccaaattcttaccaatttgatggtcttgaggggcaggctgtctggctcatctcttttctatctgctgcccaccttttactgcctgccccactaagcacttctcatcatgtccgaggagagagtaagtgggtgcgtgcatgcgtgctgcaagtatctgcatggcattctttttcctgaaagatcttctttttttttttttttttggccatcatttccattctgtcctaatatatcctttctctttaaaaaccagcatctagccaaggcattgatgaaaagttttctttgagctcccttgtggctgtgcagaagagtttattcctgaggttgctctcatttagggttggaatctttgaagataaaatacttcttcctacctctcacttgagatcaaggaaacctacataagactcccagagcaaaaggaccctgtaacacttgtgccttggcattgccatatgctctgttgcgcaggaatggggaggaacggccatccacatgccacccccacttccactcggaaataatagggggtgacaaatggctgctgcattctattctgttttaccaggctgtttctttcctgccctcaagaggtttctgactttctgacagcagggagctgaggttgatctagcaactgggaggattgcacctggatttgcagaaatacacatgcacatgtgtgcacgcacacacacacgcgcgcgcgcgcacatacacacacacacacacacacacacacacacacacagtgctgctgcaactcccagagtatcacataatcactcttctggctttagtggttttcctttggccacactctgctcttgtttggcttgctagcacagtaatcagaggaaagacagagactctttgcactctaatccccttgtgggttacagtagtttcagatagaagacactccagagggtgctatacaatttggaggtttataaaggccatcttctggcccccatttccctttaagaaatgagcccctcaatctgcattatacatgttcccttactgctagaagggttttactggtgccctgacactcttctcttcctcacccctcccagagcaagaactacaaaaacatagtttttttctcattttcttttagatgtatctgctgccatttattttctctctggtgattgtgtgatataggaaggggaagcatcaatggcttctttatatcctaaccacattccttgactgggccctgtttcacatctctgactcctctagagattactcagccaacatgctgcccctcctcagcgcatcaccttcttgggtctcagggcttggcattttcattcagccttgcagttccatgctcatcaccaacactgcagacatctgctgccactttcctgcctaaagcaagggaattcctgtgattcacaccgtgagcagaagcaggggtcctcttctactcagcattatcccagtttgtctcactcctttagccaatatcatgaaactctgaaactttatagcaggatgaaaacttaagcctgtagtctaaagacccagaattatgagtgaggaaactgaggccaggagagccatgaatgatagtgtttacttgattgctgtttcagatttcaccagcttttattgatacttcagcattttacttagtcgatatatctcttcgtgtgactcaaagtatcccagtggagcacagttaactgccctggatccgaattgccactggaggccgtggcagtgtcggcatcaatagggatcacccatgaccttttatttgggatgtagtagggggtctgaagttgggaaagtctgaggtggtactcagttctgggttgaatgtcttgtgaaaatcctgtgaatacatcttgcggagaaacacagaggggaaaacttcctgttgtgagagcagggctggttcccttttaaaaaggtataggatgaatattccatatttgaaatacttgagaccagaagtgttttggatttttaacttttttttttttttttttttttggaaatgctctggtgaacatttccttagagtgtcatgtgacactcaaatagtttcagattttggagcatttcggatttgggatgctcaacctataatacccaaaggctctatttcagtagaatttattggtttgctgattatagcagtgacatagttgcattctagagaccttagaaaatgcagaaaatttcaagaaaaacatttaaattgtgctcatagtgaaactgagaggtgaccactcttaatattttgtggcataagcattccagtcttttatctttctcaaagtttcacataaactttctcaaaggccattaaatacttttccatagcctgattttttgtgaccacatagtatcctattatattgataataccataatttacctaacccatttttatatatttggattttttccaattcatcattattatgaataatggtgtatctcagtggttattactttgcactgcatttcttatgaaagtattgagtaaaaggaagtaaagccctctcagagtgttttgtaggctgtcacatttcactccataatgtcctagtgtttgttgccaccagtgatatatgaaggtacccactgaaatgtcacacctttttggttttcctttttaaaataaaaaataaaaaagacatttaaccatataatattgttcttatatatgatttattataatgtagattcacatctttgagttcataaaaatattgaatttggattctctccaatttcccttttagtagaaaggctaaagttcggtaagaaattctacttggaattttattgaattgagaaacatacttggatttctgtaactcatgacaagtaacaaataaacaattagccaattaattaaaatatctgttaaaaccttgagtaatgcagagatttagttaggcagtgtagtttaaaaaaatcaaacaaaccagacctatgctgatctccttggagatgaccatcaacaggaaagatagactttaaacagtgtatgttgacatagagcaagtttctaattttccatcatttcaaggtgctggaaattatatggacataaatgcctttataatatgtgtacatctggtgagtataaattctcagatttgaggacatttccaataaaagactcacatacaaagtataaaaccagtaagcaatggaatgctaatcaagtaatgaaggattcaggaaagaaaataaaattatgccaaaccatgtaggccaagaaatgcaagtgggaaaaaaaaaaacttaagctgatgtcaaagtcaaaataaaatgtagagacaaatctctaaatttaatgttttatttgggaatcatagaatcacatttggggcatgcaaacagactgggtggtcttcagcatgtccaaagaacaaaggaaagattgggggttttattagaaagggaaatgttacttacagttttgaaagaaagctcattgaccctagagaagcttgtgggagctgcccgggtctgattggtgagtgatggtagtagataaaactagtcttaaagtcatagcaggttgtttcagcagctgctaagtaaaactggtcttatggttacagcaggctgtttcaacagctgggcttggagaaaactcaattcttggagcatgtgctgtgtcttgagtactttttcccgctgctctgtcaactcttctttagttgggcatgacaagaatgatgcaatttgcataatcaactttcacactgagtttcctgtagcctatacaaaacataaatattagtgtttttttacctttttacagtttttattgtattgtctattgaagtgaaacattaaagttatcagaatagagaaacatttgcctatcactacacattgagaagatactgtaaagagacttgaacaaacactgggcagtatgatgcgtagaactttcagtctagtttttacaagaaaaagaaaagaactgtgctaaccattttgttcatcaatataaactcaagtaatgaggttaaattgtagttctttgcagagtgcctggccaccaggtccgtaatcgctggaggtttgattagatattgagaaagaaatctgcaaaccttggcaaaatttgctgcataattccaagactgctggttcttaaatttatctccatcaaaacacagatgtcctgtgagctggactaagccatctcactatctataatcaaattattgctttcttttttttcccactgaaagatcgaaaaagaaaaaatgggtaaaaattcttagataactgtttttgtaatgtgtatttttgttgaaccttgcctcattgtataatcaagtaacaaatatgaatagaaaatactattgactatggatggtacttagctcaacagcttattttgaagaggaaaccatcatgtttttaaatatgaaacataatcatgtactttacgaataaaattcttcctatttcttacaacaaaattgaacatttcaggatttaatggtgttccatagccactagcacgcagtagctcataatttcaaggtgtttgaccacatcggtcagtttgaaaatcatacctgaccatcactattgaacacctgaagtgcaagcatccatgatggagactggagctgtccattggctactgcctttcagactaggggtggcaaacctgaccctttgttataaaaatgaaagccctcaaacgtgttcttgtcctcacgaagatttttgtctctactgaaatgcctgtaggccatttttggaaattatagctagtgtgctcactaaagtttttcttatgtgccagacacatgctctagctttacatacaatagctgtaaacctcacacaaccttgtaaggtagagagcattattatctgtattttattggtagggaaactgagaggctaagtgccttggccaagatcaccaagttatgaaatcacacgaaaggagagcctagatccctctaccagcactccttcctctatatgcactgccttgcagtaatcaagacttcactaaaagcaatttcagatctctgcaaatgtttgaacaagagctctgttgaaatgccataaaatataggatataaccttagctttgaaacattttgaggggagttaccaacttaaaaaaaaaaatgtttacctttgagcataaccacatccgaaagagtcacagagctagtcacagaatgtacccctcgataagtaaacaacataacctgttgaataagtaagtagtttagtcttctctgcctgcatgttgctaaaaataacttttgctttggtatagaagttttgaaagttgtgtagttcaatgaatatttgttgacagtgattgaaacttacattgtttctctcatgctaatcttgccaagctttggtggtcttcaagtatttgaaacaagaaagggccaggccagagccctcgttttcagatatgggacaacaaccaggctttctccatttgaaggaagaggaaagagataagggaattgttgcagtgaatcctgtgggccccaggagttataacaattgttttctaggacatacccatttcactcttcttaattttctgccatcagcatttctggggatgtactaggaaaatggaaggaacatacccagcttccagggtttcagtagtaaagtatagactagtttaagagcaaattgattagatcacttctactcctatgatgtccatttctcatataaagataagctgagaaaggtttattttaaaattaaagctagttgtttaaaagtgcggctgaagttaactcatggattgccctaaagtattgagctgtgattataaaaaaatgtttaccaaatattgtcactatggctcttatgtagtgaagagaagaatttagccttaaattagttaaaatgtgcaaaccgtttagaacagtgcttaacatatagtaagtgctccataggtattacctatgctttagaacagtagttctcaactggtgtaccacacggcacaagtatatctttatcctttctcagacatgtgccgaaacatctatacacatattaatttttttttgtatagccaaatatgtaggtgaagtgcacactgatgtttcacttggctgaataaaataagaggtgagagacacagtgtaatgtcaagtctttgcttaccagagtgaaatggggcatcgcctttcgggtctataggggtgcactgagcagtcccgttaaaaaggcacatgttcaaaaagactaaccaggtgagcagcatgttaattaccactgcttttaagaacactggaaaggcaagtggttgtatggtagtagcaattacattgtaattactgtgacttagttagaagtttttgaaccccttttgtatttcaaattgccctgtacatacaaagtgggtcagaaccatcagttaagaattagtggggtcagttcctgtctgtagctattaaagtgatttatttattgtcttataacattatactatattaatttacacatagccttggaaaaactctttctcagacttctaggccagagtctaaatacatttatgaaacttctcaggaccaggttttgatagtgcggagatcagggagagcctaaaatcataagacttctctaatagagttaggtcattaaagaatatgaatatatgaagagtagggcattagagacaacattctatacctaacattttggtccaaatcctataaaggtttctcacatagaaagctgcctttttgcatgtactacagcttgtgtctctaatatcctttctgtaccaatacacaccacatatctgattattgttcaaatactcctcttaacttaccaatgaaagcttcagatcacttaaagagattgcagatactatagtgaacatagtagaaaatcattattctattgtatagtaaaacccatgagttacatctaaaatgttactactgtttttatgtagtctttaaaaaaagagattatgaaggtttacaattatagtaaaacttattaagtagatgcatcaataggaaaagaaaccattatcctttcaacccagtcctatttcataaatagcacatcagcgcttcagtgattaagaaacatggctcatctttgcagcatgttgcttttattactttttgcccacggacctaagaggggagaggtaaagtgatagaggaaaaagctccaaggcaaatcaagttcacatatttttatttaaggattctaggaactcgaagactgaatcaaacttgttacttagtttttcactggaataatggctctatttctatagtagagtgagtagaaggttaatggtatctgccattgatggtttactaactggttaaataactgattgaaatgtggtaaagggagatgaaaacaaactaaatctttttttttttttttggcccagattttcacgtttagatgccatgaagcttttgattgtgggtctaaagacaaactgtgacagtgattggaggcttcttttaggggtcgggagatatatggaaggacaaggaggacagaggaattcaatctcctatgcagtctctgcacctgttcactaagaaataagtcagctgaggccggacgcggtggctcacgcctgtaatcccagcactttgggaggccaaggtgggcggatcatgaggtcaggaaatcgcgaccatcctggctaacatggtgaaaccccgtctctactaaaaaaatacaaaaaaattagctgggcgtggtggtgggcgcctgtagtcccagctacttgggaggctgaggcaggagaatggcgtgaacccaggaggcggagcttgcagtgagcagaggtcgagccactgcactccagcctgggcgactgagcgagactctgtcttaaaaaaaaaaaaaagaaagaagtcagctcagtccaggcagtagactttggggtgggccttgatggaccataagacctttgctgccctgtgacttctcccttagttctcagtctgttcagaaaacaatttgcaacaacatcagagagaaatagaatgcaaaacacagctcccttttgatgaattggctcctggctcggcctgcaaaagataacatggtttttcccttagaatacttgtcatgccaaaatgatggtatcgtcctactggggtttttaaatgttaatacaagtaaaataagatggatttttttaaaaaatggcaagcgtttcttagtttggctctcttggcttttgtttaaaactgaagatcactaagcctagatttttgtgtctccagtttaaaaaaaagtaaatttcaaaagcagttcctagaactctccctctccataggcctgttgtgagatgcctatgtccctataagtgtgcttcaatctaccagctttcctaaaacaggttgatggcttagtggataaagatgggacttacaaagcctattgattctcttattgtactcatctgtagaatgggaatagcaatggtacatgctgatcttacatgatgtgaggatgtgatgaaataatacatggaaggtattgagactactgtctgggtcatagcaagcagttttgccattattatatttgtcatgacagttttgccattattattaacccaataataatgtcgtgtcccctttctccattcttgtctcccaaagatgtcacacattcattattgccaaaaaacatttttaaagctttctgtttttctggtacttgcagtgtggctgacgccagtagggtataactcctctgagaatgggtgctgaattctgttcccaaggcctatggggaaatctctttttgttgttgttttttgttttgttttgttttgttttgttttttgttacagtctcgttctgtcacccggggtggagtgcagtgatgcaatcttggctcactgcaacctctgcctcccgcattcaagcgattcttgtgcctcagcctccctaatagctgggattacaggtgcccgccaccacacttagcgaatttttttttttgagacggagtctcgctctgttgcccaggctggagtgcagtggcgccatctctgctcactgcaagctccgcctcccgggttcacactgttctcgtgcctcagcttcccaagtagctgggactacagcacccaccaccacgcctggctaatttttgtatttttagtagagacggggtttcaccgtgttagccaggatggtcttgatctcttgacctcgtgatccgcccgccttggcctcccaaagtgctgagattataggcatgagccaccgcgcccggccacacttggccgatttttgtatttttaatagagatgaagtttcaccacattggctaggctggtcttgaactcctgacttcaggtgatccacctgcctcagcctcccacagtgctgggattacaagcgtgagccaccacaccccgctgggaaatatcttaaaagaatcaaaataagaaagttactctacttaaatcgtgtgctttttctgtgtgtgatttatggtaatcttaccatggggtatctgattactttagaaagatccatttagcttatttttttcttctttgggttatttttttcttccttccatttgcacagcctccccccaaataaaaaataaagatataaagtctatcttctccctcttgtcagtttaagtaaaaagaacttttgcttccattttaataatagaatttgtgtgtatataatataggcagtgatttggcctcaagctgagtttagatttgaaaagatgagaatattaaagcttgtcagccagcccacaaaccacttaagtatttctgatctgacaggatgtggggtggagttctttttcttttctccaccaacacccctcacaattaaaataaatcagataaaatagacactgtgaaggtgggactgaaagtaggtgataggaaagggtggccccacaccaggaccagtacatatgcagaaattccgtccaaagtacttcaagggtctaggacagtgctgtccagtacaactttctgtcacattgaaaatgttctgcatggcccaacagagtagccacaagtcacacggggctgaaggcagatagtgtaactaggatttgaatttttaattttatgtcattttaatttaaatagccacaggtagctaatgtcttgaacagtgtaggactagaaaaaatagattttgacacacattctcatgtatgaaaaactgccaaagagcatcagattgctctagttgtggaagattgatttgggagtaaaagaacgtctaaactgctatcctgtggaagagaaatagatttctattttgttgttccatagggaagaaacaggactacttgggagaaactgcagagcaacacatttaggctcaggctaaaaaaacttcctcagaattagtcatacaaaattctactcagatctcttcgagtttaaggacgacccccaattctgagagtactcagggttagacttgatggcagtttgacgaggacctgcagttccccatttataacacttgtcccacacagagtcactagttgtgctaagtattagctgaaacattgttttcataagtgctctgaagctaccaagaccattggtatcattttattagacatgactattatttagctaaagacaatgtactttgagtcactgtaaggccatttgttctaaaagaaacaaaaagattctccttgggatcccaagcggaaccctgttgttctaacagtaaacatgctccccatgactacgataggtggcactggtcattcagttgttaatcttaaacttttcagtgattatttcacctggaggggatgctgacattggcacaatagcctttccaaatacccagaaaatttctgataataagcaaatggatgaactcacagtagttcagctgtggtagatgctctcgttgctggttagtacttgtagcatccatcagccacggacccgccggttcctactgttggatgtaacagattcatggaaaagaagccttgtaggtaatgtcacagcagtggtcttaaattgcaaagaatttctaccagcctcacgaaccagggcatggcatggaattcattggccctgcttatccccccgtggagacgtgggaatggcaggactgtgaatgtggagctcagttacccagcagaggggtaacgctctcataaagaactcccacagaattaattagccgcattttagcactggagactgcacctcttacatagtaggagcgatggttcagaaagataatgaaggcccttaggttattattgatagaccctgccttctttttaagcaggaggacatttcctcgttctttctcttgttaaaatgataagtgcagagcactctcattaggatgtagccccttggctcccaaggacacagtgagatttcctttccttccgtgcatgttgtctctctctctttccctgccatctcattctgacatttcaagtaaacaggcatacatttacctgttggtaggtgattacatactaataaaaactacaagtaaggaacactaggcagcccccattttacaaattggcatttagtccctctataatctcttctctggagaggagtaatatccacctggatgtaaggctgggtggaattataatgcagccctgttacacagatggctgtcttcgtctgtgacatgtgtgcacacgtagacattcttgcatgtgcttttctgtcagcccagattgatgtgtgcataggttaaattgctagagaaatcagctttctacaccagttgcatctgatacaaatttctacctctggctgggccctggtgccaagtgtttgctcattttgacagtcctcaaatttgttgctttagatttttttcctctcatcttaaaccctctagtccagactttcgtatcacactttattatgtgtagatagctctaccaagaatatcaagggtatctagtaaaatcaccctcaacttccatctccgccatttaacatgaaaacattgttattcatgtttatgtcactccctctggagaaaaacatgttcttcattcccaaggtcaaagccatgttcttcaaccaacgcttacagtctcctccatggttttgtcacatcagtcattcctttccctttgccttgtacctgctgtctttttcaccacttccctctcagctcatgaactctagcgagtttcctccaatctttaaaaatctaaaggagaaaccacctccatcttgtgtgtctccatccctcaaggtcaaagaacttttatgcttgctgtcacccttcataacccgtggatgaatagttactgtatcctattgtgctaataaaatagtttcttaatacccaccaatgactttctaataaaatagcttcttaatgcccaccagtgaccgcattctgcctagttgacaagctgttccactttggatctctctcatcccatggactgcctgactttgccactccttgttcccatccttttctgtatctttgtcaggctctcttctctttctccttaaatattcgtcagtatcccaaagtttatagagaatgttacttaacagcatggatatgaggaacaggtaggcctgaattcaaatccttgctccactacttatatggctatggaaacttgagtaaattagtttttctgagtatgttttctcatactgacttcagatggttgtgaggatgaaattagcaaatacatgccatgtgcttagcagagtgccttaggtcactgcccctggcctgtctttcccctcttcccactgttcatgctcttacctgccattgttattctttctgttcctggcctccttcgggaacccaaaagccacattgtcaaccacctgccagacacctttctcaaatagaaataactatccctttttcccaaagtaaatttctccttccccaacttggcttgatagtctctctcaagtaggaagcacagatgtccatttgacctcctccctctctcttaccctcatatccggtcgacaatccatgtctatcctagcccctggattcttgagtctagacctttctttgattcttaataccaccatcttggctaaggcttctcctacctccagcttagattattgttctggcatcccaagtcgttccccatctctattctattgtaagcattctccctgaaattgtacatatattatttagttgccttctcaagttgttctcctttgtactttccaatcccttattaacttttggctgaaggtttcatagccaatctgtagctcaggggtagaaaggcaaaaatggttgatgccctgcatagagttagaactcattaaatgctgaattaatgcagtataaaataaagcaaaataggaagtgtagtaagtcataatgtaataagaagtggggataagtggttgattaaccaaaagttagctttccattgataaatactacagaattagttgtagaaaaaagagatttataacttgatcttcatttctcacctgagcctatgacaagagggtaatggattggacaaacaagtggaaaatctcagctggcatcaatgggctgtcttctgctcccacccagtgggtgtgaagtcactctctggctctctgtatacctctccttccagccattgctgatggagccaggtctctattttttttttttttttttttttttgagacagagtcactctgttgcccaggctggagtgcaatggcatgatctcagctcactgcaacacccaccttccagattcaagcgactctcctgcctcagccacccgagcagctgggattacccgccaccacatctggttaaattttttgtatttttagtagagctgagttttgctgtgttggccaggctggtctcgaactcctggcctcaagtgatccacccaccttggcctcccaaagtgcttggattacaggtgtgagccaccacacccagcctggatctccattcttgatataggtgttttgatcctaaggagacaatcgttggtgaatttgaaacagattcttcaggaaatatagtgcaagaccaaaattgggtcccaggaaaaatcatgtgatacttcgtaatgcaggtctcttgtagacacaagaaggcacacttgctcgtttccctgggtttggtttttgttttgttttcttccccctatgtctcacatcctctcctgcaaccccaaccctccgtaccgcaggcaagaaaacattgatgtttctgcatctggcagcatgtctctgggagaagaggccggcggaagggagtttgatgtgtgagtgacagatccccaggtaacaccactggggaacacttgatctgacctgtttgaaggtgaaaactcaccaggtcacactggaaacagttgctgctgggcatggctttgatccttgtttatctttttctcttttttttaaccttcttgaaaaaaatgttttgtacaaatggatactttttcctgtgtatattttgtctgctggagcatttgtatattttgtgtgtgtgttccttgtcactgcagggcggggttttgtaaccttttgatgcagattgtgaatcttaatgaatttgtcatttgccatggaaagatgtttgttcaaatagagcagagacattttcgtccaacaatattacaggaatattgtgtagaaaataatgactaatactttgagcattccatgttggctcccattttaaacacttcatgtattaacttgtttaatcttcagaagaattcatttttcctggttttcctgttgacatttgatgaaactaaagcagagggaagttaagtagtttgcctgaggtcacacatttagtaagtgagagacccaggactcaaactcaggcaggggttctagtaccagcagtgtttatcaactgctttccaaccctgacaagcatgagtgggcacaagcatggagcactagggcttacaaaaagctccctcaggctggcacattgcctgacttaaaggtaccgaaggcatggccctgccttcaaggtcattattgcatgctggttagaggagaaatctgtctgtctcatttgcggacgtgtctccgttgctaagtagtgtcaggcatgtaggagatgcttagtacaatctttttggattgtatcaatgtaggttttgaaaggttattagagcttgtgaatcatcaaggttgaaccataatcaattaacaagaaaggggaatctgagacttctaaaatgtaatggtcatgacttgctacctttagaaacaccagcgaaaaaaacctgtggtgtcggttggatcatggctcttattcactgcggcgtttttaaagctttttcaaggattatgtggggatcccaggctcctttatgatttataaatctattatgcatgtcacgtagagattttcatgacagaatcgtcagatgaactcattcagggtataatattgtaggagaagggttggcgaggttgagggggatgccataagaaaatgcctaattcataggtagagtgtaggacagaaatggatggggactggaggccagttaggacgacactgtagaggccagtgtgaggagcaaggacgtgggctagaggaggaggagatgagcatggggaggaaagtccagggagagttaacaggacctaccgactagacaagaggatccagggaaagagaatgaagcattgttaggaaagtttcacagtatagcggcccaccgataaccttaagaacctacaaacctaacagttttaaaacgatgagcttgaggctcagaaggaaaggcatgttaagctgtcatatcaggttgattgaatagattgggtaagtctttcagacatcctaccaccaccttctgccccatgctgttaattctttaagcattgggaccatgagttctgtctagcagtgtgggtgttgagaccacatgaatcaaggaagagggcttctagaggcccaagggctgtttgctgtagaggaggcagaggagggttccaagaatttcagaaggcactgtatagctctgccaggaagtgtttagagaactgaggtgcagcccccacttctcattacaacattttactaccatcaacctctcagcagaactgctgcattaggtacctagtgtttgatttgaactttgtatttattctccatgaaaaggcaccgtgcccattgatgtcactttggtgctgctgagacagaaagtgagtattttatgtgctgtctcttttcaagcaagatggaagggtcttgtaaaagtggtttctaaggaataacctaacattttaaagatttatagaacaagcatccacttaccagttcatttaagttttacaaaacatctctgcttctgccttgccatgtcagcaaaagattctgacatttaaataaataaaatatggtgggatataataaagtgcaaaaaaaatgatgcatcaagttactactgaaaggaatattgaggcctgagtcatctccctgctgctgtctcccaaacagaagatagctttaatcttcaggctctgtgttatttaaataagctgagggatttgcgagttgggggatgctgccaaatgtatccactgaagataatgatcccatttcagatctgcaggtctattttaatgaaaggagacaggtgagggtgcagaacagaaatgttcatagcacctgaccctccttctttccttaggagtttctcaacccagcgaaattggtgagatttttaaaaataaatactttggagtatatcatgaggtaggattactgtagtgagacagggagcagtaatggcagtcaggaaaacctgtgtatgttaaaaagtgtttgctaagtctctcctgtgtgtttagtgttgtgggggttttagtcgaaacaaattagggtctcagccaacctcaaagggtgtattttctcagtctttattgattcctcttggtttcctcagggctcagaacatccaacaccttaggagcaaatgtcctttgaatgaataggtttgggatgaggttctggaagacactaacacaaacaaccttgataaattacatggtagtgacttcatcacattcttccatctagtcggagtagctggcctttgaaaattacccttatgaagcttacattttactggagaagccagacaaaagaatacgtaaatgaatgaatgaatgagtgaatgaacaaaacaaaattatctctcgttcatagatcaaattgtcctaaacttgctcattaagacttacttagctatgcattttataccactgtccctgagcactttaatcatttattaattattcaacctctacattgctttaggtgaactggaggcatgagacaagtttgggatgcagactttttctttttattgtccttaagaactataatatatgcagttagttagaaaccctgtcctattggtacttttgtttcagtgaacttgagtttaaactttaaggcacagaggttattacagtatcatcttcaggaagctactggtactgaaaagagcattcttcatgccaccccagtatcatctttgtactcttacctttgtgttgagaagggatacatgtcacttataaaacctgggtatgactacgcaagccaccttcacatttgggatagaagattctacaaaagtaaaattcacaatctttgtacatacacagaagccagacttaccagcatgtattaaatctgtctttattttggatcatggcatttatggagatcactaagcaggcagctcatttgaagtgagattcagaacacttacttattttatccatttagcaaacatttacttaactcctactgtgtgtactacatcactggggaagacaattaggacccagtccttgttttcaaggagtaagtactctagtccaacatgaaacaactaatgaaactgagcagggataggcaaggcagaggtaagtgtgccttggaagaaaaggggaagaagaaatggtggatgttgaccaaggctggcactaggtaggctccaggttcccctgggatgctagttttagaggtggaagggcagttttgaagtctcatttcaggagcagggagaggctgtgcgttgatggttccagtaggatggggaaaggaggaggagtcagtgcagttggaccaggctcttgtctgtccatctcatctctccccagggataggatgacaaggaccccagaaatcaacagtgacaccagctgagtgaccacaggcagtaaacaccttacaatagctgctttgatttgtatccttgctggcgtatcttaacaacatgacgacatttaccaaatgaatgactgcttaccaagcaccagtctaagtgcttcacccatgttatcatgtttaatcttcccaattttgtgagataggtagtattattcccatttgaaaggttggaaatctgaggagtgaagaggtcacccagctagtaaaaggtagagatgatgcaacagacatacatgtccatgcttgtttgactgtaacacgtttactcttaacctctaagcaatggtgctttccttaatatagaatgtccttcgaaacatcccaatgccaaaattcagcatattttcatattagaatagctttgcgttaggtctctttttccctgaacatttcttttctctgttttgcagaatcttgttggcctcctttaaatatcattataaatgttggcagtgttgttttaaataattgtgaacagaaagtaaggaagcatatgcactctgatctttttaaagcgatttcattattgtaaaaaattctggttacaactcactaaattggtagtttggagcacctttgggtgtactcccagatactctctactcccctctcctccctcccacaaaaaaacagcatttctaaccacagtgactaagtcatgcacttctaagttagaaaatttatagatgggggaaaaatgtagttgaccagataaatatgcagatagttgggacatgtctaaagtgaaacactggtttcctgacacatattcattaaacatacagtcatgtcacaaaaagagattatggtcaggtgaatttattattatatgtccctcccgccccgagaatagtaccctatagtttatgaagcatgttgataatgaagttatctgtttcatatactctttatgaaaataatattttcccaagaagcctgaaaaacttacttggtcagtccaagtgagaaaaaattgaattattttgtatttagcattttaatccccaagttagaagggacatttaacaactgtactaaattcaaaaggttacttagagacagaattcctctttagatctaatatgattgtctggttttaacagtttggctttacaggaagacttggaagaccagcaaaactgccctttatttgtataaactctgcttgcatttgtgactttttttaaagggaaaaaataaaattctttataggcataatttttataaattaaaatacattatagtatatttatgtgggtgaagcttaggaaattctttataaaatgaactgtattttgaattggtcaactgctacattgtccaaaaatgggaatggtgattctgtggatgaagtggaagaacaaggctattctttactgtcaaaaagggcctttatgctatggtttaaaatctttctgcaaagcccttggatgttataccacacatcctgtagctcctacatgccaaactcccagctttttttatgtggagccccaggaaaaggtgatcacttacctgttagcctcatgcctggtggtgataagaaagatggctttggtgatactaactgaatgcctactagaagtcaaatgtgttgttgtttcaattttatggcctctctgctggtgagtatttaaaatgagaatcgagcaagtgaaagtgtgtcatagttttttgtttgtttgttttttaattaagaggaccaaaccaaagaaataggcccattttgttgagagaggcagtccaacacagtggctcaaagttccagagcttgcctgcaagctcaggcagatgctggtaccaggaatgccctgtacggataccaattcattcgtgggagatagtacaggggcaggtaatgctgaatcccagctccacttatgtccagagcacaagtgatggcacaaagccctagctctcttcatccttccactctcagcactttacatgtgttgccttcctctgatttgattccaagctcaggccccagatgggggcctcccagcaacatgtccctctccctttcctggcttaaaccaattagagtgggttctgaaactggagctggagtttatcccacagaaattgaaagtacagcagggatatttcccaaaggaaagttaggatactattttactaagaagattgagaggaggaggtgacaaaaacaacagatgtctgtacatatgtgagggtggagctgaaattgcttggtttctacagttagcattcgctcaaaacaggcagacctaagtttgcaggtgaggccagtccacaacccaactcagaggctgagacaagcaaagtaagtggaaaggagacggatggtagaaagaaataatatctattgggtgtctgttctgtgccaggatctttatgtttgtggcccagtgtacgccttgtcaccctcatgaagtggtattggaaggtttaaagggtttggagataagggtaaagatagatgtagagtcagggtcagccactgtagccaagagctttgggtagttccagggcaaactgaggaagcagacctcttagagggtaaaatgggttatgattttctaaagaggaaattcttctgtttgacctagatgtgaactgaataatcacttctgttgtttggaaagccataaagccagccaaccatgccacaatcctgatctcgcaactcacatatcttatttttcaacaaggaaaatcctttcaaagagataaatgtgaattctgtgtgccatgtatatatttgtaccacatttaatttcattagctataatatcatgtagctgtgcttatttaactgcttagcccagatggtaatgccttctgaagaaaaatggctacacagtgtaattgaacatgtcctattgacagagttacaacaacccattttccccattaaatataggtgattcaataaaatgaacacagagtctattactctgccaccatttctagctgaaaatgcaaggaggaaatgttctacaaggtgaagaaatggcacagttatgttgcatgcagtgggaggacaggcgtaaaggcaggcctcctcctcccgccttggacaaaagaggagctatttgttgacactcagatttggttgggaaccaaggggagaaccttggcgtcatcagctaagacctgtctgaaagtgatgatgatagcagatgtgaacatgaaaactaggccgtacattttggaaaatgatgtaaaaggatttggcttctaaatggaatcaagtggtagaaacagttgtgttggctctcagcagatgagggtcttgggtcttatgaatgttgtcaatcactagtataaaaatattctggccaaattagtatatgagaacaactatctgatgaagctatcactgcaaatatttttgtattcattgaaaaaaaattgccaaggcagaaggattgcttgagcccaggagttcaagaccagcctgggcaacatagcaagaccctatctctacaaaaaattttaaaattgactgggtggggtgatggtgtgcatctgtggtcccaaccactcgggaggctgaggtgggaggattgcttgagcctagcggttcaaggctacagtaaactgtgaccataccactgcactccagcctgggcaacagagcaagaccctgtctcaaaaaaaataataattacagggttggcctccctgatcctgtatatattgtctatgaaattgacaggtttggtgtggtctaagaaagtaagtcatactcgacactgaaactttcctaggaagagcactagagatgatgtgagaagatgttattgaggaaaagtttgggaatggcaccttgccatgtggcgggacttattgcagttgctatgtgtatattttttcttagttttcttcatgttttatgagtaaagacttacagtcgttctctgtctttgcttatggggaagttgagaattttagagtcaaaaagacccaaaagcccactctggcttaccctctcattttcctgaagaggaaagtgaggcccagtgaaaacccacacaactcaggagagatgagccagggtccaattgtcccttctctcattactgcattttgcccttattccagtgctaagggacttttggggatgaaaggagagaagtgggaggctggaaggagtgaggtttcttgtcctcacagctagtcacccagagaagcttaagaaatcattacaggcattgtggctcacacctgtaatcccagctctttgagagactgaggcgggagcatcgcttgagaacaggagtttgaggctgcagggagctgtgatggtaccacttcactccagccggagtgacagagcaagcccctgtctctcaaacaaatataaaaataaaactgaaaaaaagaaattacttaaaatatttttcttatgtaaagaagtacaaaatttgaaacccactctcctaaacaataggaattcgtacgaagagtgatgggcatatattatgcctccctcttcttcactcctgtccagtgtgtcctagatatgggcgtcacaatggctagtatatacctaaatgaaatgacaaaaagtgaagctgaaccttgtcttcttatggagaatatattcagaaggtagaataaaaagatattttagggtgattgagtttaaacaagtagaacctggtcactccaaccccacccccgatcagattctcaaaaattagacttagaaatcatagtcctggatgttagtcaccctttctgcaagggaattgctatctgaccttgcatattgcatgtggacaagttcagagccatcagatccacctgagaaaggaggcaggaaaagagggcaagccttatcaagctgctgtggggatgaatccagtccggtggaagaaactatcccacctctgagccctgccagcacaagccatctgtctgcatctaacaacaccatgggcctcagctctgaagcccctcccttggtgactcagcaatcaaactgttcattttgcacatgttttgtgtttgattcatttagtcactgagtcttcagtttctctgcctgctttttgccctgctgatggggaccagcctccaggtcagcacagcaggttgagcctagagaggcaatcacagtcccaggatgaacttttttttttgtccctgaaaggggcctttccaggagactccccaggggctgctgatatgctcttccaaggctttcctgattgtctgtccacccatacccaaggggaactgatgtttctatcctctcccataggccttttctaggctttttacccacttccagcctgtctcctaggggcctgattggccctctccacttctcccaaggcagcctttcttcacttgcctcagccacctaatctctgtcccaccagttttggggttttccttactccatgcgtttacctttccacacttgcacatgcacacagcaccgcatgaaaactcctaggaatctctccttcaacatggcttaatagtccttcttacctaatttcccagtgacctctgactcacagttacacaaaggaaatggacgtacacctggagcccagctgacttgggctaaggttggtcatggctctaggtttggtttaccttattggctagaagacagtagaggcccaggcactgtgtgctttatggatcgtctttctaatttacttgaacctgggatccatggtcacttctaagagatcaagtctattttactctaagtagtttctttgagtaaggttggacatttatttcccttgacataaggtaaacaagtgtgcctatgagtgtggcaacaatgaggagacattgaatcctcaagtcacattggcatgcttgttgaggcttttaaacgatctcagtatcacagttcttggtaataactgtaaaaacataatcacaggtggcacttggcatgaaaggtatgcttggttcttttttttttttttttttgtgacggaatttcgctctgtcgcccaggctggagagcagtggcatgatcttggctcactgcaacctccaccttctgggttcaagtgattctcctgcctcagcctcccaggtagctgggattacaggtgcctgccactgcgcctggctaatttttatatttttagtagagacagcattttgccatgtttgccaggctggtctcaaactcctgacctcaggtgatctgcccgccttggcatcccaaagtgctgggattacaggtgtaagccaccgcgcccggccgctcagttcttacataatgagggcatccatggatttttaaatggaggtctttatgtttccagttccgtgtcttcccaccttcagaaagcactattttgctgaatttgtctaaagggcagtagcttctagagtaaccccaggagcaggtcttctcaaaatgcctatttatcagcctttgcatgagttttgtgggagctggatagaatggaaaaagaaatgaggaatgttcttcagatatgacattgtacagatctattcttccaaagaaatttgccttgagaatagtactccagacatggaaggggctctaggtatttaggctatggcagaaggtaacttgtaacatcttttcagaatttttgcaacctctgattctttatttgacatttttctttcttaataagatgcacagctagtacagcagcatcctgtaatccatggatttggatgttctgggcgtaatcatccctcaaaatgcaatacaggtgtggttagtctaagccatcttcctgcaaaaactttctattcctcatcccctccttagactccctgtttttgtaatatgttgtcaactgaaccacatttatcataaaatttatcattttctttgtatttctactgagatctagatagtcatcaacatgggacatctttccagcttgaagcaaaaattcttggtacttaggtatctcctgtagccttggtagaggcatgtgtggttaggcctttctgaatattgaaaagagctcccttatcccccagttggatccatggaactcctggtcccaaccactgaattcagcactgccttgtttttgcctcaataccacaatgatggagagaagctctactttaggattcttatctgacaaattagacagcaggaccccttctaccttctaatatattagatttaataaaataggcatatactctctactccagagaaccaaatgcctttcagcttgggaaactaaaatacaggggtgtttgatttgtgtgtggttttgcttgtttgttttgagactgagtctaggtttgtctcccaggctggagtatggtggaatgatcatagctcactgtagccttgaactcccaggctcaagcagtcttcccacctcagcctccctagcagctgggactacagatatgcaacaccacacctggtttattattttttttttaatagagacaaggtcttgctttgttgcctaggctggtcttgaacccctgacctcaaatgatcttcccacctttgtctcccaaaatgctgagagtgcaggtgtaagccgccatgcccagcagagtgagttgttttttaagatcacactgcaagtttatgtaagaatcacttgaataactttttgttcctgttgggttaagctggtgggctagatgcttggaagttgtagaccttactctcaagaagtttctgtgcaagagagcaaataagcaataagtaaaattaaccacattcagcagtaaagaatgattttaagccaacagtttatgatgcaagatttaagagaatggaaaagaagttatttcttttaaaaaaatcgtttgagatgaaattcacgtaatataaaattaacaattttaaagtgaacagttcagtaggatttagtatatccacagtgttttacaaccactgcttctatcttgttcccaaatattttcatcactccagagtaaaaccccttacccattaagtagtctgtacctatcccttcctccccattgcccttagtccccagtaaacctctgatctgtgttctgcctcttcagatttatctattttggaatcatacactctgtgaccttttttgtctggcttctttcacttagcataatgttttggaggttcagccatgtatgtgtgtataattactccactcctttttatagctgaataatactccagtatttgtatataacatgatttgtttatctgtacatgcactgatggatgtttgggctgtttataccttttggctattgtgaacagtactgccatgaacatgtgtcacatatacttgtttatgtacctcgttttggttcttctgcatatatacctaggagtggcattgcaggacgatatgatacttctacattaaactttttgaagattgccgaactattttctagaatggctgaaccatttcaagttcctaccagcaatatatgagggttccagtgactccacatcacttccaacacttgatattttcctttttcttaaaatagccactcttatgggtatgaagtggtacctcattgtaaatttgatatgcattttcttgaccaatgatgttgagcatcttttcatgttttttggccatttttatatttttttttagagaaatgtctactcaggttttttgctcatttttcaatttggttatttgtctttttgtcattgaattgtaagcattctttatgtattctggatactagatacatatgatttgcaaatattttcactctctaggttgtcttttcactttcttgataataaatgccttttgatgcacaaggtttttaatttgatgaagtcttagcctgtttattctgttgtaacaaactacttgacactagagaatttataaacaaaggaaatttatttcttacagttatggaggctgggaaatccaagaccaagatgccagtagatttgctgttgggtgtggggtgctcgctctgtttcaagattacaccttgttgctgtgtccaagtggtggaaaagcaaaaatgccaaactctgtgtgaagcctcttgtataaaggccttagtcccattcaagaggaaggagccctcatgacccagcctcctcctgaaggcctcacctttaaaactattgcattggagattaaatttcaacatgaattttgagaaacatattgagaacatagcaaagtccagtttatctgttttttcttttgttgttaatgcatttgatatcacatctaggaatttatggccaaatccaagatcatgaagatttaccactttactttcttctaagagttttatggctttagtttttatatttaggctgttgatccacgttgaattaatttttgtacatggtatgaggtaggggtccaatttcattgttttgtatgtggatatccagttgtctcagcatcatctgttgaaaagattattcttttcctgttaaatagcttaggcatcttgttgaaaataagttggccataggcatatgggtttatttctcaactctcaattctatttcattggtctgcgtgtctatccttatgccagtagtacactggtttgattactataggtttgtaattaagttttgaaatcaggaagtataagtcttccaacttttttctccttttacaagactattttggcgattgagggtccattgcaattccatacaaatctgtggatcagcttttgcatttctgcaaaaagatcactagaattttgatagagattgcattggatctgtacattaccttgggtagtactgacatcttaacaatactgtctcccaacccatgaacacagggtgtccgtctatttattcaagtcttttaaaatttcttttagtaatgtttattttataattttcagcatataagtctttcacctttttggtgaaattgtttcctagatatttcattctttttggatactagtgtaattgtattattttcttaatttcctttttagattgttcattgctgatgtgtagaaaaacagctggttgagaatttttgcatcaatgttcatcgcagatattggcctgaaattttctttttttgttgtgtctctgccaggttttggtatcaggatgatgctggccttataaaatgagttagggaggagtccctttttttctattgtttgtaatagtttcagaagagatggtaccagctcctctttgtacctctggtagaattcagctgtgaatccgtctggtcctgggctttttttggttgttaggctattaattgctgcttcaatttcagaatttgttattggtctattcaggaatttgacttcttcctggtttagtcttaggagggtgtatgtgtccagaatttatccatttcttctagattttctagtttatttgcatagaggtatttatagcattctctgatggtagtttttattactgtgggttcagtggtgatatcccctttatcattttttattgtgtccatttaattcttctctcttttcttatttattagtctggctagtggtctatctatttttgttaatcttttcaaaaaaactagctcctggactcattgattttttttttttttgaagggtttttcatgtctctatctccttcagttctgttctgatctatactggcaaaccaaatccagcagcacataaaaagcttatccaccataatcaagtcggcttcatccctgggatgcaaggctggttcaacatatgcaaatcaataaacataatcgatcatataaacagaacaaatgacaaaaaccacatgattatctcaatagatgcagaaaaggccttcgataaaattcgacaccccttcatgctgaaaactctcaataaactaggtattgatttaacgtatattgaaataataaaagctatttatgacagacccacagacatactgaatgggcaaaagctgaaagcattccctttgaaaactggcacaagataaggatgccctctctcaccactcctattccacacagtattggaagttctggctaggcagtcaggcaagagaaagaaataaaggcattcaaataggaagagaggaagtcaaattgtctctttttgcagatgacatgattgtatatttagaaaaccccattgtctcagcccaaaatctccttaagcagataagcaacttcagcaaaatcccaggatacaaaatcaatgtgcaaaaaccacaagcattcctatacaccaataatagacaaacagagagccaaatcatgagtgaactcccattcacaattgctacaaagagaataaaatacctaggaatacagcttacaagggatgtgaaggacctcttcaaggagaactacaaaccactgttcatagaaataagagaggacacaaacagatggaaaaatagtccatgctcatggataggaagaatcaatatcatgaaaatggccatactgcccaaagtaatttatagattcaatgttatccctatcaagctaccattgactttcttcacagaattagaaaaaactactttaaatttcatatggaaccaaaaaagagcctgtatagccaagacaatcataaggaaaaagaacaaagctggaggcgtcatgctacctgacttcaaactatactacaaggctacagtaaccacaacagcatggtactggtaccaaaacgtagatatagaccaatggaacagaacggtggcctcagaaataacaccacacaactacaaccatctgatctttgacaaacctgacaaaaacaagcaatgagagaaaagattccctacttaataaatggtgttgggaagacctgctagccatatgcagaaaactgaaactggaccccttccttatactttatacaaaaattaactcaggatggattaaagacttaaacataagacctagaaccataaaaagtctagaagaaaacctaagcaataccattcaggacatagacatgggcaaagacttcatgactaaaacaccaaaagcaatggcaacaaaagccaaaattgacaaatgggatctaattaactaaagagcttccgcacagcaaaagaaactatcattagagtgaacaggcaacctacagaatgggagaaaatttttgcaatctatccatctgacaaagagctactatccagaatctacaaagaacttaaacaaatttacaagaaagaaacaaccccgtcaaaaagtgggcgaaggatctgaacagacacttctcaaaagaagacatttatgcggccaagaaacatgaaaaaaactcatcatcactggtcattagagaaatgcaaatcaaaactgcaatgagatacgatttcatgccatttagaatggcaatcattaaaaagtcaggaaacaacagatgctggagaggatgtggagaaataggaatgcttttacactgttggtgggagtgtaacttagttcaaccattgtggaagacagtgtggtgattcctcaaggatctagaaccagaaatagcatttgacccagcaatcttattaccggatatatacctaaaggattataaatccttctactataaagacacatgcacacatatgtttattgcagcactgttcacaatagcaaagacttggaaccaacccaaatgcccatcaatgctagactggataaagaaaatgtggcatatatataccacagaatactatgcagccataaaaagggatgagttcatgtcctctacggagacatggatgaagctggaaaccatcattctcagcaaactaacacaagaacagaaaaccaaacaccgcatgttctcactcctaagtgggagatgaacaatgagaacacatggacacagggaggggaacatcacacaccagggcctgttggggggtggagggctaggggagggatagcattagcagaaataccttatgtagatgatgggttgatgggtgcagcaaactaccatggcatgtgtatacttatgtaacaaacctgcaggttctgcaaatgtatcccagaatttaaagtgtaataataataaaaaaagaaatacagctgatttttgtgtgttgatcttgcaattttgctgaattaattttattagctttggattttctgtacatagaataatgtctgcaaatagagaggccatttctttctttttcttgtctaattgccctgggtagaacttccagtgcaatgttgaatagctatagataaaagcaggcatcttcatcttgttcatgatcttaggaagaaaagctttgtctttttccactgagtacaatgttagctgcaggtttttcataaatattctttatcatgttgaggcaattcccttctatttctagttttgtgagtatttccagcatgaatgggtgttgaattttgtcaaaggctttcttgcatcatttgagatggtcctgtggtaagtaaaatcttaaagagtaggactgataacagatacagagaaatgcgattctggagaagtaagtaactaacttacagtggtaggtgcatgactagtatctgcagagattagtgcacaatctaaatcactgtgtagagtattgggggcagaggactgaatgcagtacaggcaagggcagattctgagtagatcagggaggacttgattgacagattgccttcatcttgtctccattctggagatccttatggtttctgagcccagtcaaactaggaattgtacgccttgctcattgttctctccttctgtgtcttcacttctcttccttctattgactttcatgtccctctaacaatctttcctttttaattttggtagaaaagtgtcatgtaaaacaaagaaaaaatggagttttttggtactgtgtgataaatcttatgattttttagaatttaggagtacacataaaattgagaggtgagccaacttttttgttggtttatttctagttatgtatggagatagacctgctaaccagccaacagctagtgtcagggctgtaaattagactggaggaaagaatgaactgcacatttctagctcctgggccaaggttcctgagatttttgccagccctcttctagacagcagcttggtacctcagctgtccttctcatcagggagacagatggaacctctgaggtttcctgttgaggcgtctcagaattcaaagttgttatgatgtgtgggctttgaaaatgccacacgtcagggaagctgagtttttgtttctcaggctttcttatattgagcatgtgttcctttctgtctttgtggcattaagtttcattatgtgtgtccccaagccttttcctggaatctcaacagaggatgggttttagctctgttggaagttacattccattaagtgtgctcaaagatctgctttactacacactctctcctgcccaattcttaggccagccccttttcctctccctactcttgtctaattagtcctctccttcaaaaggcagccctttcatgggattctgctccccgaagtagtgggccctgacttaagggccagcccatctttgtccatggccatacttatcagggatgtgactatttagctctttaaccaggagtctgtcctttctagagaccttccagcatactattaacctaagtgcataggcagaggagaccaggagcacttggtacaaatgttaatggctttttcattagcgtacttcatcacagaattccagctgttggtggcaggaggtgacagtgaggcgtctcttggataagaaggacgtggagatctacggagatgaaaactgaaaagatgcatatgattagtcatcagaaagatgtttgacttctaagttttttccaacagcaggtatggctgcatggaaaatgcatacatccattgttgcaaggcctttatttccttatcaccatcatcaagcagtattaatgaagaagccaattgtgcatgacatagtgcaggtctctgtatgtagttatggaaaacgcttccacagttaaattgagtatggatatgtaaagtgattaaccaagacttgacagctcacacaattctttaattgcagcaagcatctcaagtaaatacataacttttaagaaaatccagaactataaagtcttaatttttgaaacaaatcatgatctttcacgttacaaacagatctttctttctaaaaagatgattcacaatcttttatgctggaacatcaaacatagattttactttacttctttttaaaataattggtttgttaacagttaggaaagccatacgtgttatttgttaaaaaaataaaaataaaatggaacaataaagaaaatgtatccaaactataaaaagcaaaagtcaccaacttgtcccagctgcaccccctccaccccacccatgtttctgttcccacaggacaaccattgctagcatttctctctgtagttcatctcttttgaaagtacatatgtaagtgtgtgttaaatgattatttcagaatttatattgataaatgcctatgttttctattatttcaatttgcccacatggagggtgattgttttttagtgtgttcccttagcttctggaatacaaaagctgatgcctgtataccttgactttgctgacggcagtggtagtgagtttagtgctttctacttttagctttatgttttgcactatttttgaattatatcaattagctatgatgtatacacattcaggattctttaattttgggtaaaaataattcttcactctgtgcctacttagctaagaatatctttaacagaggcagagctgtgaaaccaccgagcaccaacactgcctctctggcttttgcagggacgcttgggtttcaggctgtaactcttagttgcattagcctctgataacttttttgttaattgataagtatgtgtatgactcatcaagatgctggttgctcagtaagataaaattatattctctaacactacttctcctttagaagcttacttacctgccttggtgtcttctgtctcggtcttactttgttttttagtttgtagtttgttcttcagcttactaaacctctttcattgactgtggtattggctaccgatttaaaaatccttgaagacttaaaactcagcagacacgtacagggtggacccctgctttttctcaagtctcccttcatctccaggaactgaatttttcatgcagtaattaaaatttgtaggtcaagcctcccatggcaccgtttgctgctaatatgggaaagcagtgatcagattcgcttatgctgctcttcactgagctgagacttaaaggatgaagggtgacattttcccccattttgtaaattaatgccattgatctgcctaacaagaacaaagttaggcttcaaaataccaaatgataaagagattaagactttaaatggctttccaaaaggcaacctctattgtaaggctccgagctgactattgaactttcaattagaatttctaataggctattgacttaaatggacaaaatgttacaagtgatagctttcaagatgacaaagattgcttcttacgttctggaatattactttatgtagcgtgcactgttctggagggtgaataataataaactgccctccccctgtagagtgtcttctgcatctgtgctatagttttctcaaaggtgaataaatgcattttttaaaggcatttttgaaatacttgctttttcatgtgtttgctgaacacaggttttatgaaacctttcatggcagggaagtcccattagtctttagcactgtggcactattcttcttttatgaaaaatagcccatgtggtatgtatttctctgcacacatgtgtgttcatgcatgttaacatgtgtgttcacagttgggacaccagcagatctgttgtctatcattgccatgaggatcagtccctgaggccttgctctctgcctcagtttactgttgttggaagctatgattcttttccacaatgggcttgcagtgtagtgtgactcaatttaggccttgttgtgaaacactagctctaatacatttttaaatactaattttacaaagaccagctacctcttctaggataaagggttaatattatgcttatgttacagtgcattaaaaactctaattaaaacagcattacattcccatctgccaatctccagtaatcttctttaattgcagtaattaaactatatttacatgttcagaatacttgtaatttagcaaattgcactctctgctctacatttaatcaaacaaccagttccagtatatttagtgtggaaagaagtaatttcaatgttttgattactatagcagatttgacagagtaagtgcccctctagtagagggcttgaaagggaaggcaaacatgaaatatagtcatggttttgattgtcatgtgaatgcctaattacatgttggaggattaactattaaagggtatcatggttgcagttgatgtttagaaacagccggtattacagatagcatagactgtcttttaggaaaatttcacaagaagttttctctttaaaggttgtgagatcataggaaaatttagtgaaaagatcgcctacattgtataattgttattatgtcttctacctgtgatcccaaagcctgctatacaagatggttattttagtcttcccagttaaagcccagaagaaattcaatgataaacaaccaagagaaattgcaatgattatatcaattcagggatgagtattccctcatttcggtatcttttggcaagtctggttgactctggagaggacatgtggtttcctggaaaggactcatcagtagaagtcaggctttttttattttaccttttgctgctgttgttgttttaaaccatgactctctactaggctgttccacctaacccatctccagcctcatctcttatttatttatttatttatttatttatttatttatttatttattttgagacagagtctcactctgttgcccaggctggagtgcagtggcgtgatctcggctcactgcaagctccgcctcccgggttcacgccattctcctgcctcagcctcccaagtagctaggactacaggcgcccgccagcacgcccagctaattttttttgtatttttagtagagacaggtttcaccatgttggccaggatggtttcgatctcctgacctcgtgatccgcccgcctcagcctcccaaagtgctgggattacaggggtgagccaccgcgcccggcctggcctcatctctttttttcttggttttctcattttaaaaacaagtaacagtgttgtgaatattgattagattcaaaggaacaatgtcttagtcatctcaaagctatttttaaaattcttattgttattatctctttgcaccagtatgaaagtttctgtttctttatctagataaatttgactgggatattgggtattgccatcaaatctctgttatccaaaacaacgtgctaatttattcaacacagaaatataagtaatactctctttttcagtagcttctttttaattatttgatgttaacagtatttctgagaatttttctctctctccacttcggggtcatctattgtattaataaggattatgaattaatgaaaacaaaaagctagtctagcgtacctgtttaaaccaatgtgaaaccttgcttcttgaccatatgaaagagcaaagctactgaattgttaaaatgatatgcaggagtgaggatccaagattttcttcatgggtcagctagtaacttactgtgatactgagagcaacatgtttgactgatttaagtctcagattgttcaaggtggggtagagaatagggcctggatttttttggttcatgaagagtcttgacataaagtaagtattagactttagactgtcacaggaataaccattcagttcaaatctacactcatttctgtgttagattagtgagaatttaacttctgaaaaaagttcaggcaaaataccgctgatgtactgcactaaggagatttgagagtgccagagatactttgaaaggaaaagagatgtaatttgaagtggaggacagggctagccagggttaaaattgcagctcttttacttagctatttaataccaagcaaattaccttatcctctgaggtcttgtctgtaaaaatggggataataatacatacatagtactacactattagtttttctctcctatgacttgccatctgtgtccatgtatggagagaaacacacacacacacacacacacacacacacaccccgtaataagttaagagtctttggaatggtaaatgatttgaacataaataccagtacacattttttttaataatgcagcataaatgtcaagatatatatgcataagggatgaggtgtgcctagaagctgtaatatctagaattttcgcaaaccttatttataaccatttgtttctgaaccctaacaattcttttctgaaactgttaactgaaagatctgaatctcactatttatttcacactcttcacatagaggtgctaatgagcagcagaataaccccaaaaatggtccttaatccaaacaccgagaagtcaagttataagtaattaagaatacactggatggaacatacctacatggcagctagcatctgtgctttccagaggttgctggggacggttagttcagttctcatttttgatcctctttggaaactcaggagttaaggtcagcatcctcagtacaaaggtacttgaacatgtatgaatctttgccttcttgaaaactttttatcttgggaataaggaacctgatacaaagagaatctctagtatttcattccatcgagagaagttttgacatttacaattctgctaatttcacacatcatttcgcagcatgcaggattttggcgcctgccaaggggactgcaaattctttttggaaaaagtacttttttgggtgttggaagagttttgagttacagacacatttctttaatagtgttcttgaaatgtccatgtggtcttaatatgtaaatcatatgaaactcaaaacccactcctgaacttactcttccaagaaagctttaaaacagccctcattctaatagtaaggctgttttcctcttttccaatgtttatgtatactgtataatgtttactgtataatgagtttattgtataataagggactctgatttattagctcttcattattctcattctgtcagcttcccaataaatgctacaacccttggcagagacatgagtctcaatcaggtgatatcattgctttttaatgaactcttcttaccggagtaacagcattacatgtgaaataccttatcctgcattattaacggaccgcagcataaaaggcacaaaggcactgagaaggttgcactgaaaaatggggcagaattcattaccaattcgatatactgtcagctaacagtctttgattatcatatttacccttctgaaactgtgaaaaatcatgggcggagccgctgtgaacaatagcatgtgtaggcattttgtaaatgttgccttagttgtttaatgcccaggctgactgctggaatttaacacagtgacaactttctcagatggggcatgaaaaaaactgtgatattttactacctgagaagttaagcactgagatagttaggacccagctctcattagctgaatggtagatttttctaattagttctttctagtgcaattagcacgaaaagagtctaatcacctcatgtgaaaccaatctaatgctcagaaaagaattcccttggcctctctttcagattggatcttaggattttcagtctgcctccttaaagaatggaatctgttagtgactgattatttgaacggtaaggacagatctgtagaaaaggcaagaaatggacaacttattgacttgcagtgcaagtttggctggagaaggtgtttagaaatattcattaattggcagttatcacttcaactataggttctggttttcttgatttctttcattttgaaatgggagacttgggcccgggacagctatagttcagcatggctgcctctctggagggcatgaaacatactgcacattagaatcaaatgcattcggggcctgggactactgggcttgctttcttagcctctgcagtgcccagattcccccatcagtttttgctaatctgtgtgttcagggctttgcctgtcctctctctctccctgccttgcagtcatctgtaggcaccacattcatttttgaactgttctctaatttctagtgcccatccatcacttcacatttcttaagtaagccaactctgggcatctcagttgatattgttcatttttaactggaaaggaaactataatgacagcatttctggcacataattttttctttttttttttttgcgggggggaagtcgcttgccagaagatcgatgagaaaatgctgagtatgtgtgtatttattatcaactatgcagaaaatgggcatccttgctcatcaggctacagagggtgacaatattgaatttccattgttcatcccatcactgcccagtagaacttcccatgatgttggaagtgttctgtacctgcactgtccaatacaggaggcactagcgacatgtggctgttgagcacttgaaatgtggctagtgagactaaggagctaaattttaaaatttcatttaattttaatgagtttaaatttaaatagacccatgtggctaatggctaccatactgaacagggcagatgtagatctcttccacctcctaaccactgtaccccaccttacacatagctgcatccttaacagagaatacactgccctccgcagcctcttgctatccattctcttcagctttgccttaaaagcaatcagactttttccagtgctgtctggagtttgacacaaggcattcccttggcttgtgctatctgtagatcattctgtatttcaccgtggcagtgttttgttctaaagttggaaaagaccttgtagttttttaaagagccaaaatacaggattgtttctaagaaaggaggtggccagaatcagtaaatttaagctcatttgtggaagcttccaaatctcaaacctagggcagtattgaacacctctccaaaaagtcagattaagtatttgcaaatggcttcaacaaactccctctctatgaaattttaattatagttgattaaatattcactttaatcatcttaattaatgatatttgacaaatattttagctttgcttatgatattcacttgctctgtcagaactctccagttcacactgaaagggtaaagttaacaacctggacagacaggcccatcatgtgtgttatgacctatctggtttcctactcgcatggttagaaggctcattttattgctttgaactctggaattaatcctgcttaaaggagaatagtaagaatactgtggttttctgctcaacagaatgcatgttcatttattccacagacactaattgaaggcccattgtgtgctagtaattgtggtagtcactgagaacgcatggatggaaagacactatctatcccactggattgtaacctcaagccactggaacataaacagttaaaagtactatatgataaatcttctggaagacgggtgatggaatgtaagggaagaaacactaagtggtggtttcaaaacagaaagacttttaagatgtaacatgtaagggaaattttatggatataagggaatacaagggagagtcttaaggggattacaggattttgcccgggataaagagaaggtggggcatttgtgaaggggattatgttttcctaattaactgtattcttgaatgtctttgaagaaaggagtctctcctttcttcattttgtaaagcaacagtgtgtgttagaggaattgctgttaggaaaggaatgaggatatttggtgtgtaactgtgagtgctgggaaatgaaacaaaaggcagccctacctcaggtcctggaaaggcacatagtggtgtgagtgttgcagcccattgaagctacatcctcaattctggaaactaacaagaacagcattagggtgaggccagagatccacctaaggtgcaaaatgtaagggggcactcactttgagggtcgtgcaggttcaggatcagtactgacacaaccctgagaatgagtgtctcctaaaattgtgtgccctagacaccttacttacgccctgaaacatcccagccctgggtttttgtgcagtgaatgggcttgaaaagcaagtagataagaatctgaaccatggaaatatggcagacatggcagaatagaaatcaatgagacctatttgcaaggtaaagtcaagagaacctagggcagaaaaaaatacgaggcatgagagaggggaccctaattgtcctgtcactgaattctggggatcttttctattgcctgatactgacttttctccaatttctcatattcctcagctcctgccctgtcctgaaggtcatgcccagttcaaattcagcccttacctctttgctaagtcccatgccctcaaccttgttttcagagaaggccatgagaactggagtttttaaaatgtccaactctagatagatctgctttactgagtggtcttaacacattcagagaactgcattcttcttggctctctaaattcagtgaccttattttaaaagatgatcaacatgggttagaaccttttgaggattaggagacattttagcaagtttatcaagaataagcaaagatgacatttggctagcagtatgtctcccccaccccatcctgcaaaaccattttttttggagtgaagcttttccatttgacaagtttagaattaccaatactgcttgcaactccttccttactccaaactctgggatgttttcaggagggactcttttcttcaaaggcatccaagaatatagttaattaggaaaacatgcaagaaaagacatcttggctcctctggccgcctgttgtactcttccagcatatgctattacttgtctcagataagtagacaggtggctgtttgcaaagcagggtccaatgtgcctttgactcagagaagtttggaaacaaagccctctgtataataagcttctcactgtatgctgacgtcttctgatcttgcctattccccattacctacagtctgaaagaattttgtagggagtgtgtggtattctgcagaaggctattgtagcataacttagacttagccggcatttattgggcttagaatcacaaaatctcaagattgggtgactactggatggttatctaatccaacttccctccagaaagtctcccatacagtttttcccgcaaagtggccctcgagccataacttcctatgacagagtgcttactgcctctttgttcaacgctggtgaaacctcagtgatacttataagttaactttcattccttcagcattcttctctttagtgttaatttctttgatggtggtaccactttccaacttttatatgtggcctcttaaaatcagcttacccagagaaacttcctgcctagctcctgatttatgtagcttctcaccaccatgccctttctcccttcttataggggcagtttcacaattttgaagctccttgattcccttgagccattgtcctttccaaaacttgtcactatgaaaagtagactatgttttagcctttgaactataaaatctgcctttcagtaagcttagctccatattttgaggtctctagatccccccttagtatgcatcatgagacttgtattactcgccaagactctcatgactttcttcaagcattcagttttgtctaagaagccatcgtttgatccagaatggagtagacctaattatatctcctgtttttttggacttgaaatttacttcaagcctgatgataacctgttggtcagatgctctgccattaactaaatgacaccatcagcaaatatccagatagttgaggtcccagtgtcctgaatctgtggttttataatctatgtcagaagtctatcattttttttttcacctggctgtcatctggtatattctcaaaaggatatcacttttcttcttatccaggtacgtgccagtgtgcttcatctctcatgctcatggatctccatgcaaattgatctgcttttccaaaaactatttattaagcattattatgtgtctggtactatgtcaggtggtagagctacagtggtgagcaatggaaatctacgtgttttttgacatatgacactgcttttccacaatacctttcccaccttaaatcctatcccatgagcctgggtgatactcaggagattatttttatcatgtctctaaaaatctctgcttattttataactgatgatacatagacatctaaagagatgagggcctcacacagggattggccatgagagaagctttcagtgctgcgatctgaggccagtctgatctgacaccctcttaaaggctttcaagtataggccactgggttccacatcccatacctcttacctccattgtggctagtttctcatttgcggaggaggttagagatgttactctcttcccctccaccttcagtgtaaatttctcttaatcaggtcagctcacctccccaggcaagcaaacacatgtctctctgtcttcctgagctacccccgggaaagtctgcattattttagtaccatagacacagtctagaaatctgattcctatgggttgacaacatcctcatgacaaacccttcacctaccacatcatcttatttttataatcaccgaactttgttaggatgaagaactagagcactcaccaggcacccaactctgcgccaggctccatggtccccaaatgaagcttcctaggtctcttgtgtccaagccattcccctcacgtgaaacaacatgaataggtagagataagtggctttgtgacttggaacagacagtagcccaagaagaccacatgcctcccttctggccacgtgaactacatgaagcagtctcctttctgttcagccaagagtccgtgccatctcagtgcttgttttccttcctgtccctttatctggctctgtgcatgactgtttgagcagcctgtgtcttctccttccagccacacagagtactggtaacttctcacaggatattgcggtgtgcctccgtttacactgtctcttcttcctggatgctttcctctatcccctgcaatcacttcttacttacctgaaacttacttcttgtattactgcttaatgacagcttaacttccatgatacctccccacctccttctgctcaattctaggtttgagtatgtgccttcactaagtcctcccataatacctaagcaggtctctatcacagtccatacattgtttcctgtgtgtgtctgtttcttccattagactataatttccttgaggactgctcttgtgcctcactcatctttgtgagtacagtgccaagcatacagtagatgctatttaatgaaggtgggcatgtatgggtgaatattcccagtgtttcaggatgttttttctttctcctctggcttttctattctctgctcacctggaatgagagcggataaaataatacagacaggaaaccaggaagcagaagagaaccccagccacctacctacacttccccctcttagatgccctgcaacagagatctgtcctggggactccacctcatctttgccagcggtgtgcagctggcttcctaaaatccacccagagtaggggttagcttgtcagaaaaatacaaattggatgtcttctgcagggctttgcacagtcccctcagcacccacacttctgtgtcagggaggggatgcagggacacatctccttctaccctctgggagacttgtagtctacggctccaggagatgactccctggcctagaggactgtatccttaaaccactctctgctctgctggcttatgtcatcctcctgctcctttgggtagaagttctagagtcttatccacaaattgtcaccagttataggcttgagtaggcactaaatatgaaacatgaataatgacatgagccagcagagcagagagtggtttaagagtggtttaagggtcagagggaagggaaatgaaagccttggaggatttcagattcactcactcttctttaccttatagcctgtgctgcaaagtcagagtaaagaaacttctgttctgcctcattgcatccccaccacaacaggctgtaagcaggagctactccatgttttaatataaggaaactgaggccccaaaaattaaaaataactttatagtaccagctagccattggcaaaacacgattatacattcagatttgtccaattgtttccccatgtaaatgagaccacagattaaaattattattgtcaattaagaaaaaataaaagaaacccctgaaaagaggatctgatatgtgtctaactacctttaaatctccttgagataaattataaggtgttgtttctattgagccacccccatcaccagtttctcacaattcagtgctcagcaggcagtggctactcaagaattccagctggctgggcacggtggctcacgcctgtaatcccagcactttgggaggccgaggcgggtggatcacaaggtcaggagatcgagaccatcctggctaacacggtgaaaccccgtctctactaaaaaatacaaaaaaaaaaattagccaggcgaggtggcgggcgcctgtagtcccagctgctagggaggctgaggcaggagaatggcgtgaaccccgggaggcgttgcttgcagtgagccgagatcatgccactgcactccagcctgggcgacagagcgagactccgtctcaaaaaaacaaaaaacaaaaaaagaattccagctaagtggcagtgaactaatgagatttcatcacagagcatggtgaacgcttttctaaggtctaaatatgtgctctatagttgtcatggagggccaaagaaatgaagaaaataaagaacaatattagtcttaagaacttttttaaataacaaaaatgactgagttactaaggtcaggaactattctaatgcttttatactcatctcatctaattgctccaaaccccatatgaagtagacactactactactatcatgacccattttacaaatgaacaaactgagtcttgaagaagctaagtaacttgccaaagcacatcccagacttacaggcagtctggctcagagacctctgctcacagacactcctcttcctgggtctaattcaagaggggtgacgtgcgacttagagcagcctgtgggcttagtgattctgctgcttggtgcacagcaagacagaccataatcagcactagaataatagaatttttataagtgattaaagtaaaaccaggatttagagattgagagttgattgttaaaggataaatgatatttggaacatcttactggatttgattaaagtgaaattcaaaaaccatcacaaagagaatgattatttaccagtggtacttgaaggactttttttgtggcttaagtcattggcactccaatgcttaaaatctctgtgctcaaaaccagaatgtaattgatccttagaaaatcagaggttagcgccttctttggcaagctacttctgagctttgttacactgtaacataatcatcctttgaagactgagatctggttttccaggcttttttttttttcttcacatggtgcctggtatcttctcttgaacataatagatactttgagatgggtggacaaaccgaagtcattttatattgctttaggggctctgaatttaagaaagagttgatttctgaaagaaacataatagcaaagattacttaaacacaaaaatctcatttctgttcttaatcagctggacgtcaatacccaggttccagtccaagtgtcacactgtgcctctataagttaatcttttctggaagggaaaccaaatatgaaatagtatcaagaactgggacagtgttggaacaccctgcatgtcctctgttggccactacaaaaggttaaacaacaggagaggctggattagggtttgtgtttggaagtgcatttgaggcaagcttgacagttaagctcatggccagtactacatgccacagcaagaggacaataggagatttaaaagtgtgagcaggctgtggccaaatgctggaattcatgggctaagtagatgaagagtggatggagttaactagtaaacaagtttcatggtccttgaagagacctatttttttttatggtatgaatttaagatgtacaacataatgttttgatatacatacaattagtgaaatagcgataatttgatatttcatatatataccaaaatgattactctgggtgtattatttccttctcatgctgctaataaacaaatacctgagactgggtaatttataaagaaaaagaggtttaatggactcagttgcacatggctggggaggcctcacaatcatggcacaaggtgcgaaggaggtgcaaaagtacgtcttacatggtggcaggcaagggaccatgtgcagagtttataaaaccatcagctctcctgagacttattcactatcacgagagcagcacaggaaaaacccaccctcatgattcagttacctcccacctggtccctcccatgacacatgggagctacaattcaagatgagatttgggtggggacacagccaaaccatatcaacagggaagcaatttaacatatctgtcaccttccatatttaccctttttatgtggcaagaccacctaaaatttactctcctggcaaattttcagtctacaatattattaactagagtcctcctgccctacattagatctctagacttaactgcaagtttctgctctttgacctatatctgcccatttcctcctcctccctacccctggtaaccgccattgtgttttttgtttctatgtctttgactgttgttttttagatgccatatatgagtgagatcatgcagtactttttttttctgtgtctggcttatttcacttatcatcgtgttctccatgttgttgcaaatgacaggattttgtcttcttctttttttttttttttttagatggagtctcgctctgtcacccaggctggagtgcaatggcacaatctcggctcactgcaacctccgccttccaggctcaagcgattctccttcctcagcctcccgaatagctgggattacaggcgtgcgccaatacgcctggctaatttttgtattttttttagtagagatggggtttcaccatgtaggccaggctggtctcgaactcctgacctctggcgatccacccgcctcagcctcccaaagtgtctggattataggcgtgaggcaccgcgcccagccgatttccttcttttttaaggagatgtatatgtgtacacacacactacagcacattatcacattttctttatctattcatccattgatggacacttggttgatttcctatcttggttattgtgaatagtgctgcagtgaacatgggggtgcaggtatctcttcaagatgttaatttcattttctttggagggattgctgtgttgtatggtattctatttttaaattttggtggggtcttcatactggttttcacaatagctataccaacttacattcctcctaacagtatacaagtacctttttctccacaaccttaccacataagtgttgactttttctttttcttttttcttttttttcttttttgatacgaagtcttgctctgttgcccaggctggcgtgcagtggtgtgatctcggcttactgcaaactccgcctcccaggttcaggtgattcttgtgcctcagcctcccacgtagctgggattacaggtgcctgctagcacacccaactaatttttgtatttttagtagagacagtggtttcaccatgttagccaggctggtctcgaactcctgacctcaggtgatccacctgtttcggcctcccaaaatgctgggattacaggcatgagctaccaggcccagccttgaccattatttttaatagctaacaattattgagggcttaccatttctatgagtctaagcactttacaaatatttaatcttcataacaatctctgacatagatactactgttaatcccatcacacatactaaaaaactgaggcacaaggagtttaaggaactcgctcaaaatgtcacaattagtaagtcatgaagccagccagaacgcatgctcttaacccctgcactgttctgccaactctttggagtggtttgtttcagttgtcagtttttgtttgctgtctctgaaaatccttgctcttacagtgtcagccagagtcctgcattgatcacatggcctaacttgcctctctcagtacagtgactttttaatcttcggctgcaatcctttttttcctagactgtaaactccctgagggtagaaagtctgtctcattcatttgtgcccattttaatgaatgttgaaagggagcgtcaggaggggttatctagatgcctgtggatctagattattcatcatccactgggatctttattggtgttccttgtccccaaggagggagtcagcagcaacagaaggcagcagagatctcatcagtgttcatcaaacacatgttgagtgcctactacgaggtaaacagaacagacgttatcttctgtgccctctcagaacttaaggtacagcaaagaaacaaatgagataagcacaggtgtgataaatgcttgtttaaaaaacattttaaatgaaatgcttcgtttaaaaaaagcgaagaggctgaggtagagaataatggaggttgggtggggtaggacctactttaggtaggtaggcatgggaaattcctcatcgaagaagtgacattctaagcgaagatttaaccaacaagaatgacatagctaagaatgagaagactgctggggaagctccttgttggcaaagaaaacagcatctgcagaggctctgaggttggaaaggctttgtttcatctgtttaatagtggaattcagtgacactcattagttacctcttcacacattcccgccaaacacttgtccctgagtctgttctttttcattagtggttcctaatccagttttcaaaactgctcaatatttggagaggttttgaccagttgctctggaaacagaggcggttccaccatagccaacagagttcagaacataaattgtccatttatatccccatttgtatcttaagcttagcttgcataggactcagcaaagcaatatgtcaaattccttatatttgttatatctcttttttcactgactcaaagcatgaaaaatttgaaattaataaaacaattttttagatgatcagagattcttttttctaaaattttctaaatactatggttgtgtcccttaaccacaggcatggtggtttcactgcattttactcaagagaagattgcttacaaatatcacacaggagacctttctagtctcctgcaggagggtggctgacccagggaacctccaggcaagcaggacatatgccaagtatcctacatgtggacagtgtctaacttgatccgatctttctccttccccatgttttagttaagtcccctgaaagcccccattacccactgttcataaagggtctgtaaattatttaagagaaggaaacacagcctttatcccatcggatttttcctctcaatcacttgagtcttttctctgagcacacacacatggcccagactcactgtcaggggagatgtaatgccagcatctggtgttaatatctattgttgacattttgggaatgagaacatgagctgttagggaagatgtttgcttgtacctaattaatgtcccattgtatcctctcttgttgtcagctctgcctcaccatcctgccttggcattttcttttactggctaactttaaaagttaattatttctctgttgaatgttaaatgccaccggtttttaatgccgttccttggtgtgagttattagttatcaaaaatcaaaatgatctgtgcaattatcagctctttacctaaagccactgttcttgctaatcgcgtaaagtgtgatagcatttgctgatgtctggcaacatggatctttctagcagatttaagtttctcactcagtacattcctgtccctgtctggctttccttgtggagatcagatacaaagtcctggtacatcatctaatggaaacaattactgacagggccaagtcttcaaggcccattttgcttgaatctcaaatcactgttaaaattcatttggcaactccaataagtacagagagtaatgaggaacttcaaatagaatatttcctaatagctttcgtaaaacatgtcttggtaggagatcacaactctttctttacttgagattggtttataaaaataatagtacaagttccaactaacagctactaagtgcatactctgtgccaggctttgtcattagcttttcgcatggattatcttaatcctctcaacaatcctgtgaggtaaagtcttattattattcccaacttaaagatgagcaatttgaagactaaagacttgagtaattaatgcagcatcacatggctggtaagtcatgggccaggatccccagccagcagtcactgcagagctgcactgtcccaggcagtgactgtgactcacacgtggctactgagcacttgaaatggggtgagtccaaatgagatgggccataagtgtaaaacctacgccctgttcctaagctttagtcaataaaatagcgtaaaatgtctcgttaagaatgtgttcataccaattacatgttgaagtgataatattttggatgcattgagttacaggaaatatgttattaaaattaactttttgtttctttttcacttctttaatgtggctactagaaaattttaaatttcctgtactgcttgccttatatttctattagaaagggctgctgtgtgtgtgtgtgtgtgtatgtatgggtgtgtgtgtgtatgggtgtgtgtgtatgtatgtgtgtgtgtatgggtgtgtgtgtatgtatgtgtgtgtgtgtatgtatgggtgtgtgtgtatatatgtgtgcgtgtgtgtgtatgtatgggtgtgtgtgtgtgtgtgtgtatatatacggagagagatttctggagtttttcttgtcttaacgagtttccgatcctaaactattgaggaataggcacaaatttctgacccttcctcccctttctggttgtttcacttccagaaatccgacagaaagtacaaatttttacatctgagtctctaccaagagcccatctgttggctcttctcaagtatggaaagatgaaacactgacatgccaggcattaacgagatcaaaagcagggctaatgacagaaatgtggctgctgttaaagtgtctccagaggattatcggggaggactttttgttctccttacggcgaccccctcaaatgtcttccagagagtgcctctcagttccagttcctgaagtcctcctttgccttcctttccaatccttgtccaccactttcctggtccacctccctctctctcctggacgcccatctctggggtgtctgtgcagctgaggcggcccctctgttaagcacttctgacacgaggcaggtcttttttccctgccagtgagagcagagtgtataatggtgttgccctccaccggggatctttgagaagctttatggctctagcagacatgggggaaccaatcacaggcactgcagctgatatatgacactaatatagggttcacttttattctcaacctaaaaaaagatagattgttccaagtttagacaggctgtaaaatcatgtgcttctggaaccatgctgccttacccctgggaccactgtaattgctttacatctgtacaaaggttccttgtaatcgggctttctgccttcatttgtcttcttttcagcctcttagtaaagaccttaattggtcttagtggggcttttttcagttagtgcaactgtacctttagggctgaacaagtaccagacactacctgcggggagaagtgaggagatgggaaagacatcaatactcctttacctttaacagtttaattaatgtgctcagaacaaggagcagtttgaagaaattttggctcctctgggaccctgctacagatcagacataactagggttaggtggaattttctagatttctttcctgcttcagtctctgtgaacactcattagcctcataattgtctcacagtaaactgctgtatcaagtttcagtctgtctctttggaggatcaagttgctttatatcaatagactgaagtactaggggatgtgtgtgaagggaagtagcctctaatttcttctgtttcttagctactaattatttaataatacattttattgcctattaaaatgtggcataacttgcttgtcagcaaaactagatggaacctaatcatttgaggagaaggataattggcacttgtacagatggcttttattgccagttgggtttgttattgcagatagaattccttgccaggtttcttggttctgtttgtgggctggtcagtgttgtgagggggttacttactgtattacaacccaggcggttaaatgtggtattattgcaaatgcagtgtgtactcagttatagatcataaaggcttctgctgtgtaggtactttttttcttctcctccccccacctccccacccctggttttaaaggaccctagtgagttttgtaccacactgaaaattaccttatgtgctggaaaatgcatcagtggagactttgtttaaacaaagggcgtttttatgatggatagaagtggccaaaacttctggatttccatctagtaaaaatttgtgtaggaaaattggaccagtcccagttccttagtagaatttcacgaaggttttcctgttgcttcaaaatgaccccttgaggaatgttgtataaattccagaaaattgctcccaatgtttcctggagcacattaaaaaatgaaggagacacattgtgtgtgggatagtttggtaacagaattagttcactgggtagaacagaggggatcccaggtagttgggctctaagtgggaagcgttggccaacatttgtaactggaggcagatttggcaggcacttgggtaaggaacattttggtggtaatgaagtaggcaggaacaaaccgcgcaggggaagaatgcttcacactgccaggctttgtggcccagagcctagcattctcatccccaggtgcccagctcctctgccttcccaaggtgctcaagtttgctttctactcagatatggcccagtttcactggcaaccacctcccttatttgttgaaagtatggcttgtgttctgacccaagagagccatttaaaacctataatgatgtccatctttgtacgttttctgggtcccatcttcccatccattactactttgtcattgttcttatgtctcatagttgaactcctgaggtctaattgtgccagaacaacatgtctcccatctgtctggcaactctcttggcaactgcattcctcttcccttgaaagaggtacacactcttgacccctcccttccaaaagcctcagtgaagacctatgtgttttacctgtaaacgcacggcctttttaagtgtggaagggaatgtctagacttgatactttagaaaatcattatgaagtaagcttgacgtaggtagctttgtttcttaggggttgaacttgggaattactgtaatttaatacctacaataaatgtgttaaaatagggaagaaagccaattctgaggttttgtgtgttatatgaagggtgtgtgttatgcatcgtcattaaattttcttaagcaaaagctactagcaagtggaagccaatttaaaaggtgtatattggaaccagaacatgtagccagaaactggcttgggaggtgcaaatcctttagaccattgagagcatggaggttggcgagacctagaatgtctataaccttagtggtcacagtctacagtccactccggatgacgtggggctatggatgagcagatgggtgggtatgtgttggggacacgattttggacaacgttacatctgttgatttctttctgtcctgtagttgactcttctgagtttatttgtaaatcaccagttatgccaatagtattttcttatcagccctcaccctggtaacttttctcttgttgatctagatggacagacccaaatggagggaaaggattttaaacagtatgccattctttattaaatgaagcaccattaaaactacttccatctctgagtttcctttttccaggcccacgcctaacatttgcaaggcaagcatacacatggaggcccagcttacttctcttcacttctctttccagcaccatgaggagctttgctcctcacctcactcactccatacatccaagctccacccatactttttgccctcaccagcccagtaaacagctgcctgttgaccaccctcaagcctataggtgtgtgtaccaacagcatggcctgcccttgggaggatggcttccagggtaggaacctgcctatgcaggccctagaagcagcttaggccatctgggaagaggagtcctgtctccttggtgtgcaccacatggtcctaagggggaatgtgtcagctaggtgggcccatccccacgacttcatggattcttgccccatgtggagggacacagctggaggggccaagaaggatccccttatgcatggtctcaaggcaggggctggatctaacctgtattgcctctgccttttcatttcagtcttcataacctcacacttcatgtcctgcaaaaataaaatgaaataaaatggatccagctctccttcagaaaagctaaatggatgagctagttaactcatcagtgtctgcggacacaaggtgtgaaggcttagtctttagattcaatactggaaagtcagctggggtcttgtgcaaaagatgtgatgcattttgtgtaagaagtctgttttttccattagcatttaaagtatagcatactgctaaccagacacaaggaatgctctactatacagtgaaagaactatgcaagggaaaattgcagctgaaggaccaaattaggaatgttttcaatttcaagagtccagagaagaaacaaagcattatattgacatagtttgaacaaagtaaagcacttcgaaccttgctaacatttttaaatacacctttgttaaacctctttaaagaatgacgataattgcgttgttgttgttagtattcctaatgtccaaagggttgctgtaatttactctcccttcaaatttgaatatggttcataggcttctgtcttagtccatttcatgttgccataacagaatacctgacactgggtaatttataaataaaagaggttatttagtacaaggttctgcaggctaggaagttcaaggggcgtggcactggcatctgcttggcttctggtgagggccacatgctggtcaaaacatggcagagaaggtcaaaggggaagtggacacgggtgaagaaacccaaggggcgcccttgctttatctcagccggctcttgagggatctaatccattccctggagagtgagaacttactcacttccaaggagagtgttcatctattcttgagggatctgcttccaggacccaaaagcctcccactacaccccacctcccaacactgccacactggggattaaatttccacgtgagttttggtggagacaaaccacatccaaaacacagcagcttctaaaattaggttaagaggacacaaactctatccagaagccaatgtagtatgtgttttctattgtgctgctacccaaattttaacaatgagaattctgactttgatgtggcagtgatagtccttaaagtatttgaaggtctttgtcagttgccacttatttttgtgtagcagaagcacgggtttttatgattttgatcttcctttaaaaagatgtaggttaattattctgtcatctttatctgacagacaatggctaatattgtttattgtgtaaatgagacgctttactttcaaagaatgctaatattggctttgaaaggaaaaaataagcaagtatcttttttttaaagaaaaacagtctcactctgtcacccaggctggagtgcagtggtgcgatcatagctcactggagcctcaacctcctgggctcaggcaatcctctcacttcagcctcctgagtagctgggactaggtacatccaccatgcccagctaagttttaaactttttttctagggatgggagcctcacttgggatatagaaacccctagtgttgtccaggctggtctcaaactcctggcctcaagtgatctgtcgtctcccaaagtgctgggacttgaggcatgagccactaagctcggcctaagcaagtatctttaaatgggtccttgttagtcagcttttttcattatctcaagagaggagagtattaggagagcacattttcagacacactagaagacaacaataatacctgtgacaggtgtatgaccccggctcatggtggccttctcactcacctgactcaaagttgggcagcgggactaattttacataatcttaaatcttataaatgactttctgctctcttttccttacaccactgatttctcttccctggcacccttgctagtgagataaaacagggaacagagccaggaccagtgagctgccatgtggagtgctgcatctccctgaaggctgaccgtgagctgtgttcatgaaggactcattgtcacattctacccagaggcctctaagctgctcttttctggagtttaagcctcattcttaggacatgccgtgaatttgctctccaaaatgattccacacacaaaagtcctctctctataagccctaccagcattagccagagtcctcctggtattctttctcatctccacctgggttaaaaagtgagtgtgtagcagatttgtttaaaagggtcctcagctacacccagcctcccatataaaaatcgattcttggccaggcgcggtggctcacgcgtgtaatcccagcactttgggaggccgaggtgggcggatcatgaggtcaggagatcaaaaccacagtgaaaccctgtctctactaaaaatacaaaaaattagctgggcgtggtggcggacgcccgtagtcccagctactcgggaggctgaggcaggagaatggcgtgaacacgggaggcggagcttgcagtgagccgagatcgcgccactgcactccagcctgggtaacagagcgagactccgtctgaaaaaaaaaaaatcgattcttggaaaatcaagtcagataatgacgatagagcaaagtattttgctcgtgtcttttgtttggctcagtgttcatttgtcattacgcctcagcctccttttctttaagcacttgttgtgatctccgggcatgtgcttatgttcgtgactgttttccagagcattgctgggctgcttaacttttgatgctcccgtctaaataatgactaggttcctaagatgcctttacgcttcctagaagaatctgccaccatttgaattctctagcagcaccccaaaagtgctaaattatacagtccaaggaggacagtcatccaccaaagaaacaagggtaggatgaacagaaagggagaaagatgttgaattgagccaattcagggagtaagtaatacatgctctctggttgaactgatttttcatatggctaggtggctgggttctgcctgtgacttgttcaactctgcaagctactaaatagaataaaacttgctgaaatcagagaacttcaagaagataagttttatgtatatgtatatgtatataggcatatattcatatacatacccatgctctcacacactcatacacaaacttaaaggattctagtttagggtagacttaaccctttgacagttcaaagagagaagttagagtctacaaagtgattattatgtaaacccaacagggcctttcctggaaataccacaaaaatttcttagaattgaaaagatgacaaatgctgatttatgcagaactcgggacttcattgatagagcactgtcacttactacttccatcagcaggaatggttccttttaacatcagattgggtgtttacatggatgacaattagggctggtgaaatagttcaaataaaagaagaaccagaccggcatggggagtgaacctagttagttcccaagtattaaatacctgtcttccctcccttgtctctctcctcttcccttcctttctccactttgtttctcacttcactccctttccagactgttcttccctgtcagggaaggctgaacagagattgaaccacacaatacattgagattctgcagcagagaagacattcaaatcctgaaatactgtagtgggatctggttttcaaatgtttcttccccgggaaagtgaaacattccttgcagtcttataaaataagtatgttcgttgatatttcaagcaggagaaattcattttaagaagttggagtatttatatgtgacaggatagtagttcctctttctctcccccgtccctccctccctctctccttcctcccgtcctctcttccttcctccctccctttctctctcctctttgattttattttttaatcagaaagttctttttaaaggaagagaaatatcaacattgtacattctaacattccaaatgcttcatatagttccttgttttattgctttaaacattttttcaacagatacttaaggacatttttcaggagttgtgcaaggcatgaacacctggagatacgtaagctacagtggtgaacatggaggtgtccacagtaagcgggagagaggcaggtactctgcagtaagagacgggtgttaaagaaagataaattatctcaataactctggaatgacatcaaccccacttagaattaaaggaacagaagtctttgtgataaatattctctcagtctttccctctctgtgtgtgtataatatttttgttaatacacagatggtaatctaatgagatgcatttattcctcctgatatttgtaagtacagtgtatcttttcattgtattaactgttgttctacatctgtttggatccattctgtggattcaaaatcatgtagatcaccagtctctaatggttggacatttaggatttatctggtttctcatctgagtgtttattagatgactattggatttccttagacatattcttggaaatagaattgctatatcaaaaattatggaaaatctgaagctattgatatacctaatgctagatgacacattggtgggtgcagcgcaccagcatggcacatgtatacatatgtaactaacctgcacaatgtgcacatgtaccctaaaacttagagtataatataaaaaaaagaaaaaaaaaaaaaaaaaaatctgaagctattgatagtcttatttttaattgctctaaaataagtattaatttcttagaaagaattatttatttaaattaagatatttatgcagatgaaatacccaaatattctggtttgctgtttatttttatcccataactcaacgggtatttatataattaattatacttttcaagtttttcacccctatgttctacatatattgctacccatgtactccatactctattcttttatgcttctttgaattctgtaatttaaaaaatcaaagcaaactaaaaacaaaacaattcagctcaaataacattttttcctaaaaacctaagtctcccagcttctttgaactcctccttctatggactcttacagtcctcctctagcctatttatctcatttgttaattagctagctagcttttatgctatgttttattattagaatcctgtttcttttagtagattgcaaactactcagagccagagaccatgccttgtgttatttgtgtacacagctagcagagcaccttacacatcataggaatgggatctattttagtgattaatctgttctgtttttatttcagcagggtttgtggaagggcatggccaagttgatggtgatcatatgccttcaaatatcatgttgacaattatcacgttgatatggaaggaagggagactggcttactaaaaaagcattctagttgtctagattggaaaaaaatgcatttagtctttcaactgtctagcacctagtaggcagtcagtaaatagaagcttaaaaaaaaaaaattaggccgggcgcagtggctcacgcctgtaatcccagcactttgggaggccaagatgggcagatcacgaggtcaggagataagagaacatcctggccaacatggtgaaacccagtctctactaaaaatacaaaaaaaattagctgggcatggtggcacgtgcctgtagtcccagctacttgggaagctgaggcaggagaattgcttgaacctgggaggcagaggttgcggtgagccaggatcacgccactgcactccagcctggtgacaaagcaagactctgtctcaaaaataaataaataaataaataaataaataaataaataaataaataaataaaaattaaaaagggctcaaaagtccttttaaataagtatttcaatttaaataaatttattaacttctttttactccatttccttgtctaggaaaggtggatcagactcattcattataaagaactctttctgattgaaaacatttagttaactctctctggtcatgggcattcacatattggagacagaagcagaaccagttgtgtaaacactgaccaatgtgttcaatgtagttttaaggaaataaaatattttttatttatggataagtcttgatactaaaatgctaaaaacttttcagttagctggctggcacatatctctcagcagtaatactgctgtaggtaaagttggcgtgctacttcctttttcatcaggtacagtagctcagtttagacatcatatgtaaatggagaaaggtactgggaaagcctattaacaaaaaggattagtaggaattttaaaaattaactgtgaaaaaaattctttctgctctaagacatcatctctgcagaaaagatatttggtaaaggaataattggttcagattttctcccctagtatctttactatctgccctgaatttccctctttactcttcagaagagagggtcagttccatcaccaacccggatacaaagattctcatttcccgttaggtcatagcatttagaataatgtttattttggtatttttaaatattttgtggttttatgaggaaccaatacatgtggtcaagcattcccttattaagggaaataaagctcaagctcagaacagatggagaaacttgtccatacatttgcatgtgacgtgtggtgtagaccagaagtttaaagaatattatattccaatgacacatataaagcacctgcaattgacagagaacgtaaatggtattttttaaaggctagaagttcatagactccttccattcatgtctgacatcagcaagctcttaataatgcagtgtgtacttatctattgatcagaccatttaagtagtaagacatgagaaagtagacactattgtctggtaattgaccatattggagagttaagtgttctgacaaggaactaagtgtatttaaccttcagataagatcaattttaagataatgcctactttagtaatgaaccaaagctgttaagaaaactttgttcttctaaagcagtgctgttttgatgacaactatcatagttttaatgaccagatttgttcctgaccagattggtcttccagggcaacctggaaaggagttactaacattcatcctttacttaccataaaagctcaaatggaaagagacggtgggaagcagcactgcccaaagagccactgattggtttaggagacatcttttgggtacctaccataagccagtcatcatgctatattgtagggcttccaagtttagtaacatatctgacttcaagaaacttatgtttcagtaaaatggttttccagttgtattttatatgttaaatctctaaaaccaaagcttatgttagtccttcatttattaaagagagagagagaggaagttctcctatatttgcctctgagtcttttccctgtgacctaattgaacaccacttgaaacctccttctcttagagacagatccataagcaaataacacattataagttatataatacaaacatgaacaaaattgacaagagaacacaaagaaggacgtagctaaagcggctctgcatttaggaaaggcttcctagaggaagcaatgttgaactcttgtctcgttggatgagtaaagctccccagagagagagaaagtggaggcagtgtgagcaaagcaggtgaaggctgtggtatgtttgtggaagtaggtagccctacttatatgtctggaatagaggcttttgaaaagaaatagtgagagataaaacaggaaagtagattaggccccaaatcctccagaggtttttaagcagaagactaaaaatcagatttggatatcagtgaggtgatgctgataaactcggggaaatcacaggagctttttaagaagagagttgatattcacctagggcagcagtagtgacatttgagaagaaggaatgttccaaaggtattttagaggtgatagtggatagattaagtgactgaccaaatgtggagaacggagaaacaaaagaggagaggaggtaagggtaattctgagacacctaaccccaaagactgcatgggagagtatgtccaatacagggggaggattgagttgaagatgagaataaggaagaatcagttcattttggagatgttgagtttgaggtacctgtggaacatccaagtggagaactttggctaacaaagtttgggtcctgaagataaaggttaggattagaaatactgatttatgggctgggcatggtggctcacagctgtaattccagcactctgggtggctgagatgggcagatcacttaaggccaggagttttagaccagcctcaccaacatttgcgaaaccccgtctctactaaaagtataaaaattagccgggtgtggtctactcaggggctgaggcacgagaatcacttgcaccaggtggcgcaggttgcagtgagccaagatggtgccactgctctccagcctgggtaacagagcgagagtctgtctcaaaaaacaaaaaggccaggcacggtggctcatgcctgtgatcccagcactttggaaggccaaggtgagtggatcacgaggtcaggagatcgagaccatcctagttaacacggtgaaaccccatctctactaaaaatacaaaaaattagcccggcatggtgatgggcgcttgtagtcccaactacttgggaggctaaggcaggagaatggcgtgaacccatgaggcggagcttgcagtgagctgagaacgtgccacagcactccagcctgggagacagagcgagactctgtctcaaaaaaaaaaaaaattgtaaaaaataataataataataatactgatttatgaaatcactgatgaagaacgtagttttgggaatgttcactaatgatggctagaagaggaatattcatcaaaggaagcagtcagaggtattatttgatatctaggaagcagtagttttgcaaaagaagagagttctcagaaagtgcaaatagcaatatctgataccattgggagaacagaaagatatgaatcttctgaagaccactggctttgctagctattatagaaggccactgacctttagcaacaactttttcaggagaatgatgagagtagagactgggttagaatcattcgaaaagaatgaaataaagaaatggagacaatgaatgtgtgtattcagtgtttagggtgatgagaaatggagaactctggctgaaaagagaagcaaagtggagtgggtgtgtgtatgagagtgagttgaatatgtatataggctagggatacctgtatgtctctgggatagtaaggggtttggaatcacactcgtggaagatcaaacctctggcctactatttaatagatatggaccttgatcaagttcttctgtgagcctcaagttccttatgtataaaatgagattagtactacctacctcttggagttctttaaggatttaatgaaattatgacatagaaaacacctagaactcagaaggcactcagtaagtattagtaggattttttgtttgttcattcttgtgaggaagggagatattaaaggtgcaagagagggaaaggatgatgcctatgatgtcagagaaaagagatgagtagacatgggatttgagtagaggtagaggagtagtttcaaagtgagattggacctattttcctgggtaatagaagggaaggacagtgataaaatgaggcattgggcaggataatttaggttatgttgcagtaacaagtagccctaactctaagtctgttaatgcaacagaggttctctattcatactgtatggccaacattaattaggaagggtttctgttttatctctgcccctcagagacccagcctgatgggagctccatctcggtatttgcctctgcagtcatcatagagcagtcacatggctacctctgacctcaggaggccaagaaagtgcctggaattggggaagcacaggaaatatttggtgatcagtgctcaagaccagaacaatgagtagagctataggtataagtaaatagggaagggatggcagtggcttctctttttcccaatgaaggaggcagcaaaaatatgatccaccaagagcagcgtgaggggtcttacaagagtggtaaatgtttggaacagctgtttgttaaaataattaaacgggaacatagcagcaaaggaaaaggaagttgttctggttaaatatttatcattagggctccatgcagaatgaaatggtaatatagctgtgattcagtttcttagttcagcttaaaattagaagctgcccatcaataattttcccaagagagcgatttctactgtaacagcacatagcctagagaaaaggaaacgcacaaagaacaggctttcttggaatgggaagagaaaccattgcagggagagaatatgagagagaaattgattgtacatctatccctggaaataaaagtgagttcccttttatcagtcattctgtaaatacatctgctgctggcctagcactttggcactaggtgtaatcgagagaagtttaggactttattcatgttctcagagaatgtgttgtttggtcagtggggcaaaaaagctcatgccatgagtttgagggttgtttcatatatgtcttttattgccctaattgctataatttttggggaagagtttcatggaacagatgagattaaaccgaggccttgaagaatagattaaccttggagggtgtcaaaggaaggaaaggagggcaccagagtgatggtatcattcaagggccaatggtgggagtgaaaatggtttctaggggaggcaagaaggagagtggccagaaagaagaggagatgattagatcaagaaattatgggacatcaggttgaactgacaggttgcaaccttattataaggagttggtacaatatggaaggaaagcaggaattagttgttgcatgagagaatggcattgtgacaaggtacacttggtcagttgggaagaacataatgagaaggattagttaaaagacttcataataatccaggtatcttctcctcatctactccccatacgacttgaatgacttcctgttaccttcagaataaagtcccagtctttagtcctgcttgcccatccccattttgaagagactaccagatatgcaaagggtactagaatgaggaagactcggatatgttggaaccaggagccagaccatggatgtacaattagattccaacaatgctatcaacaggcaacatttaggagtgcagcctagcaccttgcaagggctgtgaccaagtcagacataaccctgccctagtaggatgttggaggttaggtgggctttccaacacaggcatcaaaggagaaacctctttattatttttttaaacagctttattgagttatagttcacataccacacaactcacccacttaaggtatacacttccatgttttttaataaatgcacagagttgtgcattcatcaccataatcaattttagaatcaatttcatgacccaaaaaagaaaccctgcactccctatccatacctccttccttgcccattccactgccccagctctcagccctaggtaaccaaccctctatttttcatctctatagatttgcctattctgggcatttcatacaaatggaatcatacaatatatggtccttgtggctgatttctttcacttatttttcactggttttaaaggtttatccatgttgtagtatatgtcagtacttcatctctttacattgcctcataatattacattacattgatacaccacattttgtttatccattcattaattgatagacattgggattgttgctactttttggctgtgatgaaaaatgctgttacaaacattcatgtgtaagttttttgtggatatgttttcatttctcttagacatatacacatcttatagtggaactgcagagtcactatcatttaaccatttgagtaattgccagaccatttgctacagtgcccgcattttacatttccatcagcagtgtatgagtgttctagtttctccatatccttgctaacacttgttgtctttttttttttattatagccattattctagtgggtgtgaagttgtatctcattgtggttttagtctgcatttccatgatcagaagttgtattttcaaaactaaggcataagtgaaagcatgtttgagggctttgacagaagactgagaaataaatattaagagattgatatggataggaggatttcaagcagttaaaggctaagaaggaattggacgcagccttttatagtatgcccagtccgtggtgttgccatgttccatggaaatgaataaccagaggttgctattctcattctaaccattctcagtccttggcaacacgaagttaggttcacctgaaaaataattttaaatataccagcgttcaggccctatccttggccaactgaataagaatgtttggggatatagcccaggtatctgtagtttttaaaatctcctcacatgattctgatgcacagtgagggttgaaagacaccattgtaaataattcagcaggattaaataatagaatgaatgtattgattgcatgcactgatcagataaccatctgcctttattttgacctgtaagcttttctgagacacctgctaactgaatttgatcaaacagatgtaagacataattgcagtgtgcagtcttctccaactaatgatagaggaaaacctagcgtgtggttcataaaatcaattaactatttctccccaattaaaccccgaatttaaaagttttgtcacagagttgagttccttcatttttttcccatttatattggctacacatgaggcatttgtttatttcaatgatttcaatctctttgagttcaacatacagtgatgcttttcaaggtaatgaattagttcattgattagtttatctattataagacagtaaattgatgtaatgagtcactgatagatatcctagtggttggctcatagatacaagcattttttatggttgtgttgatttgaacacgtgccatttctatgcaaaccttgacctttgtaattgacctgatgtgtacagatgacagcaaatagatcaatcagggtgatgtctcattaccatatggccagtgatttctctaggactaaagtatgttttttctctttagggattgagggccatttttgtcttctgttaaaattctaggtctagtcacaaaactggaaaggatgggaactaaagtgcaatactcttctgctagtttggcaccaagtttccaatgctgaaaagaatgattttccattgtccagactcttctttagaggggtcctatgtccccaacttaaaatttgagctacacagtttcagaaaatgaaaactgatattccagaaagaagaggtagataatgcagaaatgtcagtaattcaacatgttctgatgccaacctggccagagatggctttggtttcattgtagattgagatttcttatagaaggtttaaaatgcagggaaggtcaagttgagttttgtagaggaagatatcctagtacttttttagggaacccgtatttttgtcttaatggaactgctaaaaagatgtgcagtaatccaggccttctcttcctctcaaaaacaaactaggcactggttgtatttagtctcacattcgtttaatctagagtaaatggaagcctggcatatagatcattgatgtaaagagtatcatggaagaaattgaaatggaaacaaacagtagggggaagacctgtctggtagcacatcctctccatctggctagccgtcagatttcctggccatttctcattgtacacttcatctttgcttgcttcttacttcctttctttcttttttttttttttaaaatacaagtattttaaactgcaacctggaaagaaaacgagaggtatataacacatccttaaaaacaaagaggaaaaaaaaatcaaccctgttaataacttccactttgagagtttgggctggttgcaaggcccaggggactaatctgctgaatgtgggaggatatggagccatttgtcctaggagaagcactacattaaaaagaagaggaagaagtcatgggggaagggcgagggtctgctgatgaaagtagctgtcaaattagcaggtctggaagttgtagtgcatattgttatgagctgctcaagttcacaccagagcaaccagctccatccatctttctcagtttacattttaattggcttgtagttaagttttttaaacactgcgagattgctgacatacactgcaatatcacgtgaataatttatggaggttgctcaagacaagcttttttttttttttatgtgagaaaccaggggggagtgggggaagaaggatgagagggtctgtgggaggggccaggacagaagagcagacacaactgcatgtgctgtgctggatgttaaatgtttctgctggtgtaggcagcagcatttgggatttcagggaggtttgtacaatacgatcttattaataacaattctgtcaagagagcacccgattaaattgaattgggtttatgactccctcttggtttctgaaaatgtgtggatataaaacctctgcgatgtgaatattggataacaagggtaggtttctttatttatttatttttttggttggttttaatcattcctcctactactgagaatttgcttgtttataaatgcaggggtaggcatttttcccaaactatctttctgttttctgctctcaaaataatctagagaagatggaactggcatcagtgggcagttatcctaagaacgtgactgcttctaggcatggtttgctggacaactctgagtctagaatatcatctaattaacacctgtgggacaatcctcttcatctgctaaaatatactttttttctcattacaaaatgagtaaattatataaaatgtctagagtacaaagaggagaataaaaataacctgtaagtcctccccctgctaataaaattggtatggtttttgtttatatccttctagtcttttttctgttcatatttagtgaacataatttagtgaatcgtatatactgtttagaagtcatcttttttttttcactaaacattacatcacaagcatattcccatgaatggtctatacggaatgtcatttctaatgattgtagtgtgtatgtgtgaattaactatactttatataacctatctcctgcaactaaaatgcagtgttagtttataatttttatccattttagacaggcaagttataaatatattttttggtcaaatttcagtatacattcttgatcatttctttaggaaagctctgagaagtagaatttctacaagaagcagagtgagtctgagggaaaaaatcattaatgtctcaagaattttgtctcgaaaagagggataaagcacattttaaattaatgaaattaacagtttattctatttaaaaagaaaaatgatgataacattcaacatgaggttcttttaaattattgaattttttgccttgtggggtttcttaaccacaaaacctatctattaggattaatggaggctattttttctttaccaattgctatataactacttaagacttcatgtaatcagctgagatgctacaaatgtattgcctgtcaactccagtaaaaaagcgggcagttaattaaagggatgtcttgctgttaaacaaacttgcagtcaattgcttgtaagtaacatttagtttgatatgtagtcaaagggcaggaaaataagtgtttaggcaggactggctttttgcaacgtaaaaagagaagtgattatattggggtcaagatgagtaacctttcaactggcatattttccttctaaaaagtatattcacatatcagaagaaaggtgaaagacatataaggccttaaggttggtcagtttgagatcttttccacttacagtaactaagtcctcatcttcttgcatcccttgaagacactgttttaccctaatataaagcctggctttgaggtcagtgtgtgtgtgtttggacatgtgcgtgcacacagaccgtaagtagatgaggcaagaactccctaaaccaagtgccatactctgcagatgggaaactgccatccatagacccagtagaaaggctgcagtagcacagcagcacttgggacagctgctccaactcaggcccattacctgctcctcctaggagtgccccgatgctccctgcacctttgttcagctcttccttgataatccaggataggatcgcacagtttctggttggtgagcttgtagtcagaagcccttttcaagcttaacactttcagagggagggtttatccaaaagacaccatactgattcaatatgttaaatgttgaaatgcttgtgaaacaacgcatatatgatagagatttttttctatctcaaaatcacttggatatgagagaccagagctattagaagccccattgactttgctttgagattccattggaggtcattgaactttggagcctcactctgaagccaagaaatttcaactttgccagtaaccacattaaaatgtgtgtacctggcaatggtgaaccagcctcatttactggtttccattctttgtattggctattcattatttcatcaacaagaatttatttttttactgccaattttacgtccaactaggtagtatggaatgcaagagaaggtgtaagttatggccattcccctcatgggccttttaataaagcaaagtaaatatgtaatccacttacagtcagtcaagagcaatatttttatttgtaatgattccacattttagcttaagaaagtatttattattctgggaagaaaaacattggctgaattaatggcagattctgaatgggctttgagcaacatttggaatacaagtgtgtaaggtggggttggtgagatttgctttatttcctgaactgctatgaattagcaaattctaaaccagctgttttccaattacatacaataacttgtgcctacctaagtctgtctttctgccaagcttctacttgcaactcattttaaaacttattcctaaatacccccaaaccagtggaataatagtaggcatcaccttaaatcataatattttcacaagaacatgttcaatcttgaaataatggccaggttttagaaagtgggaggtgagaacggaggagtagtttgttttttgtcgttaaaaaaaaaaaaaagaagaagaagtgcttgaatgagcaagttgctcagatttctctgctgctttcttcccagatggccaaagggagagaacactttcactgaagaaagggataaatgaaaaggacacctctgtatccagttatttataggatgataattgatgatagggttggagttttaaaatgtttccgtgtgaacatcttgcagttcgctttacctgccttttctgtggtattaaacacattgcttaattcctattttcattttggattggcaaatttctttataaaaggtcagatagcacatattttagcctttttgaccacacaggtctctgacatatattctttgtttctctttttttttaaacaacactttaaaaatgcaaaaactcattttaatttacaggttgtataaaaatggactgtgggtgagatgtggccggcacaccgtagttggccagctcatgccttagagaaacatggggggatatcctgggtgggcatgagtatcagttaggtcagcaagatttccctcttactgctgcttgctttgttctcttctggtcactggccgtctcaggagctagtccctggagccctgctctcctgtgtgatgtaatggtgtgaaatggtgtttccagtggaaggcctgcaggggtaaatgctgtctctaattaacctgttcatttagtgctattatcctttatctcgaatgcagttctgctctgggaggataaggaaagtgcttaattatagtaacagtttcacattgtctttgtttgcatgatgaagtacaaaaagcccaggagatgaagctgtcagtcactaagtgtctttgggagcctcttggttttttgcatttaataatcatgctctgttattgcgtgttgttgaatgaaacctcaggtcacagtctttgtcaatgatctgacccaagacatctggcctatgtaagttatggctaatgtccacgaactggataatatcattggcaaattgtggcttcattgatgcctgtttatttgctttttgcctcaattagaatactttggattgttatttgtctttttactgtgttttctaactccctaattgcatgttaagtacctgtagtccagggaatgtgccccatgcttctttgaagcctaaagtcttttggaataccatcacaatatttttataggacttttttattaaccacaataaaaaatgtcctataaaaacattgcagagatcctcatactcaaactctgaggagccaaagtcagctgaatggtgtttgggtctcaaacaaacaaatataaatatatatatatatatatatatatatatatatatatatatatatatatagtgatatatatatcgcaataaaaatgttgtataaaatattgtaatggttaaaatggtaaaccatttatatatatttaaatagtttatatttaaactatttaaagccataaaatggcttaccattttaacaatttttaaatgtatagtttaatggcattaaatacattcgcattgtcgtacagccatcaccactgttcatctccggaacatttttcgtcttcccaaactgaaactccatgttcattaaacaataactctccattcttccttccccaaccctgccaaccagcattctacggtctgcctctatgaatttgactactctaggtatctcataaaagtagaaacaaatagtatttatccttttgtctggcttatttcgcttaggataatgtcttcttttttttttttttttgtgacagagtctcacttgtcgcccaggctggagtgcagtggcgcaatctcggctcactgcaagctccgcctcccgggttcatgccattctcctgcctcagcctcccaagtagctgggactacaagcgcccgccaccacggctggctaattttttttttttttgtatttttagtagagacggggtttcaccgtgttagccaatggtcttgatctcctgaccttgtgatccgcccatctcagcctcccaaagtgctggtattacaggcgtgagccaccgcgcccggccagcataatgtctttaaagttcatccatgttggcagcatgtgtcagaattgccttcctttttaaggctgaataatattccattgtatggatatgccacattttatctattcacttatgaatggacacttggttgctttcacattttctctattgtgaataatgctgctatgaacatgtctaagtcctgctttaatttcttttatgcatactcagaagtggctattgaaatatttttgcatctgccaatgtaacaacttttaagctctgtggaactttaaatattcttacggttctttcctatgttatctgcctatagtaaaataaattttataataaagaattcagttattagctatgatgcacaaaaagatctatgagaacaagcatgtattcatgctatgtaccaggcactgagattagctcttatgtgaattaatttacttaaggcccacagaatatgttatctgtgtgctacagaaaaggaaataaaggcttagagaggttgagaaacttgcttaagttcacacagctagtatgtggcagacagggttctacttcagagaccatgtttgtagataccatgaagccattcagaaaagtggattgcatctatattcctcattatattcccagcatggttagcagaaggcttatcattttccattgcatgatgtcacttttaaatttcaaaatcaaactacataaaataacatgtaaaattacttgaaagctttaaaagtgctatacatatgcagagtattaacagtaaatcctagtgatggacagatgttaaaagctataagtatatgattcagaaaccatctaagaattttaaactgtggtctaattattatggaagcttactggagcctatccttgtgatttgttagaacattgtttcatatgccattttattcgtatctcttccaattcttattaagactagcactgctgttatgaatttcatggctttttttttaagttgctggatataagccaggttatcatataatgccctttactacctgtagtcactttgggataggtactgtgccttcaaccatctttgaaatcctacaactcgtaggctaggtttagatgccaaatagctaaagagctatcatgttgaaaaactattattagggcgggcacggtggctcacgtctgtaatcccagcactttgggggagccgaggcaggtggatcacttgcagttaggagttcgagaccggcctggccaacatggtgaaaccccttctctattaaaagacacaaaaattagcagggcgtggtggtgtgcacctgtgatcccagtgactcagaaggctgaggtgggagaatcacttgaatctgggaagcagaggttgcagtgagctgagattgcacaactgcactccaccctgggtgacagagcgagcatccgtctcaaaaaaaaaaaaagaaagaaagaaaaactatcattagacttaatttgtgtcatttcagaggacagaattgaggccattctgtgtgtgtaggttctggaaggacacatttcagtgcagaataaaagatgtagttgtagcttggtagactggctgccttgaaaattagtaaactgtcaacagaaatattcaaatacaggctagaaaatcctctcaacaaggaagtaaaggggattcctacactaagagactgaatttattaatcttcagacttggtctattatgacatttacttgaagtgttctaagaacttcacctttaccattgtcttatgtggtattgttttcttcagcaaaagacaggagctaagaatttttggttggcttatttgctgtaccagaggcaaataactgtgctgtgttggaatgacttagaagtagaaaatatttcgatcaggtgcaaatcatggtcaggaagacaacaaggtcaactttttaaacccagattctccagggtgaggatgcatcatgtacaaaacatgactgacactaagcaaagagtctgaagtggtttgatcagtatatattgattatttgatttattgactttgctgcagtcttcttggagctcttcagcatccagtactataaaactcactttttcattgtaacatttgacttgagcaaggacttaggtatttggcacaaatgacattctctcctcttttctgattaatgtggctctgggatcaaacaaagttagtgcaaatactggaatatttgctcaaatagagaccaaaagggcttaaaattcagtgcaggtagaattgtttaagtatcagaagggcagactttggtaatttcagctgcatatgttggttcttatttcattttggtagaaattgagtactggagactgcctggaagccagcctccagcattgacgtctgacagtaaccgcaaaagcagtccccctttccgctggcagagccaggaccacgtccgtggctgtgatctcaggggagggctcccagtccacagcctgggcttatgactgggaagcctgcttcttgtaaggtggggaaaacagagccaaactgaccccacagaatttgaacttggagaaactgtcgaatccaaaggatccatcaaggccagggacaacgcctagtctgaactggcgaccatgggctttttcagagccaggtgtcagaaatgggtaaatatcaaattgtgtctgattaaaaacaggagggagcagagctccccttactcactgaggagccaaagtcagctgaatggtgtttggctccaaataattcaaaagccacagtctcatgacccaaccaaagaaatattcaaaactagcctgaaatagaacagcctgttttcagaaatatgctatcaaacacatttatctttggctaaaaaacgaattaagtagttttctcttaaaatggccagatatccattaacatagaagagtataggataaatacctcttatggagatggtcagattcatgatttcatttaagttaaaaatattggcaatgataccgtataaataatatttgctctcatccaacacttttggttgaattagtctattacctggggaaaacactgaaataggatgaaataatactaagaataacattagaattatatatttgaaaattactgattatatagctatttcaccaatgagatattcacaagataaagaagagggataatgatagcccaagtggacttcccaataatgcaatagtgaagaaatcaaaatccagccaacatggacatgtcttatatcttgattggaaggtagataacacagtacatacatttgtcaaaactcaaccaactgtacactttacagctgtgtgttttcctgtgtacaaactatacttcaaggaaaaagtcaaatcaacttatttatggagctacaatttatgagaaagtacaacattaagcaagccttgggagaaaaatttcccagcattcaggaaacttgcaaatcattcgttagccctagacacaaatgtaagaaaattttaataataaaaattaagtcaatgatgagggatttgaagattcttaatattgtggacctaaatggagcctctatgatcattaaccctccagttacaaatatggtaaaacagacattaagaaaattttagaaaattttccaaagaaaatcagagtcagaatttgactagatggcagaacgataagcttaaagctccttctcctttctcctttgtcacattgacttcctcctgctcctacctgctaaatattctcaagggtctgttttcagctctctttacctttatttttatattgcactcccgttgatcctttaatttcaaagttgttatttctttattcagtcagtaaacactttttgagtgtataccgtataccaagcactgttttataggtgggtgatacacagttaaaccagaaagactaaaagtcttcactcacagagcttactttctactaatgtctgtgtacctggaagccagatactgatttctggaacaagtattctcagcagtccagacaccattgccctacaacttcccttgcatatcacgacagtgtctcaagctcaacgtgtctgtaatctcctcttctctccaaatcatctcctcctatttcccccagcctgaagatcgtcattggctgtccttgttgaatctctaggtcaaccaatttgaaaaactctaaactcttccaaattgactttttcttagatcagttcagaatctccatgtttcctcacttctttgtaatgtccagtagctttctaactcatctctctactacaatccccaactctgatgtgtcctacacatcactgcctggctaattttcctaaagcacacctcctataccaactttttcccaaacacacacacacactctctcttgcttttcctttgatttcatctgcctttcaaattaaatggaaattcctctatctggcagtaaagactattgaaagcatggcgccaccctccctttcaaatctgacttctccactacaggtacctgtacctactccagctgaagtggatttttggctgctcctttggcaggccctagttctctaccactctgcctttgcccattgtgtttctatctggactcattatgcagctttgccccactccgtactcatcatcatcctctgtgtacaactcactcactgtcttttctaagactcctttctcattctgatcagcatgatttttccttcatttgagtgtagtcatcactcactgcattgcattatggtcattctcttccttttttattaaaacaacacgatggattttcataaaatgacacatccttattgaaaaaaagtatacagaagagtaatgaaagtaaaaaccacctgaagctgtatcacccagagatatctggttttgaacatccctctagatgtttctttgtgtgtatacacaatttatgaagtctatatatttttccagaactgagatcaaattctaccttttttcatgttgatatattctgatgctcttttaatgttgatcaatagaaaactaagctataatttgcagtggctgcaaggtatctcatcatttggctttaccataattttttgctttttgttgttgatttttttttttagcttgtgttcctcccagtagaagatgagaggaggaggtgcttagcatgtgttctgcccatgtgcttagcacagtcttgtaaaatgcaagtgagcagtctgtcatggtccttgacagggactgtttgtgacttatcactccatgcggtttgggacctgggaaaatgtttagagatcttgagaacaggttagagaggattgacctaaagtcccatagtaaaattttagcctttaaaaaaaacaattattactgctttgaacagccttatgcccccattgcctgtaagaaagccattcattatttcttgttacataatctgcagagagcttattcacttagaaagcagtgcattcatcatagcttctatcttatgagtagctaaaagcagaatctgttctgcatctttgaggcattcttcgcagcacagacctcatgctatcactaattagccagagcattcccagccaaaaatcccagtgcctgtccttgacaaaaaagtctgttttttccacagtaagggtgaaaagcctgcctctctgtctagggacatctccataagacaagcaaaaatagggtggtggtgagctctcagatcagccagcgcaatgaaacagactgcagcctcttaggagacttactgtttgctgcctccctttctctgcaaagtgggatctccattagacgatgcctttgtactctgacaaaatacctaaccaccatgagacaagccacttctgcattattctgtacattgttcctatccattccccatttttggcttcagaagtcatcccctagccaacttccagccacttgcattaatgatgaatgcgattagcagcctatgctagtccattagggaaaagaaagaaagaaagaaagaaaaaccatgagattgtttgcttgtcactgggaagtgaagcttgacgggaacatcctcactgtccctccccaccgcccctcctgccatgtgcctgtgatctgtgcgcatgtgctcatggttgcccgtgttccatggctctgccatttgctcagtggggggacgttttcttagctgagcagtgcaccactctgcctgagggattgagaacatattgcttggcaggtgggcctactcagacgcactgactgttgtttcagcactgacagggaacatacatcatgcaggcccattatgccagcataaatccatggtaacctgttcaaagggctgcaaccagcaaacaacgtgtttgggtcttaataggtgatatttttgaaacatataattgggatctgagaagtaattctggatgacaagccactccttctgccatcctaacagaagctgggcctacagcaaaataccactcctgtcatgctgcacaaagatgactgccattccagctcagctccaggctgctgtgcacggcgccaacggtgccaagagcttgtctgtgcagggaaaagagccctcaggtttgagggctttcctttgtgccttgttgctctggactgctggcaaaaggagctcctaggattgttgatagacaatgtcagagcctctttcttcagcctactattacaagtttgaaagggatctagagtttgtttggcgttgggtagtggacagataatcctcaaagcagagggttctgatcaaagctatctttcatatcccccactggcctccagtaggagaatgagatattaataaagtccttgaaccgagtgtgaaggggcttggtatcactagccttgctggctgcttccctacacagaagccagacatgtggtgccagcaccttggagatatagtgggtaaagtctggcacagccctggtcacaaaaaacactttttccctgcgtttctaggatgaggaggtgaatgattagtttacacgagtttccatccattggagtcatgatacagtttccttacaacacacttgctccatgactcatgttctgcattcctgttgtgcagactctcacaagatgcacctcaccgcacataatcatctgttgctttctgcttatccactaaactgttctccctaaagacaagtaccatactttatttgtacatagccaagtgctagtttcatgggagacacagaaggactgaagaaaggaagatgttcattcataaaaagaaaagccacaaggaggtcattgtggagttgttgacttttttatcttcttgatttctaagaatcataacatgggtatttcagtatgacttgccaattaaattacaactgggtggcaataatatattatttaactctcattctgccacacaattaaacaagtatcaacacaacccaatatgcatgctacacagcatctgcacttttctcttgctacaacagaagtagtttccttaaagcaaattagaaaatagtctcatgagaccaaggactttataaagtataaggaccaaggagggccaggtgtgcacctgcagtcccagctactttgggggctaaggtgggaagatcgcttgagcccaggagttggaggctgcagtgagcaatgctggcaccactgcactccagcctgggcaacactgtctctaaaaatagaaaataaaataaaattttccggaccaaagagaagactgttatgatgtgaacagtagcagtcaatatttagaaaagttgtgttcctggtagtctggcacagaatggtgattatgagagatatgggctgtatcacaccgcagcagtggcccagctaccactccaccagtttcaccactttcttgtttctactcaacagtatggttacttacaacacagagatttgccagcccaggtttcatagaaacatagacgttggtcctctgtccccagatattctagttataaggcctatacgggagcctgggattatactttgaaaatgcttttcaggtggcttagatgcagccagtctgtggactctggtttgggaagcactgattagaagcatacaatactgagaagcccagtagttccctcagtctttccactgccatgtgccctctatatgtcttccctgggccatctgtctaaaaatgcctgatgtcttagacagaggctctgaggagccttaagagctccttgcaagacataaaaccaagacgctttttggtatggaagggaaatatcatttagcacatctccatgtccatcatcagttctacttctgaaatattatttaaaaacacatttattgaaatacgattcacttatgaagttcatcctcataaagtatacaatttattgatttttggtatattgacagccatttagtaaattgtacaaccatcaccactatctaattctagaacattttcatcaactaaaaagaatccccaggctcattccctcctacccagaccctggcaatcactaatctactatctctgtggatttgcctattctgaacatttcatctctgaaatatcctaaagtgactgaacgtaagtccagttatatctgcaagtgtctctaaaaatgtttttttctaatattccattgggggttgctggttcttacatcttttatagtcagaaaggcttcacttatctctaacttttacctacattacccttctataacattaactcatattcccttgtcttctctgcctctctctcatcatttcaccaacactcaaattctttataaattcaaacatcattatcaagtcacctcccgacttttctgtaggatgaatgatctgaacagtcctatgccccttcccagatttacccaatatttcctcctatttcttcttatttaaataaccaagtgttcacccttttctctaaggtggatgccttcatttgtgccctcttttttattctctttctcctgttctagaacctggctttggactgcatcttcattttctttcttcaacctacagtaatactccacgttcacactttttaaaaaatacctctatcctgctgcctcctcaagctaccattctctttttctcattctcttcactgccaaaccttttgaaagcacagtttgctctctctgttggtgcttcttttccactcactcccacttcacttcttgcagccatgactctgctcccgttactttacagaaatgtctctccttgtagttcatggcatcaagcccagtacccttccctgaccccattccctgagacctctaggtaacctggagctcagttgactattcctccatcgtgaagcactctttttcctttggcttctctggcactccacattatccggctacttttggctccagtgtttagtgccttcccaaatatgggtgcccactcttttatctgtctattttctccctttccagcctcataacaccatctggctcctaactatgtggataacttccaaaactatcttcaccacttggatgtcctgccagctctttagactcattgctcaaaacagaactcaaaccctgacaggctttccgtctttcctaatgttggccataatgtgacccaaggttgcaaatttgacttttttctttctgtctctatcacctccttggttgccaagatgacaagccatcatgtatataatagcttttttattctattgaagctgtatttcttcatccatcgtctctacttctcaatgtcattgcccaggtccaggctttcattggctctcatttggactatcaccagaccattcgatctctgctcattccatcttctacgttacggccagatagcagtcctccttcaacacatatgtcatatccctaggcagcaatctttcaaattcttctaagcctactgaatacatcctaaacgccttatcctaaattacaaggccttctatattattttccattccttcatattctgtatgttctgtcctaagcaaagcactgatcattctttcacctccacaatttctcatttacaggacctttcttgtcctgtattcttttatctaaaatgatgtcctttatttctgccaacatgattctatgtgttgaaatcctctcatccttcaaattctttctcttccatgaaatcttagaacagtatttctctctcctttgattttccaaaattgtatgaggtggcgggggtgtggagggtaggaaaggacatttagcactttgtcttgtatttccattatttatgtgcttgtcttatccagtcccgccttggattttcattgttataactcctgtgactgctgataaagtatcttaaatatagtatatcctgaataaatgtttcttcagtgaatgaattttttaacttctataaaatatagaagatgtaaaaaactaaacttgtagatgacaggctttatgtcagtgtcaagagagttctcagtagtttccacactattattattttcagtcaatctaggtacaaggctgaggtgaaagaagcttgagagaattgtagcaaacctgccatcatcttcatattgtaatgcctttgcatttgcataatattttataccattataagatactttcacatcttatctgaccctctctatacttattttaggttagaaagagatagttatcctaatatccatttcataatgaggaaagtgtattctgggcagttttaatgacttaattaactaacgtcaggttattgattaggggcagacctggacaaggggacctgttggctgtctttaaatatttgaagaactatcatgtcaaagaaaattaaatctttttttttattctttatttcctcagaggactagaacaaacacaagtgaattcaaactcaatgaggagataaatagtttaactatcagatccacttcaagatgatattggctgcctctgttgttcaagaggagctcagggagagcaagctggccaaccaggtagaggacagtttgttggaaagagcctcccaaaaagtataggttaaccaagctcccttctaattttgcaattttgactttctttttaggtcagcactgtgttactaccctgcataatctaagttttgatttctgtcttttttttagaactcaaccttaagcaaatttagccacagtgtggtccaggtcctagattttttatgagatggccactccaccttatcctacctactccttgcaactgatattggaccacctacaggtgggaatctaaaagaatgtatttccacccaatccttcagtgcctagagctgccagcccaatggggaaaaaaaacacgaagttttcagaaaatctcacaggtgccatcatcacatgtagccggcccaatctggcaactccagaaacctgtctggtattatggccatggtaggcaagcctagtgttctctcagaatgccactctctcattctgttggaaggaggtgggtgactctaatgagctccaaacttttccttgaaatggggagttgcctaaaaaggcaactgcctccaaacagccaaatggaaattatgatatttcactgaactcagaaccaaatctgccttttttttttctttatagaaacattttatgtgccatgtgccttgggagccaaaaagaaatcatactttggctccctgttccactttgctaagctcagatactgtaaataccctcctctcctctcataacgttaaatttttcatgaattcatcataaaggagccactttgtagatttggctggtaccagtgaaagacttcattttctatttcacaggaacttttcagtgcaaaaaaaattacgggtgcaatgttgaaagactagaattattcatcaagtcttcactgcctgcaaatgaagagaatttttctaaagcctatctgggagaatgcagacacagacatgcatattttagatggtgcttcatcttcaccgtagccaccttatctttctcagaagagtcaggagtaagagaggatatgtgctttcttattgttttgtggattcattcaagagttcacaacagctcacacatttcccccttaccttccagtgtacctggaactcaccaatgcaccgaagaagagaatatttccttgaattacgcattgatagaagtaccaatagctttgtatgataaaatgcagtggttctcagactttgacatgcatccgaatcctctggtgggcttattcaaacacatgcaaggcctcatgccaagattttctgattcagtagatgtgggttgaggcccgggaatgtgtctttttagaaaggtgatggtgctaatgctgcctgtacaaggacaacactctgaggaacactaacataatgaaaagaatttagaaatcaggaaaccttggttttagtcctgagtcatctaccaatgatggatctgtggccaagtccctgggcctcaagagtagtgactcctgcactatgtgaactagtgttactttgagaataaaacctgagggtgtgcaaaagaacactcagcactcagggctctagagggacttgaaatgttataattacaggcatgaggagagttgaaggaaaacaaatggaagaagttttaagatgcattcattctgtcaagtccaagcagagaatggccggcactcaactgctatgctaagaaggggccagcgaagatgggaagagttaggtagttcccccattctgtgacctggctctgaaaaagtcagatactctgctttattcatgttctatatgatatagccaggccgtgttagagcagtggtcctcaaactttcctgtgattcagaattaacctgggacattaggtaaatacacaaaggcccaagctctttcctacttcaaggagcctgggccttggggtgattctgatacactccaaagtttgagaatgaccgaatctgtgctgataactgtaaaaccatatcctgataacctgtgaaggaactgaatgccctagacagttttctcagccttgtctgcacattggaatcccctgcagagcttttaaatcccacacgtacaggccaccatccagtcctgttgtatctgaatctctgggggtgaggccctggtatcagtaccttcttacagcgcctcagtaattcacatttgcagccaaggctgagaagcaagcactgatttagaaagagtcccctgtcactgtcctcagcaaatatgttttgtttgtgttttgttggcttgtctctttcccatatcatgtggtgagaatattgaggccatttctttgtgcccagaaaccaacacagtgcctcactctgtgttttagatgctcagaacatgttggttatttgaatgaatatttcaaggtatttgaatgttgaattaatgaatatgcaaataaaatacaacaaaactcaccgcagaagtcccctacattgaactgttttgtgtaagcacaacccgttgtggagttcaggccctcacaataagagagtatttattgaataatttgcagaatcacaatcacggagtatctgttgaataatctgtaaaactgttatcaaccccaactataacttactcttccaggtgagatgaggagtcggggaaacatttgcctggcagagtgttaagaatgctaaaaaataataacaataaaaataaaaaaataaaaagcagcaaattaagacatatttgacacctactacgtggcatacattttcatttgttctcactgaatcttcacagcaaacttgcattctctctgtttttttctgagggaagaaatggcaaaagcaaatcgcctgtgttgggaagcacaggggagtttgttggaccccagagcttgagttcttttccagtatttattttgctgccattcagagcttccctagccacccctgctgcttccctgacctgctcctgcatggctcaccaatggatcctagtcacaccagcccccacagagtgcttcctgacttctccagtgaagtttcccccgggaaattctcactggcccatgatttgattgcctgaccaccttcaaaacgggttagataactcatagtatgctatgctaaccatgttaaaaagcttattctcatagctttgcaatggcttctttgtatgactgttcctcgccctagacagaaggcttcttgagggcaagaatggtttcttgcctatctttatattccctttgcctagtgtacttcctagcccattggagagactcagttttttctaaggaatgaatgacagcagaaactcatccatgatgagcaaggacctcctgaaacatttcagcatgtgtgcatgtgttgtgcttcagaatattttagaaacattttccagatttaattgaggcttctgggaagccttgctgtgttcttccttgcaaaaaatagaaggtcgttaccaggaagtctcagtgtaccatatttatctggtgagttttgaaaatactgagtaatgggactaatgactcaacatagtattttccaaactgtgaggtaatctttggactttgcaagattattatattaagtgtactttttagtctgtcagtaaaaaataaaaagcctgtattttcacattagaattcaaagaacatctgctgcgtattgtaaataacatattttgaaaaccaactgatgcatactcagcctgcctccgcttgctaactatagcaggtccttaagataagattcagtttgccattggtaccgctcttgctttgacattccactgtttggtgaaccaccgttttccagaaatctttagacaccattcaaccctctaaacaaactgagtacagtgaggttttcagcttcctgttttctagtgggattagaaagggaccctattcctagatgatgatgtgtttttcaaggagttaaacttagagaggttttctactggggccatttcttacccccaaggacatgcatcctctggctggaagctcagctcttactgccttgcagagagccaccagttgccacaggcaaccgactgctcccgacaggaagggtagtattgattttgctggtctgcctgtaggggagcgggccaaagaggaatgctcagaggggctcctctgtctggggtgtgcatttgcacagcagccccattcatgtcctccagcctgtatctcacctcctcgggagactgaaaaactcaatcagcttttcccttgttccttctcagtttgtcttgttagcactctttcttagcaagtaagcaccatatgtcttctatgggaacttgttttcaggagattcccagcgcatgtgtgctggctgggaagagaggaattggtgttttactaaccagcagcgcttgccagagtgcccgcttttgagtcctgcccttcctgctcatctgccccatggtctagtttgtcctggacacagtatttcactggatcttactggggtcgcagaaaattgcctggcttgtgagggatttttctgaaccaaagagagagcctgtgtggatgcctctctgtggttcctcattatcctgggtagtctgtgtctcacaagcacctgttcattgatctggtcctctgtccttgcgaagacgatagcacatactgattataggggctctatgtgatgttattgggcttccttgctcttagccagccacccatgccaaagcatgcagctgatatgttctgcttttgaaataatttggtttctgtaacacgaagcccaccacccccctttcaacctttaatacctgtcttctttgaaagccagcttgttgagcatccaatttgtctcttttcttcttcactttcccccagtttccttgcactcaggctgtcttttatcaaaaacagagagtgagccaatgacacctcatggcaagcagcagcatgaagcattttcttctttcaccttgacatcttttcggcaaagaaaaagcaagggttgggaacctgctctattcactttggcttctacagctacctcttttaaaactgctggttgttattgcctggtagctgtctccctgaaggttttaccagttgttttggaaggctggctattttctattcccttgggaattcaccttacacagtcatagatgcatgtgttatgtgtatttgtgttcatatgctatcaattagtaatgaaaaatcaggccaagcctctttggtacttttttttcccctacagatgagtagtcagtgttcataataactgccaaaacttatcttgagtttcctgagtgccatggtctcatgtcattcttacaacaactttttgaagtagtccccattttacagatgagaacactgatgcttgacaggttatgcaccatagtggagctaagacttgaatgcaaagattctgccttgaaagcccaggctattcaaagattaactggattgcctgggcctgatacggtatctctcagtcactcatttgaactttgccaaccatagtcctaaatgcccaatgcttatccttggaaaggctagatatcagcaaacatgagatgagttgaaaataatctttgttctgaagttctaagggataagacgcattgctaccaacatatgtggcctattaaatgatgattctcagtggcacagaggagattgaccactgtggtggggaaggtggggcaaggactgagagagagtgggggacagttctgttatagcccaaggtgataaaggagttgtgataatcactggattgataatcactattctagaaccatagtgttcccctaatcataaaagctactattagccacgtgttgtggctcacgcctgtaatcccaatgctttgggaggccaaagtgagaggatcgcctgcagccaggagtttgagaccaacctggacaatataacaagaccctgtctcttaaaaaatgtaaataaataaataaatgtttaaaagccactagtaagtgaacacatactatatttctggcattgaactatatgctttcatttaatcattctcattaccctataagaagatactgttatctcattttttctctgtaaaatgagatttctctgtaaaatgattcttagtggcatagaggagattgaccactgtggtggggaaggtggggcaaggactgagagagagtgggggacagttctgttatagcctaaggtgacaaaggagttgtgataatcactggattgataatcactattctagaaccatagtgttcccctaatcataaaagctactattagccaggtgttgtggctcacacctgtaatcccaatgctttgggaggacaaggtgagaggatcgcctctcaccaagtttcagagaggttatcctggctcaaacttgccacatcttaagtgaaaaaaaacttagacttgaacccaaatgtgtttgtcttcaaagcctatgctctattctttcctaattatcagcgtctttttgcccattgtgatatttaatcagaatcattatcattaatagctcatccaactgataaaggaaggaaataaatgaattttgtatttgtggaccagagtatgtgattgagctgagtatgcaaagatttggtcccctggtctactggatgatcttttcacaagtgatctcagttagctgccatgtgcttaacataggttgaaagttagttgacagctttgcttcactgaggattgtttccagaattatcagtgcttagtgactttgaagataaacatggattacaggttcaaggagcctacgagagtcagaagagttgggaatgtgttcccaactctttaactagctgtacagatctgggaactgcacttaactctattcaacctcagcttttctatctgaacatcatgttaggtaattccaagatatgttttagctctgaatgataattgctgtttaccgtcaagcctgtttgttttacacatacagaaaaacactcttaacccatgaagtatgtagttaattgagaaagttaaaggaaaaagtcataaagaagaaaatatgctatctacacttaatttttaaaagcagctttattgtggtgtaattgacatatgataagctatgtatatttaaagtgtacaatttaataagttttgatcaaagtacccactcatgacaccatcaccacagtcaagataatgagcatcttcattcattactccacaggtccccatctcctttgtggtcccttcctcctgcccattcacccagcccctgccacatatacaaaaaaacaactgctaagctacctgatataccttctgtcactatggattactattcatgtttagagtattatataactgtaatcttatagcgtgtatacttttttgtgctctcacattctgtataattattttgagatttttttttttttttggaaacaaagtctctttctgtcacccaggctggagtacagtggcacgatctcagctcactgcaacctctacctcccgggttcaagccatccccctgcctcagtcttcagagtagctgggattacaggtgtataccaccacacccggctaatgtttgtatctttagtagagatggggttttgccatgttggccaggctgttctcgaattcctgacttcaagtgatccacccacctcagatgcccaaagtgttgggactacaggtgtgagccactgcacctggcctattttgagattcatctatatggctgcatgcattgaggccatttctttctttcgctgagtagtgtatggatataccataattatttaccttttcacctactgatggacgtctgggttgtttacaatttttggttattacaaataaagctgctgtgaacattcacatacaagtctttgtatggacatatatgtatttgaatcttaaggaagtatctaggagtagaatggctggaactggtaggtatatgtttaatgttttacaaaaatgtcaaactgttttccagagtggttgtaccgtcttacatttccaccaaccgtgtataagagttccacctcctcacatcttcaccaacactttgtatgtcttttcattttagccattcttttattatttttttttttttgagatggaattttgctattgttgcccaagctggagctcaatggcacgatctcggctcactgcaaccttcacctcccaggttcaagcgattcttctgcctcagcctcccgagtagctgggattacagaggtgtgccaccatgtctggctaattttttgtatttttagtagaaacagggtttcaccatgttagccagactggtctcgaactcctgacctcaggtgatccacctgcctcggcctcccaaagtgctgggattacaggcatgagccaccgagcccagcctcattttagccattctaatacacatgcactagtgtctacttgtggttttaatttttgtttttctaatgactactgatattgagcatattttcatgtgtttgttttccatatgtatatctttttgggtaaactttctatataaatcttttgcccatttttaacttaaattctttgttttcttattgtgagtttgagattatatatgaaaaaatattgtttaagaaataatctaaaataaaaataaatatattcttttatttatttacatatgtatacaactccttacatgtatgtacacacacacacacacacacacattctgcaaagatttgctcctagtttgtgggttcttttcatttacttaacagtatctttcaaggagtagaaatttttaattttgatgaagcccaattaattaatttattcttttatgtgttgtgtttttggtattatagttttgcctaactcaaggttaaaagattttctcctatgttttcttatagaagttgcacaattttagtgtttaaatttcagtctccaatttctgagttcatttttgtatatgatgtgagttcatttttgtatatgatgtgacttcaattttgtatatggtatgaggtatagattcaagtttgtttgtttgtttgcttatggatattaaagtgttcccgcactgcttattgaaaaggttatgcattctctactgcattgcctttgcacttttgttcaaattctgttgttcacatgtatgtgtttatttcctcaccctttactcagttccactgatgtaattttctgtctttatgccaataccacatcatttggttactacagctttatgatatgcttgaaatcagggaatgttagccttccaacttcttttccaaattgttttggttattgtaggtttatatatttccatatgaattttagaatcagcttgtcaacttgtatggaatctatagctcactctgaggagaattaataccttattgagtcaaaccatgaacaaagtattttttcatttatttagatcttctttcatttctcttagcaatattttgtattttttaatgcacaggtctttcacatattttttgtgtgatccctagttttttatattttttgatgttattgtaaatgataacatttttaaaatttaaatttttgattgttgctagtacagtttatttttgtatattgatgttatattaaattatgataaatgcacatactattatagttctagtagcttttttatagattctctttgatctttctacatagatagttattatgcctgcaaataaagacagtttaactcttccttttcaatctggattactatctcttttccttgttgattcacttttagaacctccaaaacaatatttaatagaggtgagagtggatatttctgttcttagggcaaaagcattcagttgttcaccataagtatgatgtttcctttgggattttcatatatagccattttccgtttgaaaaagttcttttctaatcctggttttctgattttatcaggaatgaatgtttgatttttgtgtgtgttttttgatgctttttctgcaactatgaagaaaatcatatggtctttcttttttttttttttttttctttttgagacagggtcttgctctgccacccaggctggaatgcagtggtgcgatcatagctcactgcctccttgaactcctgggctcaagtgattctcctacctcagcctctcaaatagttgggaccacaggcatgcaccactatgcctggctgatttttttttctttttttgtaggaacaggttctccctaggttgcccaggctggtctcaaacccctggattcaagcgatcctcctaccttagcttctcaaagtgctgggattataggcatgagccaccacacccagccaggtcttccttttttagtgtgtgactatggtgaattatattcatagatttccaatattacgccattctatgtacattgtacatacattgctaaggtctttttttttgcttatgggtttgctttttagagctctgtatcatctttcttatataaattctcatccataatgcattctctacattctcagtttcagtttaagtggaggcagatcttggacacttgtcaagttttcaagtcctctaggtttaagatttgttttgttttgccagtcttttataatttccttgtccacacctaagtggatagcagtttatctttaagtttctcacctttagtgagtgtctaaaacactcttgtttggtttgagagaagcaacaattatatgtccatattcatagttcagcaatgaaggtaattattaattaaacgatataattgtaatacccagcacaactgggtaaaaaaataaaataaaataaaataaaataaaaataaataaaaacttgggatggattacagctgagtgttggtaagcatacagcccagtggaggagagcagaagtgtgtagactagagaatagccaactagactcagatttagtgtgcggtggtaagctattcagagagtggaaacaattagttactccagggaattacagaaatggaaactaatagagcttctgtaattctctttcattcctataaacagtattcccttccttcagcaaccagtgggcaaaggtccagaggtcaccttctatacgaggaacacaaactagtcagcactgaattatcctcacaattagaaaaacacctgtgaccaagtgtggatccttgcaatgggctttaactatacctgtagcaaatatatggaagaaccctggatttagagtcaagtgagcctgggtttgaatagcaatgactgtctctgtgttgttgagcagccttgggaaaattagtacctcagagggtcatctcaaggaataagtgatagaacatgtatgagacagacacagagttgtaggtatgccttgtgtgtggtttggatccttgttgcaagatgtttacactatctagagtggtgtgttctacccaaccatatgatcctcctgcccaaaaagttccctagctctagcctgtcgcaacatttgatgcaaatggagaaggaaggacattgaaggcagagaaaacagtttgaccgaggttaggtggcaaggaaggagaaagcatacatgggaagatgtgagcagtcaggattgggcacaaggttcatgctgaggtaggggggcagacaagctgaaaagtcgcctgatgtgcgaccatgccaagccgtgaagattggctggattctctcacctctcccctcacaccttatataggaggttggtaagcaaggagagtcactgaaacttttctttttaagggaacgccatggtgagagctgtgccagggattctcaaaccttgactgtatcagaatcacctgggagcttgttaaaaaatacatataccttgggccccacccagacttactcaatcctaatctataggtttgggtcaaggcatctgtatttttaacaagctccctaggcaattctaatgcacgccaaagttgagaaaccactgctttagaaggttaatctggcagcagcgtacaagatggattggagctgagagagcctggaggttcagagacctgcttgcaacaacaatcccggcaggagataatgaggttaggggctgtgggaatggaaaggaagaatcagatatgggaggtatttttgagaggcagtcagcaaggactgggcaacgaatttgatggggaatgtgagggagaaatgggacttaacaaataatgtcaaggtttagagaagctgctctccatggcatgaagggagaggtaacagaatcccctggggaccttagtcaaattgcacacacctgctcccctttctgtgctcatcctccacatcttcctccttccctgcaagttccctgagatgtgtgccaggatggggcatatcagctcctcctggggaagcctgcatgtgtagtttgagggggaaacttttccaggtgacacttctgttgcaagccacttgttaggcatctttgagcctgtgagaatagtggtgtggtgagattaggaggaaggagggaccaagctggagctgaccacaggacatgaaataacctttggaggctgtggaaatgtgagttcagagctgtggagcaagaagtgggctgtgatataaattcaaaaggccactgcatggaggtcatggtgaagacagatgagaccgtggagagtagagaggaaaggatccagaatgaagcttgaagaaggcctacggttaggagtcatatgcagatgaagggtcaaagaagagcaggctgcagaggtgggaggagactgcttctgcttcaaggccaaggcatgaggcagacatctagaaagatctgcaaacaggagggcagaactctagctcctctgccatccttccaccagcgtgattttgtgcaggaagcagtccagtcccccaggagtatgtggcacagtcatgtaaaggggttaacgctgtataggaccacacatttgaaaattttctttacaaaatccagtgtcttttgagctgatgtaccagagactgacaggctgtaacttcttacactattccccccaggtttctgatcaactcataaccttctatacacatttttggcccagcacagccaaatgtaaggtattaaaaatcattatagtgctttggggtccttgctccccgcaaagttccagacatgctgcctgtattttgtgatgtcacactgtgaaaataggatgttgtgttttggaggcacctccagggtgcccagcaattggcacatcttaagtgaaagaaaacaaattgagtgagcaacagtagaaaagaaggacatttgtatcaacccaggaaataaagaattacgcagagatgctatttatgctgctatgaagctgtgacttgatagggacagcataaaggttgcccactcctgacattggcaagacttcaggctgaccagagccactccactgaagtggggtcagctgtctcagaaggtgctctgtgaagctgacgcagaatcacagtttgctgtaaaaagggcttacacatgtaaaaccttgtattttgtcttagaagtatcctggaagctatcgcattttcttagtagagacacagaggcatcaagtaataaagaaacgattccaaggttccagactcctgggtagttgggcaggagactcaacctagagttctggtttgtagggtacagagagaaaggcttgcatgcgggaagagcacatttaagaatcacttggggatgggcgtgggttagattccagtctgttgcttcttaactgtgtgacctggggccattcatttgacctttctgagcttcagtctccaattgtaaagggcagaaaatcatatttacctcctgagagtagtttcaagaattaaggatgaaggcaccattacagcgcttggcatgaagttgatccccccaaatcgatgcccatcatcataattactgggtttttccccagtcgtctgaacactcatgtactcccctggatgcacgcaaagagacactgctgttttcctttggcatccctagtttggattttaaatgcttttttcctcattaaaataatgttatagctggaaggagcttaggtgcagttgaaataatactgttacgaaggtctgtccttcaaggcatttataaactgaatgggactttttgagtgggcctggacaccaggattttacgggaaaggtaccctagcccccttttttacaagtgaacttttattaagccaccagctctcagaacttgcagaattgctggaaaattgccttgggcagggtatgtaatcacaaaatgaataaaagacaacaggatgtgagtctttccaaagcatgggaatagcacactgcaacttcttgccatccctaccctgggcaaagatgcagctaaccagctacattgatacttggaattaagtcaggaggcttggccaggggcccccaccattccacaccttgggcctgactgccactctcagtacaggttgctaatttaaatgccatctcctggcactgcatgttgaaacaaactggaaaatagcagggcctttccttcatcagatcatcaatgtctgcctggcgtctgcctgcctactgtggccaacaacctgccttcctgtgagcatcctccaatgtacaaatacctcaaggactcctgacctctgggatttcatggctcctgtccattcttctctcattctcttagcaaaagaaattacttaagaatgggtgagggatggagacatctctcagctccctatggggtcttctttcctgaacaaactgagcagagccgcaaaagaatacataaggaaggcttggcagaatgttttgatacaaaattcattacaggtttgtttatgtgctgggcagtttgggtcctcttacacgtgtgtagacactgcattccttctggttcaagttttgtgtttagagagaggttttggaaggagatcaaagatgtcagattgctggcctaattcttaaaagaactgatttggggaaaggcttgaaaacattcatacccaggtttgaaaacaagaagtagcaatgagtccagaaagcttggtgacatggataacagtatatttttaagaaaaagagaatttgaatgtcttctgcacaccttatccgtccctaatctccatatcttccatatgtatttttcttgttttataacactgtctaagactcgagtgtaaaatccatcatccatcacccaaccctcacttttgagtgggcagagggtgttgtggaggtgactggaattcattggggtcatatctaagcatgagttaagagatctatctgggactttgtcttctttcatgttttttcttccttctttacagtacaccgtcaatagagattgctggcttgtcatccagtttcctaaatttcctgacttctgccttgtctggcctttattcctgtctatatctctctggcttcaaggtgataaaaatgctcacattttcttaggaaatattcagttgtattctctttgttgtgaaggctcctttgtccactccgtctcctccatttaggggaggttttcagggataattagtgaactcagagggatatgatgtaccttttcaaatcagggtctacttccagtttttcaggtttgttttaaagtgtgtggctcaggcatagagagcagcggttatttggacacctggagttacttggctttgctacccactaccttttaatgtgaagatacctcattgcattgctctgcatatgtgcagaggaaatttggggggaccctgttcacctttggcatatcttgatagttgtatgtgcctgcttgttgttgttgtatattgctacagcaatatggctcatcatctttctacctaagaagatacaggggaaaagaaaacactgccataatcaaaactacagaaatgggtttcataagcattttctctaactactgcgtctacccagatccaataggaatgggagggcattggcatcgttagaaaccggggcaaaagttcctgctgcaatataaaatctatagattacgcttggaatcagtggaaaccattgccctttatgccagctgcttcctgaaggagccaagaaaagtgtatagttcaggggaaatgcaaatataagctccctcctacctatagcaggaaattagaaacctctttggttagcacaaacagattatgatttttttgcaagagagaacaggagagaggaaagatacttgaggtggcattgtataccataaagctatatttatgtgctaagacaagcaattgatgttgttctataaaatatagtaaacacctcctccctgcccttttgaatgtcagtcagaattcagaatcatgaaattttatagtattactggttagaagggcttcccactgggagcagatgccatctctgtcttcatagactcagagaaagtcctgacatgtttcatggcgttcgtacgtggaagtctgtgaaatggaaaggaaaacagctttttctgtcaacctgtcactgatacaagcttttacattccatcagaatgactaaactttaaagctgttttcttcagtgctgagtatctctcagaactcccaagtgttatcagattgatagagtcccagcatatgatagaagaccaaagcattttgtggcatgatattaaaaattcattcaaatactcgataaagcgtggttgacaaaagtgtgaaatggaataaggtagagtgaatttcttcatggtttattgcccttgatttctctccacaaaataaatagacagaatggactaaaatctcttctttatgaaggtgggatcctggcagctgaaggcctgctcataaaaatcctctccgtgccacatacccttgcaatgttcaaagttggaagcaatggaaatttattgctgttatatgtattcatgtttcagactgagtgaataggtaggggatgcttttatgaggttgctgagaccctgtgaagaatagagaaataaaacacacttgtttttcccttgaagcttgtttttttctaggggggattggtgattttagtaattatagtggtattggcaattcatggtggtggtggcggcctggtggcagtcctccccctgaaggtatttaaaagaaaacactcttttcacggtctccccttcctgcctgccatcttgttttgaaagagaagcataaaatagcaaatctttaaagccactgcaagccaagcctgtgttttcatctgtctccctcccttgccaggcctccctctgcctttctgacctgccacccccttccttccttctgtccctccctcctctcagaggacatggggagtgagaggcttccccctgtttccctgcaatggtgggacagaatgcctcattggtttcagatattaacttctgtgctgaaaacccggttggagctggtgtgacaaatggattgtacctgctgctggaaaacacagccctgtcccacccgcctgcacacacaagccctcttccccatcttgcagagcccaacctagggagcagggaacagagagctgccccgcggcaccatctgtttctgccagcatctatgttgggccccgccggttacatctgttgagaagaacagtgtacttgatgagttgttggaaagaaatgtttagtctcccccatcatctctgttagccattacgaggctgctgggctcacgtgggtgtatctatgtgtgcttcctctcaggcctcatctgtatcaattggaaatcagtcactgggagttagttgcagtcagcagggacccaaggcatttcccagtgacatcaattcgtcttctcttgcagaaattcaggaaacaattaaaattctgatgcgttccagggaggatttcaaataaatcagccgatagctgatatcttgtaactcttggtagcaaagcaaaattaacaacccagccgcatctgtgtacagtatgctaaaataaagaaattaaccatgcatcacctccaatagaggaagcagctggcctgttctcaaccttcccataagtacccaaaacctactgatttgttaagttgtcattctccttatggacatcaaggacttcctgcatatgccaaaaactgagctggccaaataatcggtaagttgcggaaaatccaggcaccgattaagctcagttataactcccatgttatgcagaggaaagctgacattttgaggcggacccagttgatagctgctgaggaggtaatacaggatgcaagtaggtttggcagcaggtttagccagaattttgtcagaatttgaagattttggaatcataatcagatagccagtattttctctctcccctcaaaccaaatgcattgtgcaagaacttgtgttaattatccctgttaattacagtgataccacctcagcttttccaggctcttttttgcagctgtctttgtggtgatttcttgtcttaccacttgctgaccaatggaactcaccattcttgctaggttctcttaaaaagcagcataacaagaaccggtcgggagtatgttcccttgaaaaataaaaatctcagcatcacacccaagtaaaagccatgtgccttattgaagttctaagtctatagtgtgtttgtgtacatgcccgtcacataaagtgattgtttattagtttcagtggatttttttcctagaaagatgcataaaattttaaagtaaaaagaatatagtgagccaggtggggtggcccacacctgtaatcccagcactttgggaggctaaggtaggaggattgcttgagcccaggagttcaagaccgacctgggcaacaaaatgagacctcgtctctacagaaaagtcaaaaaatgggccgggcgtgatggctcatgcctgtaatcctagcactttgggaggccaaggcgggcggatcatggggtcaggagatcgagaccatcctggctaacacggtgaaaccccgtctctactaaaaatacaaaaaattagccaggcgtggtggcaggcgcctgtagtcccagctactcgggaggctgagataggagaatggcgtgaacccgggcggcagagcttgcagtgggccgagatcgcgccactgcactccagcctgggcgacagagcgagactccatctcaaaaaaaaaaaaaaaaaagtcagaaaatgagatgggaggatcgcttgagcccagggtgttgaggctacagtgaattgtaatcgcaccactgcactcccacctgggtgacagagcgagaccctgtggaaaaaaaaaaaaaagaatacagtggctggaaaacaaaacatcacttgaaaattttcccaccttttaaattcccagcactgggaaggaaggggtctggtatggtagtgatcgtagggtcagctcaggaaatggttcatagggtgagctcagtgagaatcacattaggatgagaggaaactcttaagcagaaccacagtggggacattcaagagtggtggagaatgaatgccattcctctgcctgtaagagggcacattatgagaaaggtcaaagaagtaaggaatggaggaagatagggaggtctaatcagggcagagagaacaggaaagggtccacttaaccccttaaaaacagcaactgttgtcacccatctagtgcttacagcacctggtgcattctgggtgctcagcatacaatccctgataatcatcacacttttgccgacaaagtacagccataaattacttcccccaccacctccccagtcagcagggagctgcttgctacaaatgagtgaaaatattcaggtactcttacacctagagatcatggagagaagtagttaggagctgtgtactattgagataggaagctcttccacacaccttgctgtgggcttcctttgcacgctgcactggttacatcagacatgctttgtgctctgcagccttcctatttaaacatttgccctcaaaaacttcacgacaagcatatgaattagcagtttttccaacctaaagagaattatctactgtctctagatgattctcaaaatatgctgatagcaatttgaagcattataaatctatccaggttggttctgaccatgttgtagaagtaatttcaactggcacgtcacatgaaggaacagatttgaaaacagtggtatgcatgcccctgaaggtttcatcttggctaatggtctcaccaccttatggcactactttggattgtgacaacggtaccaaagaaaatgtctatagtctggaaaagatttatcactaagtatgactgtctatcactctggatgtacccccttgttataaatctccagcaagactgatcacttggtatacgtaagcatgtaggtacatgcatgtacaagtcaggagtgtgctgtgtacttgtctagtatcacttggtgtattagtatatatatatatatgtgtgtgtgtgtatttatgtatgtataataactcatagcaaatgtgtggacatagatgagaatataggttattagtttggagaaagacttaccagtttgtggacattgtatatacagaaattctcaagatttctcacatgatgtgtgtgcatgtgggcttgtacatgtgtgtaggtgtgcattccgacagtgtcttccatgagcgatgtagggtattattgacttgaggaagcaatcactgcttacatgaggaggcgtgtcatcttgaccagcatttaatgggaggggaaagcctaactccgtaaaaacgcaactgttaaatcttaactgccttagcctttcattctgagctgagacgttatactaaaatttctaaagcagagacattgttatttttcacgtattatgctaataaaaatagtgactggtgtgacttagtgattggagaaaaggggcttaggactgtaaatattggtagactttcctttcggtacacctttataagttatccatttaatcttaaaggaaattcaaatgccaattcaactgggaaatcaaactctgatgcaggcaactcagggacctgttctctgacccacgcacttgaacagtgttcacagtgagaacagttgagtgcatttagaagctagatccacttcaagaagttagcagtaggaagcatttcttttcctgttggctgggatgtagaggggtgttagaactttttccctctacttttgcaagtatgttttagggaactttataattagcttttgtgcatattttaattatttttgcccatcatcaggtgggattaattttgactgagagcaacagtgtagtggttggtttgtctcatgtaaaaggaaggctgggcctaggctgcagctcagtgatgctactaggaactgaagcacttcctattactgctctacctcttccccatgtagaatgcagtcattacttatgttgcctcacagtcataagttgaacttcagatttcatatcttaaatctggaaagtacaaaaggctctgtcttaggagggtttgtcttttatttatttatttatttatttatttatttatttatttatttatttcaaacagagtctctatcgcccaggctggagtgcagcagtgcaatcacggctcactgcacccttgatcttctgggcttgattgagcctcccacatctgcctccagagtagctgaaactataggcatgcaccaccacacccggctaatttttgtatgctttgtagagacgggtttcgccatgtctctcaggctggtctgaaactcaggctcaagtgatccgccctcctcagcctccaaaagtgccaggattacaagcgtgagccactgcgcctggctgggtttacctttttattcaggtaaggacagtctcttctgggatttgtagcaatcattggccagaactatatcaaatagtcatcccctacatatgaaggaactaaggaaataaattattattattattattgttattattattattattattattatgtttgagatggagtttcactcttgtcacccaggctggagtgcagtggtgcgatcttggctcactgcaacctctgcctcccaggttcaagtgattttcctgcctcagcctcccaagtagctgggattataggcacccaccaccatgcctggctaattttttgtatttttagtagaaatggggtttcaccatgttgggcaggctggtctcgaactcctgacctcaggtgatccgcccgccttggcctcccagagtgctgggattacaggcacgagccaccgcacccagccagaaatcaattatttttaattaaacatatcactgccctgaaaaaaaaatgggattctccttaaaaaggaagaagggagacgtgtacctgtaaaagagcactgctggatgatatattcccctggcctctgaaaatgcacagtggtcaggccaaccggctcatttctattgcatgatatgcacaaatcaccattgaacttcaaaaaaatcctaaaagagcaagtctcaagacaggtaaatccacagccacaattactactaaatgagaacttttagtttggaaacaagcacctagagaatgccaaaaagtcaatgttcctgcagatactagaagggcacagcataggtaaacacactttatcaagtactgtgatactgggatgttgaagcttgcctggtcacatttaaaaaaaaaagtgtcattttaatcagaaaagttttaacataacatacagtcaacttataaaattcattacaccaaaaataatatagatactacatataattagagtcagatattttcacagtgttaatggatgattccaatcctcagtcaacagacagttattgggaacctactatgtgctcacagaccataggggaatatagactatctgaacagataactatgacaacatggcaggtactaaactgggatatgaacgaggtggttttgggaaacaggacaaaacagccaacgctgccaaggattgttgatgaaggagtttaaactctttccttttttttttccttttttcttttttttttttttttgagacagtcttgctctgtgagcgatctcagctcactgcacctccacctcgtgggttcaagcaattcttctgccttagcctcccaagtagctggtatcacaggcacccactaccatgcccagctaatttttgtactttcagtggagttgaggtttcaccatggtggccagactggtcttgaactcctgacctcaagtgatccacctgcctcggcctcccaaagtgctgggattacaggtgtgagccaccatgccccgccaaactctttcctttggtgtttatatcctagaagataaatttggccttcaacaaactatcccttgataaccttaccagaatacctgggagcagaccagggtagaagttcttatatagtcttatgttcttatttttagcttccaggaaattcaagtttgggaaagtaaagaatgcctggattgatactaagagaataagtgaactccaggtctcaaaattttgctaagtaaatccttgtcaaggatcttcgtagagcaaggaatctaagatgatttatgcatctgtagaataacaccataatgaagctgttaacctagccaaaagctttggtggacatgacaccttaaaggtggccattataaagtgagagcctctgacagctttttcatggttttagataagtgggtgtttgaaatcattctggcagctcaccaaatgtttctttgcatcttgactactggatgaatcttgactacaagtacagattttatgtatacttattaaaataatataatttggctgggcgcagtggatcacacttgtaatcccagcactttgggaggctgaggtgggtggatcatggggtcaggagttcaagaccagcctgaacaacatggtgaaaccctatctctactagaaatacaaaaattagctggccatgctggcgtgcgcctgtaatcccagctattcgggaggctgaggcgggagaatcgcttgaacccgggggtcagaggtcgcaggagccgagattgcaccactgcactgcagtctgggcgacagagtgagactccatcccaaaaaattaaaaaataataaataataatataatgtatgtcccagccaccccatgccctgtctggcactactgccagcactggggaactgggaggagagctgaggaacagctccccttgtaggctcctttgtcttcattgattgacatatccaaggagtcctgttcccagcagtggttccaatatgagcaaaagcaaatctttgctcatcttcaaatagccttgtgtatttaagtaaccagaatgttccacatttctgaaatgactatctcacctatctagaatataagttattctaggcaggtggcacctgtgtcttattcctctatcctaaaacagaggagggattcagtaaatgattgctgaaggggtctacattagagccaaaggtggtctgagcaatccagcctgttttagggacctgggtgaaaagtcctggggagtcagaagctctgtgaaaacaagtagagggaaacagaaaagacaacaaaggggtgacaatgtttcctactttccatttgacaaagaacctgggtgtattgtagttaatatccctggggggttatcctgagagatgacatagaagcttgttgtttttggtataaacccgcaatgtcttcttatcttcattcccctttctcattcctccttagagttacctaagcacaatttcttttcttgttttgttttgttttgttttgtttttttgagacagggtctcactttgtcacccaggctggagggcagtggcgtgatctcagtttactgcagcctctacctcctgagctcaagcaatcctcctactcagcctcaagtagctgggactacaggtatataccaccatgcccagctaatttttgtgttttttgtagagacgggatttcaccatgttgcccaggctggtcttgaactcctaggctcaagcaatatgcccgcctcggcctcccaaagcgctgggattacaggcatgagccaccatgcctggcctctctttaaacactttttgcttacacactgcttttggaatgaaaagaacaaggagacttcagtcatatcctcctggatttgaatgctaaggagctgcgtaacatttctgaaatcttcccatgtttattaataagagaataattctacctaccttgtagggttaaaggttgagtacgatagcatggaagaatttgcccagcacctagtaggctgtcagcgcctgttacctttcctttccccaatgctccctaaagctaagttcattggcccatcatgtagagtaatgggtccacaggcggtgaattacttgtgatgctcttccaaggactgaatgaggagagacattttaatcaaagcaccagcaaagcttttgtagcgatgaacatacaattagtgaccttctcctatcagggataatcagcagtgggactggcagaattggaatttttttacatgggtgatctgggcacagatactcagtcagctctgtgtcgcttagaactgggaggcaggaggcatttgcaggttggtcacaaactgggtatcagacatattaagcctgcattcatctgacaggcctccagaacgtgatgtcaggagagacgtttagcagtggggagacaattatgagactctcagaggtgagaaagaggattctgctcactgcctagaaagagagaatatggcattggaaagggggtggtaaaatatgttgcctgacacacaccgaaaaggcctgtcagttactgaggtcccatcgccgtctcaggcttagactgcatgagaggatctatttaggggaaaaaatgtatagcttagccccagtggctgctggggtgaatctccagggctcaaagcacgagttacagtttgtctttagtttacttaataagcttcctggactgtctgatttctttacagcctggaacagagggtaacaagtctcccagtgcagtggatccaaagttggtgggcttcagtttgggagcaaagagctcactgtttgggactgggttgatgtcatcattttatgacagcatattaacacagagtaaatagtttattccccagggtactcacccattccctcagaggtgagtgtcaactccttcgagagaggtctgctcacctaacctgccaattctcaaagagccccacctcaggcattctcatagcctttctctggccttcgtaggtctttgtcccattccccgatgataatgccttcatgacaaagatgaaatgaaggttgggggcagcctaggctgtagtcctggtgctgcaccactagccgtagagccttggccaagtcatgcccctctctgattttttcattatgtcaactggaaaatatagtcagactgcctgccctgcttgcctaacagcacagtctgaagcatgagctgatggaatacatgtgtaagcatattgcatagtttgaggaagtattcatgtatacagtggtgatattagacttaagattttcattttttcatgaaattgaaactagaccatctgaagtcattgaaataggaaaaacacatacagtattttaaattagttctactcatgcagacaaaaaaaaagtgtcctggtacatcgttgtttaagatctggtgatctgtagtgtttgtctaccaagtggctaccgtaagtggcctccacttgataagttgtaacaagatcacagcaaccccaacatctctgccactttctctttctctcttctgttttgggtggagagacatctatattgtggctgtctcagagttacggggagagcaagtcaacggtaacagggaaaaacaagccttgtgtgggttggaccagaccatttgtaaggctcttggggcatttgtgtgcacgcacacacagacgttaaccagtccagaaatgagtgtcattctcctcacacagcgccgacagctgagttcttccctgatatttgcagacctctctgaagcttgactttgaaatcctcttttccttgaaccctacgtgtgagagagaagcccttctttgccactcaagagtggttctgtggtaacagtggctctgtggatcttttgtccctggctggctccttcatatgttattgtaaggttttagtttgtgctggcatgcaggtgtgtttttttctcactcagattttctcttagatgctgtaatacaatctataatttttggtacaggagcaagtttttacaaaggaagatatgtgcaatttgtcattttccagcctgatgacatataattaaaccttcaatagtctatgccttcaatagcataactacaacaacccatcacactttggaaataaatttgtttcatattttatattatctggactctctttgtccagtgtgtaacaggcccccaggaaacaggaagtcccccactagtgagcacccctaatgtgaatgactgcacactcagcctattttggtgagaacaggcagcttgctttcggtgggctcttttgaatgggccttgcccaagctcaatgctctctctctcctcttggcttgtggcacctggccacagtagcaggcattgcctgcttgaaaagaggctgtccttggattttcctgcctcttggaacacagagcttaattcagttccctaactccgggaagaagcaatgatcttcagccctatgaacctgtccggcaacccacagcggcccacaaaatatgttctctcgcctacaacctcatcccagctgctaccacagccctgccgacgcagcgcctgctgcggtcacggtccactcccaagggacactgccttatgtcagcaggccctgtcttgattcccaggtgctgggaagacatgattgcagcctcctgcacccctgctcccctcctctgacacacacactctgagcctgcaaggtacagcagcccactaaagctctagttaaaagtaccaagttgctggaatgcccagggaagtgagaatgagcgggtctcacacagggatgatttgaaacaagccttgtggctttttaataatgtgccaaagcggtctcagtggtgggccagcagggcccccagtctatcttctgtgaaaggagaaagcccagcaggccctgccgaatgcagacagcccctccactctgctggaggagacagactccgagatggcaatcaaggcttgatttgccaacacatttccaatgattaaaatgtaattagcacaactgagtgcctcctccccagctaattttaatacatgctgtgacaggcaggcagccggctgtgcctttagcccagcagcagatggaggcagaggcagcgggagaggaaaaccattttgcaatgtgactattcgcatcacaaaaccatcagggcgctcagctcttagaaggcccttgatggcagcacatcaaattggcgctgtcatagctgaccgtggcaatggcagtcatccttcatactgtcccagaagcacagcgaggcaatttccaggcgtaaccctttaagatctagaaggggagagagagacttggagagcacacttgtcgtcttgcagtgacaggcgagagctttgcaatgtgcgctgtgaaacccacgctcttggcagcttgcaaaccgttacttacatgttccttttccaaggcacagtggagtgtggttcagaagctttggaaatagctgtttctccaaatgggagacaggcgtgagctgccttctgtgtgcattatctgaactgggaaggatgagcttttcagcctgagatggtatggcaggttggaggtttcctcttctattccattcatcccatagaagcctttgagcctggggcctctcatcatgaccatctgcttttctcctatcctgaagggcatgtcagacaagctgcaaagtccagaagaccgtttgcctatgctcctgttctctcacctcctggcagaaacactgggccctcaccactgttgtttggcctgccctctccttccaaggcaccacctgaaaaggaggcaagctccttggaggctaaggatcatttggacctccctgggattggggtgcacaggataatcacagggggcacttgtgatctttgggatctgtcacccaggcttggtggctaactttctgtgtgtgtgtgtgtgtgtgtgtgtgtgtgtgtgtgtctgtgtgtgtagacggggtcttaccatgttgccccagctgatcttgaactccagggcttaagggatcctcccacctcggcctctcaaagtgctgggattacaggcatgagccactatgcatggcctggtggctgactgtcatagaacaccaaagctagacaagcctaaataataacagtgacgatgctaagcatgtattgggcatttaccatggctgagaactatgttaaatctcttaaatgcattaattttctcacttcatacccacacaaacctaggggctccatattattattcccattttacggatgaggaagcaaagtcacagtaaggtgcagccactttcccagcttctgctgttaagtggcagaacccaaatccaaatacgtatctttctaacttgtgagtgggacaaaaaagtcatagctgagacatgctgcaccacagagatgcttcaccagtggaagcctctgagcagagaaatccgatctgaaaacaatgggattattctttgccatctaatggcctctgaagatcagcagccatgggaacctccagaactccatcacacgggtgacgtttacatgccgttgtgcatgtgtatctttttctcctctaaccgaaaaataatatgtaatcgttaaagatcaaaaacgacagtaaatgtaaagatgaaaataaaagtgacccaaactctttatcactcagaaataaacagtgtttggtgcatttttttccagtgttttttttttctttctgtgtgtatgcttagcaattttaaagtaatattgtatatataactctatgtatcttgtttccttcattgtagtagtaataataaaagtagcagtttttaatgtattttctccttactgctaccttgagaggtagttactatcacccccgttttattgattaaaaaaagaaattgaacctgtgggagggtatgtgactcacccaaggtcacttcagttaggttggtgaaaagtaattccagtttttgccattacttttgcaccaacctaatatgattttttttaaacttccctatgactgtgatcacttttccatttcagcaaaattctttatgaactttaatttaatgagtgaacacaaccctggcaccttgacctgttccccaatttggtaacatttaggtttatgaagtctgtgtactaggttagtgcagagagttagaaacaccaggattcaaatgcctggatcttcctcttatagatttatgactcttgacaagttgcttcatgtctttaagactccttctttcactgtaaaattggaaaactaaaacctacacactgggggctggggggtggggggagtttgctgtaaggttaaaaacgtgaatatatgaagagtctatcttagcagatttcgtggcccttgctatgtgctgacagtagccatataaataatgtattattgggtcatttcctaattccataatgaaatttttaaacaaattattatagacatttttgttcctttttgagactagttgagctagacagtatggaaaatatgaaggctcttgatgcatgcttctcttcttctgatgcaaattgcaaaattattttccaaatagaaattgacattcctccagaagtatatgagtgtctgcctcacgacagccttgccaacactgcatatcagcatttacatgtttttttctaatttgattgatgaagagaaatatatctctttttaatctgcatttctttgattactagtgaggtggaacatttttttcgtatgtttattagccatttatatttcctcttccgtgaattgacctctttgcttttgaaaggaaggatgagtctccaagggctagctagagaaaagatgctccagtgataattatctcagagccctggggtgaggagttgcaggggagagaattaaaggtctcctggggctatgaggcggctactaagtgagcggctttctacaccagagcgaggctttctacacagtcagcttgaaatcagtatttgttctctacctttgtatttgttctgttaagaaatattttggattttttagtgggactcttcacattctactcaagccagcgcttataattctttcagggcagacaacgagcatgcctgttcagtttgggttttttgctctgaaagtcccattggtttacagtgaagttgctgtaggtcttgcttgagtcttttatgatccctgccatccagccaggagctgtgactgctctgtaaccttcttagatttaaatctgttgcttgtgttctcctcatagtgttacagagcagcagaggccatccatactgatgtcttaatatcattctctccttagatttatagggtaaaataaaccctctgccatagaagtgcttattgattactgaagtacataataaagcctaagaataaagtaagaccaagtaatcggttctgttcctgggggatgacaataaactctggccgaggcagcctctgaaggttgccttttgccttggagctaggaggctcctttttaattggttgtcaaaatagtaagcagtgactgatagaaatcagacaaaaagagtacatactgtatggttccatttatgtaaaatttttaaaaatacctactaatctgtagtgacagaaggcacatcagtgatacggtaagggacctgagagagggatagaagctttggggagggatggacaggttcactgtcttgatcgtggtgatggcttcacaggtgtgtacacatatatgaaaagctatcaaattgtgcatttcaaatacgtgccttttaccaatgtcagttatatctcaataaagccacaaaaaaatagtgaacagtatcccataaagagacaatccatggctcactctgtgctagaaaaattttctcttttcttagaaagctatattttgacaaacattcagggggaattgtgagactacatttcaccttcacctttagctaaataggggttttagaagactgaaagatgccaccggaaattaaaaaagaaaaaggcataagaaggtaggatagccctctttcttcattcctttttctttcctacatctgaaccttaaaggtgccttttaacataattttttagtaaaacaaaaaaaggtatttagaaaatattaattcttttctctcatcccccccaacccttctgctattacatttcccccacccagaaaagagattctacagtgcagagtaaaaactactccaaaatgttggcagtctaaaagtggacaggcattttcaacacaaagagatgtttgttttccttgcattttaactcttaatttttgacacagtagggaactccagcatggctgccatttaaaatgtaacaatgccatgcagctctgattgcctctgtcacaggggtgttgtgactgaaggccaggagacaaagcaaatgaggccagagacagtgcctgctgctgaagtgctggtccatttctccacccgcatttgaatttgtcttttctctggctaactgcttttctgccctgatgaggagtcactcggggagactgaagctggaatttgtacaacctctttcagtccccttgattttaatcagaaatacacaattattcttttcctccaaatagagaaactcaatccccattttaaattcaattattgtaattgcagcattcagaaaaatagcacattcattttctaataagagattgtggataccaaattactgcatatagtatgtcaaaacaggaaacttgagactggcaaaccagtgggtgtttttatcttggcaatttgtattttcttgcagacaatttatagtaatcctacccttccttgtttatgatatagaagactaggttttaaagccatcctaaaataaagactgtttttgttgggtacagtttaattgaaaatctgttatgagtatgaggaattctacaaagggcaaaagtgaaggcagatacccaataaagggaagaaaaaaaaggaatcactttaggatcctatgtgacggtagcctaagatgtctttggatcttcttgaaccattctcattatctcaagccatatttatattcctttagccaagtttctcactatcttgcatttgtaaaaaaacaaaaaaagaaatctggttggtgagaagttgataatgtggccattatgtcttagcaatatgagagcaccattgtccctcttcctgctcaattccagttgctctagttggcttgaagtgaatcaaatgtgaaaagaaatacagtttttttattttgagtttcctgattttcataaaagagtaaccttaagatgtgatttcttcaagtgcatgctgttattttcttaggatttactgtcacctcaaaattatatccatgtcagccaggcatagtggctcatgcctgtaatcccagcactttgggaggctgaggtgggtggatcacctgaggtcaggcgtttgagaccagcctggccaacctggtgaaaccctgtctgtactaaaaacacaaaacattagccaggcatggtggcgcatacctatagtcccacttatgggaagctgaggcaggtgaatcgcttgaacccaggaggcggaagttgcagtgagccaagatcgcgccactgtgctccagcctgggcaacagagtgagactctgtctcaagaaaaaaaaaattatacccatctttttcatagacacattcagacacctaccacactttcagatcttttagtgttcatgccgccaaccactgtctctctcttgatctcttcactcagacactctccatgctaccttccctcaggtattttgctactgtaatttattaattctttcacatatatgtattgagcaccttctaggtaccagcttcaagtggagcaagatatgagcaaactctgagatactgtcaaggaaactagccaacagtgttggaggtgctagaaaccaacagttaaggtacagccagtgaagtcagagccctggaaagcttccatatggaagaaggaacagtcatttccatgtgtcctgaaagggtggtggtctgttggatccttgagtgcctactaagtgccaggtactttagttatattctctcagcaaatccccatttttgcagttacctctgggaatttttatctctgtcaagattactctcctggttgattttggtaaatcagtccttaaatcaatcttgaatataaataatctgtgagtagggctatcaaaactatctcctaattctgactggtcagaatcgctagacaaagtttaaaatatgtagcttcctacttgtaccagtaatcacctagtgtttttaatatccattctatttatctgtgtatttatttttccaacttaactttgaacattttaataatgtcaaagcccatatgcactatgcatagcataacttacaaatttaaactccaaatcttgtacctatgcattttactttagtccctgtgtgcaggttactgactatttgaagaataagtccaagctacttccatcccaaaaaaaaatgttcatcaagaacctaaagaaacacttcaaaatttcagctctaaggtgtctttcctttttggttttttatcagtgaaataaaactattagttacctggaagattcttcttgttgctcacttcgttgagagggaatgatggtttctggttttgtttgtctgggtggttgtttctgttttcgtgtagcatagtattgagtctttaaacacgtcctgagcagaaatccttgcagaatgtgacttcccctctggcaataaaacggtacaaaaattcaacccaacatttaaataattagtaagttaccctgttgttgtgtgtgatataacatatctttcatggaaataactggaaaaatgaaactattggtatgtctttctggctgctttcacatacctgaactgatttaattctcacaaaaatccggtggggtgtgtatcatcgccattcactggttaagaaaggtagactccaagaattaagttcctttccaaacacagcatgattattaagtggagggggtcagaatttgaacctacgtcagcctcagactgaatgagcacttcctgtgagccagggactgtgctcagtccctcttaagggagagctgtcttctgtggagcagaaatacggctatatggctgcattcactgctgcttgtaggcgctgcaatctcttttcggtttcagcttgcctctgtactttgccaagcaatcaatcaggaaaatattttgaagtagtttctttgtatagcctgagagagagagtgagatggtacgttatactggctaagaacatgaactttgaaggacataactgggttcaagtgccatctctgtcactggaagccttacttaccttctcatctctaaaatggaagggtggtagtataatactttcttctagagctgttgtcaggattcttggtgttttttgtttgtttgtttgtttctttgtttgtttgttttggacagggtctctctctgtcacccaggctagagcacaatgacatgatcagagctaactgcagccttgaccttccgggctcaagcaatcctctcacatcagcctcccaggtagctgggaccacaggcatgcatgaccatacctgctaattttaaaattttttgcagggacaggggtctcgctatgttgcccaggctggtcttgaacttctgggctcaagagatcatcccgcctcagtcttccaaagttctgggattaaaggcatgaggcattgcacctggcctcaggattcttttttgatgaatgccagccaacagctggcatttctagaggaaaacatgctctgccgttgttcctgtggaggaaccctgcaagatgtgaaatgcacttcaacaaccaggcttttccaaaatagagagctcagggctgccctgccatcatggacaccccatctctcctttagcttgagatggacattgaccctttggctgggaattgaatcatgttggtgatacttagcatggaaagccgtagctacattcagtgtctcacaaccttagtggtggaaggaagaatggttgcagcagcttcattacctggggaaaaagaacttggaattccaagcactttaagaaagatgcttttactttgagtgttggagaaaatagagcaattacctattgaagacaaagtggatgaaaaaacacctctgttcatgctaccctgatcatgtaatctattcatattcattctgccttcctgaaggtgattcaagccagactggctgttcctgctggctgtgcctttccttccccaggatacacagggcacatggtgatcacctgagattcccagctaaactcagacattttctactccaagaggagattcctcaaagggctatagcacacaggcagcatcagataatgtggaatgagtggaaggagggagggaggaggaatccataaatcatcaaattgttgttgagcatctttgagggtcctcaagaatacactagaccctgtgatgattccagggacaaccagcctgcactttctgaggagttcactgcctgcctggggagcaagacttgtatatgttaaattagcaaagaatttatgcaagacgtatgtgaaatcagtgaagaattctattctatctagactagagccagggagatttccaacacctggctcatgtatgctttttaaaaaaagatattcagtcttactgaagatgaatagatggatggatggatggtttctaacatctattgattgcttcctatgtatcaggcagtgttctagacatttttatgtttattacatatgtacttatacaaattatatgtttattaactcaattaacgttcttagcaacactatgaggtacatactgtcaatagccccatttaatagatgaggaaactgaagcacagagaggttaagttccttgctagaggtttcacagatggtgtacagtacaggcaggctttgcacccaggcagtctggctccatagttatatatgaaggataacgatgtggtcttttcaagagctgttggcatcttggttcacactgaaagctaccaggctttgttatctgttcctctggctttggcttcctgagtcttaagcacccttctcttttctagaacatagaccagcttgaaccaaccctctgtgattccaccccgcctctcccctggctgcaccaggcctctcatttgtagtttctcttactgagcacatttctaaacgaggacggttgctccactttaaggacatacaaatggcttgccctcacctgtcaagcatgatccttgtattttaccaggcccattatgaacgcaatctttctgttgaaaatttgcatacctcctttcttgaaaagtaatgacagcaatttctttccctccgctcactttctgagtgtctcatttaacggcacctgtgaaaccgacaggcacagagatgagaagtgaaagagagcagttgattaaatcatcatcaagtcgggcctcagaaagtcaattctgcttgccgtctgcaatgatatccttttatcttaaagtaatgagctatggcacttttgcatcgggtaatgcgataagttctattagcatgttccatttgcctcacaagcaagggcaagtcattttagctagctcatatcactgcaatcaaagcaattggcttcccaggcagagaagaaagggaaaaggctcagggtgatttctatggatcacaacacagcggaaaaaatagactcttgtattattttaacccataacatacttttcctttttactcatcagcaaatttgggttttattagcttacacaggactccaaaaagaacccagcatcagttgaagcaaacctgggggtgggggctcagaccccacccaaagcaccaagaaactatatatgggaagggaaaatcgccccattacagaggggtcacaaatagaattctgccaaagcacacaggcaaagatgtcttcctgatagtaacactgtggtctcataataaactcttgcttcacaccatcttcaaagtcatttgtaataggtccccaggcaagtacggattaatgctattgatgacttagaatcagtaaatcaatgacagagaagcaaaggatctgttccttaagcttaaaagagatcatttacaaatcaccgggccccagactgtcagttttacctttggacaagatacttatttttctgagtttggcaaccactgaggtttgtggactctgggttttaagtaaatttcatctttggggtttatgtatatttatacttggcaaaatgtgacttcctttcttagaggaaaacaagctgaactccccaaagatttgtgaaatattcacttccaaccccacttccaataactcaacaatactttaatgatctgtggaaatttacaacatacagattgttttatgaaatacacttggatttcaaagtgacaaaaaggaaaaaaaatattagaatttaatttatgagctttaaaacttcaagtttggacaacctgatttctgtcaatatatttgcacttctaatgggtggtagaatgaacctagcacatagtagttacctgaacattgttggttgaatgagtgtgttattatctgagacactggagggggaataagaagtgttcccttagccccctcagatcacattggttatttgagctctggccagttcaaactgagaacttgcaaaaatgtcagattctgagaactccccattcagaaatgctaggttatcagtaccgaattccagaggcttctgagagttgattctcttgtatctcctgaacaattgaagattggtggacctcatattattttcaaatgggctcattagtgattaccaaaagctttattcttgtaaactgttgtttggaacatgaatattttaattaggctttcattttatctgagctattttatttgatcaggcgtagttactgttaagatagaggggaagagtcgacgacattatttcacagtcagtaagaatatggtctcagtaagaacattttcaggtttaaaaatttaaaaatttctagggccccagtagctttaaatttcacttagtccaaaaccaatatgagagcaatgtaaacagtgtgaaattagggctttgtggattgatgaaaaacagacaacatcagagctgccatatgtggcacaaaatggcggcccatttttacatgagcaaaggattgggcagctgggcaggggatggtgaacgtgtttttagtcaccatgctgctatcttacttctttaaataagaaaataagtgtcatgttttctgcaggtggcttcttctgaaattgcttttaggtgagggatgtctttaaggtcttagataaaccgcctgccccaaaggagaatcgatttgttttgtcactggcaaagttaaattatacttgatgttagatattgtagtttacaagttggggttctccctcattttcctctcatttcctttaggcagaaacaagaataaaataactttgttcagcagtggtattcagccctgacatctttggtggcaatgataaatggatttgagatacgaaataactgttccagcaaggtccattgagcagaatagagagcaatgccctcctcaatgtcattgtatgtgatatattcaatgattgccactctgtgcttaagaatgcattccatcacaaggtacctagaattccatcttgttgctacattctgaatgaaacagagagatgtcacagaccttgactgatttcaatttggaccagagtcttaaaacacagataccgagattcccaaatgaaaatgaaaaatatttgcttttgaataaatataataaagtcataatcacatcttttttctgagccttttaatggaagatattttcttctgggccccaactctaggctctgctaacgattttaacctccctcagtatgttcacacatacatctctttgcgttaagcagtcatattagtgtttcttgtactttctctttggaatcacctgccttttaaatcatactttgcttatgctgcatggaatcaaccacagtttgaacaatactcaagaagaatgagattgacttgtcagtataattgagcatctattgtgtcccaaggcctagagatacaaagataagcaaggcactgtccttacctacatggagctcattctctggttggaaagactgttgtggcaaacaacggcagtacagttttgtaagggatggagatagaagcaattaagtctttctggaaaagtattggaagattcaaaaaaggaactgtgttttgaaggtgaatgtcaggcttttaggtagaaacttggaggaatagaattcccagtagagggaattgttaagtgcagatggctggtggcatgactgagcgtgagtgggcgtggttgaagcaaggtatgttaggatagtgccacacaatgcgaggatgccaaccagggccggaccacaagctgtttgcaaccaacctgctgtgagattagtatggggagtcaagagtaagcattgggaaacttttagagtaactcagtagcataattttgtgtttcataaatctaataattttttaaatgtattatatatatttgtttttctttttcatttttcaagaatttgactttttattatattttacaaaagtaattgtcgtaacatattagaaattaaagaaagcaaaacaaaaacaaatggctcttcaccacagaaagcttaagaagcattgtgttgagagagtggttgggatttgggagttgagggggattagaaacagaatgtgaagggtcttcataggccttgtgaagcatctgcatcaaatagaaatttaggaaatccactcttgtcaataaggacttggattagaaaaggaagagagcatagaccttggaaagcagtcattatcctcttgtaatgacaaaataaaaccctgaactaacgcagtagccatggccacagggatggagagttagaaagcagaatcaataacgtggggtgagagaggaagataagtccgctcaaggatggggtcaaggataaggctcttcacttacgcagttgagtgattgcttggtgatgctattaccaagggcaacgtgggagaggggcagtttcaggtgagcaaagatgttgagtccagatttagatggatacttgagtctgagtgttcgctgcacttcaacagggggcacatacccaacggaagcttaataatacttaacatttatcatctgtacatacttggtaccatgcactaagttgtttacatgtattaactcattctcctcttctagccatattttacagagaaatatactaaggcccagagagtttaaataacttttccaaagttacacagctggcaaatgtgggcatagagatttttgagtttcagcatatacatggtagaaaggaccaagggaatctttaaggtctcccttgaaagtcacatagaaacaatagaactccagatgcaactctggggagacagtgacattaaagaatatgcagaaaaggaagggccttgaaaagacagtcgcagacagcaatattggtgaatgggtgcaaagggaaaaattctaaaggatgtgcaattgaaacaatctaaataaccagcactggggaattttttaattagattatgttacaatccacatagcagattgcagtgtcgcctttttttttttttttttttttttttgagacggagtctcgctctgtcgcccaggctggagtgcagtggcgggatctcggctcactgcaagctccgcctcccgggttcgcgccattctcctgcctcagcctcccaagtagctgggactacaggcgcccgccagcacgcccagctaattttttttgtatttttagtagagacggggtttcaccgttttagccgggatggtctcgatctcctgacctcgtgatccgcccgcctcggcctcccaaagtgctggtattacaggcgtgagccaccgcgcccggccgtgtcgccattttttaaagtgatgttacaggataaattttactgattaaactgaaatatttgacgtgttatgtgaaaatcaaagcaggttccaaaatggtaggaattcatttttatttcttaaaatgtatgtttaaaagacgagtgggattatatccttaagactggaaagacttacaaaaatgtattaacagtgtttacctaaggattgtagatttatgggtaatttttaaaatgtatccagtaaatatgttttttttgtttgtttgtttgtttttgagacgaagtctcgctctgttgcccagggtggagtgatctcagctcactacaacctccgtctccctggctcaagcgattctcctgactcagcctcctgagtatctgggattacaggcgcgtgccaccacgcccggctaatttttgcatttttagtagagatggcgtttcaccatgttggtcaggctggtctcaaactcctgacctcatgatccacccgccttcagcctcccaaagtgctgggattacaggcgtgagccccgtcacccggccgtaaatttgtattttcaaaaggagaaagattgggtgggttggtttgttgtttaaggggtaagacttgtctgggaaaggaagactgtgcctccagcagttcacttttaattcatgaaaccaggggaagagacggtgaagatggaagttgagtggtttcagtattgagatggctggaaggactcaggtttaggaactagtccctttctaactgtgcatttgaggcctttggccaggcgtgcacacgtcctctttctctccttttgtgtgtgatggtttgggtcatgtctttgtctgaaggccgggtgaccatgaattcttatctgtgattgctgtaaggcctagttgtttctttttgtctcttttcatttcttgcttttaaaatggaggatatatttttagcttttcacagcgggctctgaaatcttgtcatggagagtacttcgtcacctcaagctggtagttagtgtgcaacctgtttgctaataaaccaaagcaggaccccgatgtcaaaatgcttaaaatggtcaaatccgctgggacgccgtctctgcatctgacatgccttttccatttcccagcctcatgcagaacataaacctgcatcaggaggtggctcaatgtgaactcttataaattggagtgggtatctagggattgaggagcagacacttcttcttttaacctttgaagaccaagaatcacttggccaaaaaaatccacagtgtattgaacttagggtgtgaaagctatacagtgtattaaatgtgaatttgagaccatgaattctacccacactgactctataaaacagcctccctttttcataaagcaggcccataaaccgctgccagtgaagcagaaagactccttaggactgtggctcgctttccgtctggggttgtcaacaaaccccctttatgagtggaatagacctcttgtatgtgtcgagcttctggctttttacagagtgtgttaggagccaggcaaggcaaacgttaggcgctgtttgctgagtgcatttattggctttgcataatttatgagctggaggggttgaccatcattcgtctctgccaggggctggcactcgaggctccagagagtggagctgtaaattggatggtgcgctcctgctgagctcacggcaaagtcctcaggtcagtatgggaatttaataccagaaatggaactgttttctcagcacaccatgtggaccccagtgcagcagagactgttttggcagactccacgactggccttgtcgaggagctgtcactcacccggcatgttgtgtggggagcctgagcatttttaatcggcttggcatccgtgctgcttccataatggataccagtaggtctcagttcttcaccatatgcttaactctggagacaaggtgcttctgggtatatcagtaattacttgatgcagaattaagtggaccttgaaattagaactggactgttggaaagcaggaagcttaacactttgatagaaataaccattcccagggacatactgccgttaggatagggggcacagtggtggttctttcccagctaccccactcctcgtcctccctgcacaccagatccttggggaggtgggcaaatgcgatgccacagccttcagctgtcattgattacctcacaaggagcgctgtgaacatctgggaacatgagcctgcctggcaaaatagtcttctgccttccacacccctcttgaattgagcgttgtcactcttgaaaatgtgcccagatcttaggaacctcacagagggcttaattaaaggcaatggagagatcacacaatcaggacagtattgttcctcatccacctgcggttctaggccttcaaagtcttcatctcatccaatttctttctcaactcatttgacttattacaataaagaaaccactcatcaggtcaaagaatgtaaatgtagacaatctgaggttggaagctgggttggaaatgatgcaccgtacttggttaaatcgctgtcactgaatatctgactaccctgtggcactgaggagccaatgggagaagtagaaaatgttctaatcctccagtctataagactgtgatataagttcctaaatgcttttactacggagtgcttagtctgaaaagaataagtagtccccaggttgtctcataatagcaagaagtccatttagatgggtgttctgttacttcccattaaaagctctctaataggagcttaaacaataaggtaacttagtgttttctgaataaaagtcctgaggcaggctgccctgagatgggttcagtggtccaattctgtcaggcattttttcccttggtcccactctgttgtttttgtactgagtctttttgcctcatttttgcaagatggctgctacgtatctggacatcacgttcttatacactcatgttcaaaggccaaaggcaggtggttccttcttttctttgtttactggggagacaaaattgtttctagagccctcagcagatttcagaatctcattggccaaagatgggccttcaaataagcgattacaatgcccagaggtttacctcttttcccatctttagcctcaagaaaaattgagaaagaaaatacctggcatttttaacctcaaagtgtcaggagaaggtacagactagggagaagggagttgtgaatggctgtggggatctagccagcagtggctgccctacaagcaaatttatttcctgtttctgttcaaagctataccaactcccatgtccaggtggccacactaaaaaaccttggcatcatcctagacacatccctgttacttgcttcccatatccatgtgttatcaaatcctgttggttctaccttcagaattgctgtgccatctgcttctgccttcctaaaccatggcaccaccttgggttagacagtggaatggctgccaaaccactctccctgtgacctgatttttccccactgtgcactctctccacgttcccacagaaagtcatcctcatggaagcagctctgatcatgccacacccctgctagtgtttgtatcccagcttcatgtcttactgctaaacggaaggctcctttagagccaggcctgtatctcaggtgaatttcagtctagtttagcagttccttatcaagggctgttgactgaatgaatagatatatttacctgctgagctttactctaacaaaacacatcccccagtttttcattgaatattgaattaacaaaacacttcattttttttaagttgtgttcttttttcccttgcttatcatgaggatcccaaagactggggttaattattaattatcactctctgcttatcccaaaccaaactcagtggttggaatttgggatctgtttgatatggtctgagtctatggccctaaagcatacttttttgcccatattttttatttactaccctgacctcttgtctttggcatactttttatagggaatgttccttctattctctgggcctctaaaccggaaaaggcagccatcacaagtggtgagccttggccattatgttctgtttccttcaaagttcaaatgagtgactacaacgcccagaggtttacctcttttcctgtagaaaagcaccggtagagatacagccattcacattagctgaagatagaatgtcttcgttaagaaattgattttgctctgaatttcattgaacaatcttgattcaccttaatcctgtggctgactcctagaggggcatcgcctctaccctgccatggtgggagggaagcgctcacttgtgtgattgagcaccttgctggactgacctgaggaagagccacagagtacaggcatcagatgaaatcaacaaaataacttttttgcatctggatagcattttgtttcagatgctgtttactagcacttgaactggagaaactctttctttccaggaagacagcattttttatttcctttacttatcttgcactttttttgtatgggggttgggggaggaggcatcaaaagcaaaaacatactcagttcttgcactaacccttattctcttgtcttcattttcagtgtgacagtgacagtgaccaggaagagaaggtaagaccccccctcccccattgtgggcacagcacataacacactgaacaccagagtcctcccacacacagctgcagggtaggatgccagcttcatgttgacaggaccttttctctttaggaaagatgggcattattcacacagtgacatttcctatgctatgacacgtttaatttgtcagatctacctttttttcatttaaacaagacctttaatattgcatatatgtgacactgagtttttactttatggaagatgactcatagactcaaaaacattttaaaagacaaaattatttattttaataaccatctgatttttaaaaatccatgatgagaacgttaaacttgctagtttgtgtttataatgtcatttctgcatttattttactgacccatatgcttttctgtacctattggccttcttgatagaaatgttaatggtctgtgtctaggaatctcatcatggggtacgggtgggcaagggaggtcagatgggaactgccctcttcccatccgggcggaccgccaggtaggaggacagttcttccagcaggtacatgctctgtttcgaggctcatgggcaccagcctctgtgtatccagatcaacatggatcaagaaaaggaactcagtttctgaggttccagaagattggatcacaactcggtaaagtgagctttctgctgcctgaagcaaagggattatttgtctgtttggtctttctttctagccgttccaatccccaaccaaagttccttccatttttactgctgctttatgttattttgaaaagagttacctgaatatcacggtttctgtattgcttggtatcaaaaggatggactcggcctcccttcccccgtttctggatctgtcctgtgccctgtgctttgactttcacctcctacatgcttgcggattttattcagaatgctgcagttagtatttagtgggatctttccaacaaacccagaatttttctctccttctctgctgccagcctccaagagagatctaaaggctcttgttctgtactgtcgttaatttgaattcagcatatgtagcctgttataaaatgcgagacatcatcatttgagcaggtcaagcatattcagatgaagacaaatggtgcttatttgatttccttaaaatcaggaaatgaaaaaaatgctctctggagaaatcatgttctgcctgacttggatgatagaccaatgcatgtcccccagataagaacaggctctcgccttgaggtttttatctctgaaggacggccaggactgtcagcttgctgacatgtgcattatccatgtcattttaaacaaagtgacctatggaagggtacgctgtgctgtgacatggtaatgggctgttggatgacagtgaaagtacacactggaaagggggctgtggattattcttttgtttaactgacaagtaggagctgcctttctccagcccccaggagccttagctccttggaagtaggactcctggtgtctcaggcagccagtgtgtagtgggtgccagggacatgtgcacagcagtaatggttagtgttcaagacacggtcattggcccccaaacccccgaggccacattcccacatggtgggcatcactggtacccagggagggactggtaccttctggccattccagatctatcagcaatggttgatctcactttctaagtctgtgccacttttccaaaaggataaatcttattcagggtcgtacaaccaagctgacattctttccttaaaaggaaatgtggggccaggcgcagtggctcacgcttgtgatcccagcactttgggaggccgaggtgggtggatcacgaggtcaggagattgagaccatcctggctaacactgtgaaaccccgtctcaactaaaaatacaaaaaattagctgggcattgtggcgggcgcctgtagttccagctactcgggaggctgaggcaggagaatagcttgaacctgggaggcggaggttgcagtgagcagagatcgcaccactgtactccagcctgggtgacagagtgagattccatcaaaaaaaaaaaaaaaaaaaaggaaatgtgaattccaaaaccatcaccagtcttcagcagtggtagaaggtggtaaggatgcccggttttgtgttccttgtaaatgtcttcaccagtggcctcaaccttgacacccaaatcacctagggagctgctacaagttccagtgcctgggcctcatcccaggtcaatgaccttggagcctttggggctgtcttgaaccatgggtcttgatgatcacctaactctggtaatttctaggagtaatctgcctctggttgtcagagggatctgggggccaatactgagagcaccccaccaggtcctttcccatcacctgaattcctgagtagttattgcctgggtttccatctctaagtgcaagaagtaaagtgtcggaataatgggtattgggaaggtagctcccacctaccactctgagcttgagtagatttcagggtaataaagcggatacatagttgtttataggcgagtccaagagtggcaatggcaagaagggaaggggtattaggagtgttcctcagattcatggcgcacctcctgccctgcacccccagccattcttcctttctactgtggtgatcctgcaggtcttaagtgggagccacaccataaccagtgttgacatcatctgcctctgttctgccccatgccatttctccagggggctcccaacaggagccattgagactctaattgccctcgcacctgcttggccctgttgcagttaagactgttaggcttccccttttggactgagattgtctggtgtttatcgccaactttaacaccatcctccaagacttctgctctgtcggagcctgggtccctgtcagcctcctctgtgaagaaacctcttgcctgtgcccccctcgaagccccagagctaaccagggctgctttcatgtgttgcttggaggattcgcattcgaatctgaattgctaatggtggaaaagatgccactcagtgtcctgggataccttcagcaagccccaccagggatgctgttggaggcaaaagtgaaacttgtcagggacccactgggatttctctctggaagacctgccattctcttactccatagggatctgcagaaccggcaggctaaaattagggtactgtgtttcacacagctgactgaattaagataaactctgctttcctctgatatgaagctgtaatttataaaatgatacccttactaattaacgtggaagtgactccgaaaggggctaaaaaagcagagctttccctaaatgcaggagacacacttgtgcacaaaaaggctttgatgagacactgagcaaagtatctcccttatcctcccctcccagccacgtgaatacattgcacattaatgtcagataaccacaaggacgttcatgaagagtagaaattgggctgggtgcggtggctgatgcctgtaatcccaacactttgggaggccaaggcggggagatgacaagatcaggagttggagaccagcctgaccaacatagtgaaaccccgtctctactaaaaatacaaaaaattagccgggcgtggtagcacgtgcctgtagtcgcagctactcgggaggctgaggcaggggaattgcttgaacccgggaggcggaagttgcagtgagccgagatcgcaccattgcactccagcctgggcgacagggcgagactccatctcaaaaaaaaaaaaaaaaaaaaaaagatagaaattgggtggggaattacagaaggctgtgaacactgcatcttagatgtgggattgttcttcactgtagtgagagctaagaaaagaggcagcacttggcacccttaatcacccaaattaagcaattattctgatcccccattcgaaatgaattggtatcatgagaacaaagaggcaacatgcaattgccaaatatttggcctatattttattgtttcctttctttctccagtactggcagcagcccatgatgctaagaaatatcccgtttggttatgaagttaatgtggagattaaaagtcattccctgttctacccacaccctttttcttgtgtatagcatgtgactgagctgattggaaggcatatagcccagtggccaagcacttgggcctcagtgtgatggctgacacatgtttctgactctgtccatttctattttgttgtggacaagccttggctttctcagctgtcaaatgggggtgacaacagctctacatatagtcctgtagcaattaaatgaaagcatttagggccaggcatggtggcttatggcggtaatcccagcacttagggaggccaaggcaggacaaagtgggctcttgtctttgagccctagagtttgagaccagcctgggcaacatagtgaggccctgtctctaaaaaaaaaaaaaaaaaaaaaaatcttaaaacttaaccaggcatggtggcatgtgcctatagtcccagctagtcaggaggctgaggcaggatgattgcttgagcctaggagtttcaagactgcagtgagctaagatcatgccactacactgcactccagcctgagtgacagagtgagaccctgtctctaaaaaaataaaaatatatgaaggcatctggctcagtgcctggtccatagtaactgctcaataaatgttagcttttgttcattttacttgagataaaatgagagaggacgcttgaaaaaagaggaagactagcatcctctttggaaagctggggttcttctagagaacctgctagagggtttccccagaatctgaggctcagcctttatcccaagggcccttctcctggacacaggctgaatggaagtgttaaattttgaagggttctgaaacagtgtctttttaaaccccttatccaaacatcaggccttcctctgagcagaacctggagccaagagcacgtgtactgtcctggagggatcaaatggtgattaagtgaattgtatagctcttgtcccttcagcaactgttcccaaatgccaaacactgtcggttcccagaaacccatcacaggagagatgttctggggtagggccagagcatctgtattttttaaaaagcttcctaggtaattttggtacacaactggttttgagaactactgccttatagtaaatgtcaaagggaaacatgatttttccccgtgtttaatgctcttgaaattttgactgcttaggagaaaaacttgaaagttgtggagatgttgcctgtgtgtgcagacatgtgccacccatgcttatgtctgtagataccgggcataagtatacatgcagtacacacatacacaatctcacagaaatgaatccttctccttttcctatcaatcttttaacatgactcctgattgcagttttttctctctgtgctgttagcagtaggaacaaccacctggagaaggtgtttgtgctcctgggctttgctttggtactgtgtcctgtacccaggacagcctactggcacaatggctaactgcaaatgcagtactaccgatttttcacacctgctttccctctttccacacactttttggtgcattcccttttttgtttagagacagggtctcgctctgttgcccaggctggagtacaatggcataatcttagctcactacagcctcgaactcctggactcaagcagtcctcccacctcagcctcccaagtagctgggactacaggtgtgtaccaccatactcagataacttaaattttattctgtagagatggagtctcactatgttgcccacactggtctcaaactcttggcctcaagtgatcctcctgccttggcctcccaaagcactgatattacaggcatgagcaaccatgcctggtgttcatttttaaattcatgctaaaagttgttgtgtttgatcattttatgttcacttgtgtgggaaggggcttctaagaaaaggagcaaagaaaaccagcaaagtcttatgttcctaactcaacacaaaccacatgcctaacttggctcgtgcaggagtcagaaactgctgagatgtcaaactgaagactgggcatgtggtttgtgcttacagtggaagagtcccatcccttggttggccatgtttcacactcggtaaggtttgtgcaccctcagcaacattccagaagctcagaaggccctcattgttgcttgtggaacccccagccttagttttcaaataggatatattttggtcaggagacagtttggaggtactgtcctattttgtagctagaaaggaatatctccacctttccagatttcatagcagcaaagcagacagccatcacccagggaaagagaatggatccatgttcttgtctttatatccctaatactttgcacagtgcttgatatgaattaggtgctcagtgttttgcaaaatttgcattttctttcctggatactcatctccaaacggaggggataagtgaaccaagttcagaagactcatactcaaacctgattgcacctcatacagtcgcaatgtctacttcctggacccccaaaatgtgtgatctcttcctcaggcttctatatttcatctacagttttctcatacaatatatctaagccatttataagtttcctaacttataaatagacaatttcttatggttcttggctgagtctcaggagatttttaatttatttttgttttttgaaatggagtctcgctctgtcacccaggcagaagtgcagtggcgcagtctcggttcactgaaccctcccactccttgattcaagtgattctcctgcctcagcctcccgagtagctgggattacaggcacccaccatgcctggctaatttttgtatttttagtagagacagggtttcaccatgttggccaggctgatcttgaactcctgacctcaggtgaccggcccatattggcctcccaaagtgttgggatgacagtcatgagccaccgcacctggcctaagagctttttattttggatgcgtgatttccgtgatgcccatctactcaacctcttcttaccccttcaggattttgtctgggttaaaatgacattttattgttcttccaaaatcatcatatttccaattggcttaattacattgcatacatcccaaatacacattgatactatccttggattaaatttctatggtaaattattttaaattcagaatctcattatctttttcatatgataacattttcaggcaaaaccaaaaattacttcacttatactgaacatgtatgtacaataatctgttcattactaccatgtcatgcacctgaaaaagaagttataaatgtacagattttcaattaaatataggtaagtcaacagaataaatacttgttattggaaatatgtcaggcattttcagctaaggttttgtttcttgaaataaacagtgagaagaaagaacaggttctagatgttctattgctcgcaataggtgggtggtggagaagggcactcagaagacccaattcctgatttctcactcaccagctgtatggccttgggcaagttacctaatggtgcctagcattagttttgtcatctggaaaatgaggcagtattcaatgatccaacattgactatccagattttccaaatagctatttacctaggccccaacagcatggcagaacccagagggaaattaatatgtgattgtatcttccctttgccaatgtggaaagaggattatataagaattgtctccattctttcgtctctctcagtcttccaagagagaataaacatataggggacatactcgggtatatgtgtgtgtactctcaagcaactgaaggaaacttacatacagacctgatgtctaaacagggtccttatctgtttgttggttcagtctttcagtcatacatatccactcattttttcacaagtgtctactgatgaactgacatgagaattatagttgcttaactctgatggaactgtcaccatgtacctgtgagtaagtagcagagcagttcatttaatctgtgttcctcaactactgtaagtatttaggaaagcatggggactaggtggagagctagcttacggaatgtgtttcaagaactcacttgtttggtaatgaccattacttgatctataaaaggaattgttccagaaacatcaaggttgagtgcatgattctgtgttcccacagaaaagttcctgctgcttccccttgggtgaatgagccatcgccttgggtgtcatggcttacctgaagggaaagttgtaaagccaaggaggaggctgggggaggtgatggctatcagccccatgaaattgaccatgagccctgagccacctgaataccaggagggtcatgagcagaggcatttgtacaggtgatgtcttgaacaacatgcttcatgttagtggcctctgatagagtgtaacctgggaggctctttggttgtcagagaatttgtcttatactgtattagggttgcagagtgttctgtcttcaatgaagatagaactttttggtcatgtacgtgtgtgtgtgtgtgtgtgtgtgtgtgtgtgagagagagagagagagagaaagagttaatcccccttgacaactcctggatggcaagatagttacagataaatgctcctcagaactgtgccattctagtgtgacaaatataatcaaatatctatattaggatgtgttaataattatctaaactttatactttaagaagtccccagattcaacaaatgaatggacttctgttttcttttttaattaaagttacagctgggaaggtcaaattggttctcttttatacaggttagagattttccctatcagtttccatgaggagcatgttgagaagttctagctgtagacctgcatgacctcttcaggtacccgaagaataacccaaagaaagctggaagcagctttctcccttgttgttctaaaccaggcttgactcatatacttacggagacagccgaatggggtctttgaaataaggaaagaccagtaagccctgtggtgggtggttgtagtactcaaggagcccagtttgggcttcatcttttctttctagtgctcttagtggtttttgaagttcctaatttcctggtctaaaaatatagatgctactaatgtcttcggtcagtgaaaaactaagattagggtcaataatagcaactaaatagtaataataagcaccacttcacatgaaagagaacattgcattattcaaaacacttttaaaaacatcattttataagatctgtttaagtatttattgtagggatctatatattctcacatacaccatcgttgaccatgtgccaaactctctgttagggcttttcaaggctttatcttctcaagcaggtgtcattgttttacaaataagaaaaatgaggcataagtgatggagctgagatataagttgtgtcttaggattccagaatctgggccctcttcccatgccgtgctgcttccccgtacgtcagtgtgagttgggataagcctagcagtgccattcaggagctcatgctgtcatcccctctgtgtctcacctacttgtgctgcaagagacctggatcctgtttatctatccaccctcacccccacccaaacaattgcactaactcctaaaaattcaaacatggcggtttctcaagaaacatggaacgaataaaatttgggtctactaacaacttagattgtacaggctcttctgaagtgggacttttttcttattttagcctggaatgcagttatccaaggtgagaagggaagggctatatacaaggtatatattttaactcttacagatgggtagcaaagtcagcccatgattaattagggatgtaggctacaccagtcggtggacttagcatgaaccatatttggacacagaactcagtcttcctttaagtgtctgtatatgtgtaaacatttaatattttattaaatcatagactccctgaaagcatcccatgcctagcatgtacttgacacatacggccctgtaaatattagtgttatacccagaagttgctttattggttatccaagtctcataaaggagaagggccttgcctctgtcactcagaaagcacaggaagagcagggctggagcagaggaatttcttctgagcttccagtccagagcctcatgaaccccatatggtccctgcagaccattttcttcctacgaccccacacaggagaaggggccatggttccatggtggctcctgcactgcaccctctaaggtagttttgttctgagttataattcgccccctcaagaaccctcttgtccatccccagacactgattctcaccctgacagaggtctgggtccatcagggccacagggccttttcttttttaacagcaaatgctgcgtgggctgttcctgcagcccaaatgatagtaaatacctgaagcagccatgtccatgttaaagattatgtatttgccactaaggggagaatatagtgtttatcggccggagtgcgtgccggctgagctgattacggcacaacactctgtcagccaatgatttgtcctgtcctttatcatctgtgtcactcagcagtgtgctggcgaagggaacggatcacccccttccctttttttgtacccattttgtgtagaaaatttgtatttactttgggagtgtaatttgttcctcatggataatgtgaccctgagcggagctggatcatgggttagttgaagtgatattttccgctaatggtagtcgtacatcattgctgtcagctcgggttaggaggcaagcacattacagctccattttacctctgcaggcatctgggattatttgccataaccgagtatgacatgaccgcactacagagtgcattaaaattttactggcttctcaggcaagttccccagctccagtgtgtgcttcaggcaggcggtctgatggggagtccaagggccctgacttcctgctcagaggtgctgcgggcagtggcctaagcaggggctactctctccttgccctgagaaagaagcagggaaagactctgtggggagccacccaggggatgtttatgtctctatacgtcccggactggcaagtgactagctgccttgtgtacataaccaggtgccgcccacagtggctgctgccatctgctctctctccttgatgacttcagcccccagggtggattaggcaaaaactccttctctaaggagagcccagggtaagtgcaagtctctgccaagccttgggctgatttgtattgttcttgtctgcctacgttcagactgaagaaaggaggcgtaagtcctcattatggcagaacccacgtccagccatgtagctggactgagcctgatagagtctcatcaacccagttagaaatgtttgccaaggtgttttacacattatcttatacagtcctcacaccaacccaatggagtgtaggcgtgattacctccattctacttataaggaaactgaggttcaaaggttctgtaacttacattatacagctaatggtagcagaaatagccttctgacttcaaattctatatggtttctagtgttcagtgctacagagagataaagaagtaactattgtttaaatagtgcttagatgtgctatacatatgttgacttgtttagtcttcagtacaatcctaataggtaggtgctaatattatcccccatttacagaggtgggaactgaatcacagaggtattaccgaacatgcccagtcttgctcctggttaatggcagaggcaggtttcaaacccaggtcagtgtggcagtgctcttagccgctaagctggactctcccacatgccacattccaataagcctgagagctgataggaaaagaccagtgaaaactgtaatacgttggaatacaaggaaatgttcaaagagtattttatcactttctgttgtaactctaacatccaacaaaatatcactcaaagaagatgttttgtgatgagctttaattaattaataagtcccatttgcagttagcacattacttgcatgcaaatgatgcttctaaggtgcttgaaaggtatttattttgataggttaagactaagcagtcactctggcaaatgctttattcttttatattcttattggaaaggctgtaataaacttatgttgaatcatgttctttaaaaggacaatttaaggttgtctcccagtaattagtgggatatggatgagggcccataggctgccatatagaataaaatgactgcagattccatattggtggattccgaatgctggacacttgaatgtactctcgtgcctacagtgtggacatgactttttgttctgacacggaaatacccctttttacctctctagccgcctcatcgctttctattccaagcttgaaatgttacccctcctggacagaatggacaagccattcttaccatcacctgtgtacatgatagggttgtaattcatgaatttattcaataagccagacataaagtgagttgtaccttcagggcagttttttaaatgctgcaacagaagagccatagataagcatggcttttctcactgagaaatttaaaattaagttagcacactaagaattgtcctccctgcccccgctcccctccttgggctcacaagcacacacattgatcttccctgctagattaccataggtccaggggattgaccttagtttctcctctagccttagatccaatcactcaagtagtaaagaataagaacaaaagtattgatccagtcatggaacagtaattatttctctcagatggtcgtttagaatgcagcaataattttaaataatgtattcctcagagacagcatgacaacatatgtggattatttagttggtgcgtttaagtaagttacacttgcaccctcacccctttactggacgtccaatgctgtgcaaggaggcctactttaagaagagtagacattgagaaaaatcagagtttacccaacaaatcaattaccaagcaattgttcattataaaggggcttatccattttctgtagctggacaaaataatggacctccacatgctcacatgcttacagtgcaactccacccttccgtatgaagagacttcatgaagtcattggatccttttgaaactcttaagttgtaacagctttgactgtgtttatgttaatagagttaccttttaaagactctttttgtttcaaataacatacattaaactaacaaataatgaaatgtttaggcttttggaatttaaatgtgttaaaataaccaaaccatcagaagggcagagccaggcaactggatatcagaaacagtgagcagagggctaaatgccctccttgctttgtctctacttatttttgcccgtccacttgaatcttgataatttcggagacttcgtttctccttttggtagaaatcatgacccatccacttttcagttttagctacaggcagagagactgtctctccttttccactgccattgctaagatccaagggagagattctgactggctgagattagctcaggaaaggattgtgggttggtgtaacttaagccaggtgcttacacctggattggtcagttatgggtagagagacgggaccatgttgtccaaatgtgcttctctagaggtgcctctgtacatggtgctggagtcagtagagaacccagaaagttaggagttgggcctgcagcagtgggttctaggaagcaaaacctaatcttcctgccatttggatgaggcactacttacaggcataaattcttgacagccatagaagctgcctgggtcatccaaagttgacactttatagtgatcacaaaatctcaaatatggatacgtatttacaattatgtataataattgcctaaatattcatagagtcattttaagtgctattcacagattagttctatcttgcttaagctattaaaagccatagaaatacacaggattttgtagagtgagagttcatgtgtacatgcacttagaaaagtccagaatttattaatattttaagtacacctatagtagctaatgaattactcccctgccccacccaagtataagacagccaccttgagagacacaaagatctcaaggaatgtcaattagtaaattacatatctagggtacaaaatgaaacttctttgtccaaagggattgtggtcaacctggagaatccaatttgcatgccatgcagtactacttaaacttcagcaggcagccttcctgaagtgatgttcctaagactagaaaatagtaactcactcatagcttctttcactcatgtttcattcaacaaatttaatcctcacttgtatgctaagccaagcactgtcatgggaactagggatgggaagaagacaaagacatagaaaaccttcagggaaatatggcctaattgaagggaaagctgaggtacctagatgaattacaagaccccgtagcgtatgctgtttctgaggaatggcatgatgtctgaatgcaaaaaactgagccatactctgtaagggaggaagcaattgagttagatcttgctgcagcacatggaatagatgttactaggtagcaagaatggggtagatcacaggcaaaggggatatcatttgcaaataacagagttaggaaaggcttagcatgtggagagaagcatgaaaacttctgtttgtttggtcagggtccatggcagtgttggggggaagatgagactgtaaacatatgttggtatacacagttccataaaaacaggccttgcacggcaagatgagagtttggacttgatccagatggaagccactgggtaccttatgtaggtgaatgacacatcagaattgacattttggaggaggattcaggcagtggcatgaaggatggagtgaaagggggtgaaagttgtcataatgggggatttgagaggtgatagagatctcaaccaaactaatgtggaaagaaggagtctgattttagaggcatttctgaagtgatgattttgtgaccactgggaaggggggtcaagggaggaatcgtggatgactcaggtttcaagtcaggctgactgggtcagtattgatgatgccatcaatcacacagcgaaagtggggggatggagaaaataggagctcagggaggggctttcaggaccttcagctggatgaggtcagaagagagtacatattgatgatgcaggagtgatcccaattttagttcagtgtctgggagacaaaactaccttagtagcagagatggagctataggggaatgagtgggaggccagccagaacactgggattttgtctgtgtctacaggaataaatatacgtggtgatgataaccattaaaaacaaaataaatactggggactagtagagagggaaggtagggaggaaggcaagagttgaataactattgggtaccatgctcactacctgggtaatgggatcattagaagcccaaacctcagtatcactcaatatacccatgtaacaaacatacacatgtacccccgaatctaaaataaaaattgaaattattttttaaactacaaaataactgtatattaatcgtagcacttgatatttgtatagcttttttttttactgtacatatctttattttttcatttgtggcaaaatacacataacataaaatttaccatcctaaccatttttaaatgtacatttcagtagtaatggtaagcacactcacatggttgtgcaacctatgtagtttttttatgccacatgtgttaaagtaccatatatagttcatttaaacctcataagaaacaccctggatgaaaggatgttaaatatttattttagaaatgaggaactttgaaacgggatgaactgaaacaaagtcgtaatgctttggtgataatatccccatgccttctagggtcagtattggggttataccacagtatccttagtgatgatattttaacatctaacttccagtggaccaaacagtaactcacttatagcctgagatcctattgctttccttaaggaaactggaatggaatcagccccacagcatgaactgggccacccagcagcagccaggtcgccgctctgagaggtctggttctgaggggctctgtgggagtaagacagcatgaggccatatagctttggatataggaaacgcctagaaaggtagagagatatgataccacacttccagctctagcaacatagtgctgtgtgactgcggccttgggcagtttactaatgcttctaagcttctgcttttgtgtttttttgtttttgttgttgttgttgtttttccttttaaaaatctagatataaaatacctagaattatatggcccataatagtaactactcaggtcaggcactgtgactcacacctgtaatcccagcactttgggaggccaaggtgtagaccaacctgagtaacatggtgaaaccccatctctacaaaaaaaataaaaattagtcagatgtggtggcaagtgcctgtagtcccagctaattgggaggctgagggaggaggattgcgtgagcccgggaggcggaggttgcagtgagctgagattgcaccactgcactccagtctgggcgacagagcaagatcctgtctcaataatactactattaataataataaggattcagtaaattttacatttcagtcccttccaccctgtttcctcctgctggtcccccaccattgaccgacttaccctgcaaaaaaccataacacacattagcaagattcatttattacagccaaatcagcaccccaggatcaggccttttaggaaatgggatccaaaacataagtgtcttaaagaggtagaagatcagagggctttgaaacatggccatgtcatcagtctgaaatttagaaagaagttccctgtggcaagagaatccgcaggaaatcactaagctttggaggcccaggatatacccagtaaagcacaggcggtgggcccccaagggaagatggacagcaaagacagcctttataatctgagtagatttcacccatgtccccctccacctaagctctggttttcctttagaggaggcttttaacttaattcctgttgaatttactaatgttgtgtggtgtgagattttaagtatcttctccagcctcctgggcccctctctcctcccctgtcccttccccacctccctatcctgtcttgaacttccaaccccaagagctcttctttacactgtttgctaaaatggagcctcttgtgtgatgcatacccaggaggtgaagctttcaggggtcctaatgtgtgcttcaggataagggcaccatgggtcccctgcctgccagtgtgcccctcaaagaatgtgggctttggcaacatggcattaattcactgccaatgaaacaatgatgggaattttaatgatagcgttgctgtctaaaagatgacgggggagacttctcagcgtctgtgatccagaaaacacactttctagtaagtatctcttatggtcagaagtgagagtgaaatctctgtcagtccttcctaagcattaccttggcaagcgctacagagcaatgtaacataggatgtgttcagtttaagtaacagaatgcctgatagtggctttgtccgtgtattagtttcctgtggctgttctaatgaattatcacaaacttggcggcttaaaacagtagaaatgtatcttcttggcatgctggatgctagaagttaagcatcagtttcactgggccaaaatcaaggcatcagcagggccacattcctcccagacgctctaaaggagaattgttccttgccttgtccagcttctggttgccaccagcattccttggctctggcagcatcattctcatctctgcctctgtcttcatgtggccttttcctctttcgtgtgtctcatctccgcctgcctctctcctataaggacactcgtggtggcatttagggcctatccagataatccaagaaaatctcacttcgggattcttaattagtcctatctgcaaagatactttttccttgtaaggtaacatttgcgggccttacaaaacacattcaaggcagacaaggagacaggcggtcatgtgtcctgtatgtccccttggctagaagagtccattcctaagtgtgagagagaaaggaaaagcaaagatctggcaaagaggggcaaggatttccatgacccatcatgattgtcccctgtgggttggcgttgtgctgtcttctgttagcaagaaagaggcggaggacatagtttgtgggtggtcgaagaactatgactgccaccaaggatgcgggcttccacacccccagtgtgtcagacaaaaagatctgaatgggggtctctctttttttggggaaggtaacgctgttttttaacgctattaaaaatctagatataaaggccaggtgtggtgtctcacgcctgtaatcccaacactttgggaggccgaggcgggtggatcacctgaggtcaggagttcgagaccagcctggccaacatggtgaaaccccgtctctactaaaaatacaaaaaaattagctggacgtggtggcaggcacctgtaatcccagctactctggaggctcaggcaggagaatcgcttgaacccaggaggcagaggttgcagtaagccgagatcacgccattgcactccaccctgggtaacaagagtgaaacaaaaaactccatctcaaaaacaaaaaataaaaatttatatataaaatacctagaatgatgtggcccgtaatagtaactactcgggccgggcacggtgactcacacctgtaatcccagcactttgcgactgagcgtttccctgctcagtcacactgataaaccaccatcgcctttgagtttctaactctgcctatctctggaatccactgaggaggaaagtgggcttaaggtttggtcttggattctgaaggtgcagacctcatcaccacctgctgctgtgcaaagcacactactggacctctctagaacctcagcaagaattcatacctcccaaggctgtggcaaagatgaaatgcaggcctcgggagtgctttgagctctagaccattccacgagctgctgttcctgttgtcactggacagtagggcccactgctgcttcatagcctaaagccaggtggagggagtccagtacccttgttgattctttgcttccctttcccttgtcagccacacccaccacacagacttccacatacccatgtgttgttgttgtttgtttgtttatgttcgtttgccagttctgacttaggagcaagcctttggtgctgaagttggtactgttctcactcctgaatgtaatgcccataatggatggagaatgtcaggggaattgtgggtaatagtaagattactgtcatattcccaaaccctggggtgggtgggaagaagcccctaaccatgcagctttatttccactgtgcttgtggtggggcctggaccaccttattcctggtggccttcatcttgggtgctacaggtggcaatggcaaggactgaagtggggagagtgaagatgcccgcagcatctgtgcctggccctggctcattcgtctgattggattgttagcaagccaaatatgacctggcctgcagggtacaagaagacatggaatacctggtaggcagctagataggaacgcgggacttcccagcagctgagcgtggagaggtggttccctacctggctacacatcacagtcactcagagtgctgtgctcagagaggcactttggcaataccctggacattccgattcagaagtttcttaggcaggtgtggtggctcatgcctgtagtttcagctacttcaagaggccaaggtgggaggatcacttgaggccaggagttcaaggctgcagtgagctgtgatcatgccactgcacttcagcctgggtgacagagtgagactctgtcgctacaattaaaaaaaagaagtttccaggtgaggtacaggaatctatatttctaaaagcaaccctgggactactgatgcatagcctgcctggcaaatacacagtttttaggagaaaaccatgagctttggggtcagggaaacctgtttttggtaacagctgtgctacttactagccatgtgagctttgtcagtcacctaccggcctctaaacttcagtatcctcagctttaaagctagtgtggtactaatacctgcctcacaggattgctgtgaggatgtaataagatgtttatgcacaggttatatgtatgcacatcatggtgctttaaaaaccctcaacttccccctaacccagcacggaagttcaagggcagactggcccactggctttggctctggtgcccccagccacttcccaccaactccatccatgtaagatttacatagccatggccaaattgttactgcaattaacaatcacacctaaaagcttttacttttacttttactttacttaaagggaactcttaaagagtgtttacttcatatcattagcaaatcattgttaattcttgtgatactcaccgtaataacatctatccaaatgaacatgtttgctcttaatgcgagtgtcatgtgcaatttgggagaaattctgttgtcatttagcattaattaatgcccacttactgtaaagtgttcagagacaccaatatcagcgagatttccagaccacatagacaggacagaagagctgggaaggggccagaagccactagcagggctgcactgtgactgaaggcagtggccctgggcacacttctctgctgagggcaggcaggccagccttctggctggaggatctaggtgtccacccataggtgttcagagcacacaactgggccatcccagcctggctccactcactgtggctggaaggggttctgcctctccatccccagcccttcaatcccacacaaccacctctgatgacctctcctcccagctgcagccaccttggatgttgatttttaacctgatttcacctggctgcacatgtcagctggtgggccctggagtgtgaagtgtgacttgcttgggcccctgcagccttgcctccctgcagcgacttcctgcagtttgactttggggcagcggctgccggagaagcctgaaagttgagctcaggaagtcatcttcatctccacccccaagcaggtgcttgatcaggactgtttattaatgtgttctattttctcaaatgcgtcctccaaaacagagtgtgtgtgagatactactcctgtgcctgggacagtcagtgtgacagtgaacagtgctgctctaggtgtggggacacagccttacgttccctttcttccaggcagctcagtgtagtggaaactacaataactgaccggggctgtgcccaccagctgtgtgagggggcctcagttttcccacctgtaaacggggctcactttacccaccccgtggaatggtttaattaggtgtgatgaagtcctgcatgccacaggtggtgcttagtagccatcgccttattaaaaatgccagtgatcaccgaggatcatgatttccctccccttgtgtccacacctcagacacgtcctctctccttctggaggggtaggaacagaggaacagtgcctctcacctgaggagggaacttctctgaatccaccaggaaacccagtcacaaatcacacagaagcagtgttcattttttctgtccacaaccaatatgactaaagtacggtggaaagacaagtattttttgtcctggtgaggaaaggtgccttgatatgtactttttttctgccttgtggatggactgcattggacagaggtgggggtggtggagggagtggaatttaccatggtggtacaaatgagtcagtctgctcaatagggatgtgtcccatacagagccgcagatgcctggtttaaaagactcaggctgcagttaactatgctaaactcaaattttactgagtggaatttagtctttctctgatgattaaaaggcccttcagaatcttctgagccgttttgttgaacagtgcttttttgttacttcctgggtgtaggaaatggtggggaacagagggttttgctggaacacccactggacttgtgtgtcctcctctcggtttctaagggcccctcaggccacacgcctcccatttccaagagagtgagaggggcctagaaaaggctgaacacaaagccccacaaccgccaaattccctttcaagggtgttacttagtaaacatgagcccttgagcccacattcttccagactgtgtctgcctcaggccacccctccttctagaaggagcagtgggggccctggcaggaggctgccggctcagcctggagtggcccacagcaatgctccaattcacagtgaaatgatttcctctgcctcgtataatttaacctgcccacattgctaaacttctatattacacatttctgtcaggatgtcagaagaaatgataagcctccttgaaacagcaacctctattacatgctaagagcattgcgcctggctccccccagctctggtccttctggtatgtttctgagatttttagcatggtctctcaagtataaagaataccctacttcatgaccccagcctcttgttagctgatagatgaaatcttttctaaagctgactctcttgtctattatgttttcaaaattcaaggttttagattcttggatggctgccaagtggccgggctttcttagtaggtgaattgctcctctctttttttgatccttaaacaggaagtagttgttttttagggtggagggaagcgggaggcatgttccacctcccttctccctttgttgatgtttccaggcaattggtggggaattttttcaggaatttctcctcggggaccatactttaggaataaacccaaacacggaaaagccatttccttgtctggtgggagcttgtgttttctcgctagattgtgtcacccagaatttgttgtggagcttcttgacaattgtgctgtgcacgtgactgcagcatggaccactgagggggaatagcaccaagctgctccatccacacgggagacacttgcgagatctcagggccatggacagtgcagctgcctgtcgctccctgcaacttactcccgacccgggcctcctcagagacagccacaatgcagacagtccacacataggatggctcaggactctcttcattattagctgtggttgtgtggtttccccgggagagagaactaagactgagtttcatttaaacctaaaagtgaggaagaacagatgccatattcctacccttagttgttaatttggattacaaacacccatgcttttcttcaggtcattagtcatgtggcttttttcttctttgtctcactagattctgtgggaacagatttctttctgcatagcatttagtggtgggaaaatgatgtttgctgaccatccttgaaattgaggcacaatgtagttcttgattaggaagactctggaataagcgcccaggagaaatggaaggtgtttggtttccaaaagtggtaccttcaactctttttgtaagctgagtgtgtttctctccaaagttcctagcccattagtgaactgtcatacacttcaaggccagctcaccactccgatagctaagctgtcatacatagtccagggtccgtgtgagccccagctcttttaaaactcctggctggctgtgtccagagaagacattcttatcagttttctcagttacttttgggaaaccatctcagagtgtaacctaagtctaaactcagacaaggcactgtgtgttttacaaaatacacatcccactcacctgggcttaattacctgtaaaactgaagtaatgaaagcagtgcctcaggcttctttgcagctcaaaggggatgggccagggattggaatgtagacctgggagcttcctttgggtgcctcctggatgaactgcactgtaggttcagtgagactccttccgggataagccaaggacaacagagccagactgtggggcagagggtctcatggtcctcatggcaaagccagccccagccctcagtgtgccctcatgactatgagtccagtctttacaacaggaacataacaattctacagaagggtggaggatctaacactgaacaagcaaggccccatggaccaggcccccaatagacgttacttcattcagtcatccccacagccccgggaggtggaggcatcactttccataccgtatagaggagggaactccccaccaactagtgaagtttaaaaccagcattccaagcagggctgcccagctaccctgcctactttgtcctgttgctgcatcttctctctgattcccctgaagtctgtgcgaagtgccacaggaggtcgaaggagggaccagaaaggtgagggtttcccggaagtagtggaagcggaccgtgtcctgagaggtccccagcccgagaaggaggcagccaacctcagcaaggacagcctggtctttttttttttttttttttttttttttttgagatggagtttcgcttgtgtcacccaggctggagtgcaatggcacgatcttggctcactgcaagctccacttcccaggttcaagtgattctccggcctcagcctcctgagtagctgggattacaggcatgtgccaccatgcctggctaatttttatacttttagtagagatggggtttcaccatgttggccaggctggtctcgaactcctgacctcaggtgatccacccgcttcaacctcccaaagtgctgggattacaagcctgagccaccccacccgctgagcctggtcttagagtggggtcagcttcggcttcctattgtgagaatcaggcctctggcacttatcagccctgaggcctggcttaatttacttcgaatgtctctgtctccatttcctggtctgtaaggtatcactggaagtgttctcaaccctttagtatgctttagtgtgagaaagcttgtaaaaatgcctgcatggtgccttgctggtgcccagtcagtcctgcatttctcggctctgcaaaatcacagacacatggaatgggatggtatgccccagaagaactgggggattgggagacctggcaggtgtgagccctgggtttgggaagggcagaaggtaagtggtgacagataagtctaggaaggcatttgggtgtcaggtcataaaggaccttgaaaaaccaacccctgggttagttgaagctttggtttagtttggtttcacggaggaacaggatgatgagatttttctttaggggaagatgacggcagcaataagagtgttggaaaagtcaccctgaacaacttttgtaggtaacttaagggcagaaaaaaggaactctttatttttcaagtggcatcatggctatcacagctcatcagtgcctggaacaacacctttaataatgtcaataggaacgcttcgaactgctgcagaaattctgcttcctgaatgtttgaacttaccctcccatttaatctttaaaccatcccttcaagagagggaggacacaagggtttttctcaattatgtaccactgtgagcttggcttagttaccaaaggctgatgatgggctcagcagtgggatccgagtccctgcgttcccacccaggcttcccaccattttcctcttaggtgcgcatccgctttgaagctgcattctctctgagacatgtggtggtaatgataatgttaatactagtaatgatcatagtaatcgctaacattgagaaagcatttacttattatatgccaggaatacgttgctagttttgaattgttttgtgtaattatcatctcctctttccaactaagaaaactgaacggtaatgagataaattaccctaggacacataacaagggtgtggtaggatagaaccacacccttcccaggtgaggagttgcctgtcatttctcagggtcctccgtggcacctggggacaggtggaggtgggcgtgggttgtcaggacatcaggggcctaactctgactctgcgtcaatcagagaagcttgatttttatctgtttcattggcctttctcaaaagagttgatttgagaaagtgttttttaaatagctttttaaagcggaaaggggccgtgtgcgctggctaatgcctgtaatcccagcatattgggaggctgaggtaggcagatcacctgaggtcaggagtttgagaccagcctggccaacatggtgaaaccccatctctatgagaaatacaaaaattatccaggtgtggtggcatgcgtctgtagtcccagctactcaggaggctgaggcgggagaatcacttgaacctggatggcggaggttgcagtgagccgagattgagtcactgcactccagcctgggtgatagagcaagactccgtgtcgaaaaaacaaaaacaaaataaaaataataaaataaagtggataggggttgattggggtttttcttttttggaaaaaagcaattaaaaagaagatggattgatagatacataatgagctgggtagatggggagacacatgataaagcaagtgtagtacagtgttaataaagtcagtggtgggtatataggtattcactctaaaataccacttttctctatgtttgaaaattttcataataaaatgttggaggagaaactagccaagtaaataatttctaagggcccttccaattttttaaaaaattttatttcctgcacttctctctacatcctatagttgtgatcatgtacaaccatgacgtgatcattaatctagatagatctcctagtcaccactggatgttgccactaaaaaaaaatctaggctgggtgcagtggctcacacctgtaatcccagcactgtgagaggccaaggtgagtggatcatctgaggtcaggagttcgagactaggcagaacaatatggtgaaaccccctctctgctaaaaatataaaaattagccaggtgtggtggcaggtgcctgtagtcacagctactcgggaggctgaggcagggagaattgcttgaacccgggaagcggagattgcagtgacccgagattgcgccactgcactccagcctgggtgacagagcgagactccgtctcaaaaaaaaaaaaaatctgctggggagaacaaagtcaatcatcactcatttggttctccaactacctgagcctaaattttgattggcaagtttggttgggttcagatactttcactagaaagccgtaggcctgtgagtctccagatgaaaggtgggtttagatctacacatctcctgtttcagggcagtgagctgttttggacccatctctagtagaagtttcttggagctctccagccacaataaaggtacagtgttcctgttcactcactttggcagagccttgaaaaggagcacagagacggtcaaatagtaaaatctaaaaacccgtagaaaaccctagcagaaagtattcttaaagacccagctgtatttttctgttcataagacccagataagcatagtcttcccatttgacattctgactttaacatgagagggagtttcatgcccccttggtaggacattggagtacttgttgcagcgtgcaagaagtggactttgtccagcttatatttagaataaccttgccagcacattccagggagttgatcaaggagttttgccaaactgtgataaatcagcacattgagcagcctctgatggctgataagcttgggagtgccagttaattgacaagaaccgcacttgtcaatcttttgaggtcatggaaatggatctcttgtctttctgcccttccccaagtcttcacccgcttgctctttggtagattgagcatggccttgcactgcatggagcacacctcccacctttgttcttgtgtgtttgctgagtaattaatctcattgtgctagtatggaaatagtctattaaaacattccggaggacaccatggagagggaggaaggaggatgaagactggcggagggagtagtttgctctgtttaattggttctttcacctaatggtagtttgtcaattaaggggatacttagagaaagtgaaattaatccatgtgggtcaaatgcagctattaatttttaatcaaaacacaatgttcaacaaatctgtagctgtgcttagtacaaatgtaagcatgccaccagcctcttcccaaaggatgtgggagcaggcacaggaaaggggggcctgttaatctagcaaatgtttgcctcctcccacactccctgtgaccctgaggtaagctccgcagagcttcgttcttgtctcttcaccatctattgcattgcctaacacatggtagatgctcagtgatattgctcttctggaactctttccatccctattatgtgcacagctttggagtacctcaaataggttttaggcataacagctattctctaagagctcctagcctgcttgagaaagcagaggaggcagttatgaatgcatccccaagtcactcagagcaacgtacaatcaagtacaagaatgtgtgataaaccgtggcatttgttgagcacttgctatatgccagatacttttaagcacttcacataaaccaagttttttaatctttgcaacaacacaataaaataagtaccatttttatcatcctattcataaataaggtcactgaggcccagaacatttaggtaacttgcctagggtctcacggctagtacaattagtctgctagagggttgcattcattacctaatattataagacccagagttgtcccaagagagctggcattgatcaggggttaaggtatgagtttattttggaaagtgccagaataagatgctccaggtagttggaatggtaatcagcacggttttgtggaaaaggagtgcatttctggttaactggaatatgaggttggtgaggttgaggtaggtctaggttaatacactttcagggtcttggataccaggatgagaaattttcatgtcggttattctgggatttctttattgtttatgggttgtttcactttggaggagcaagtcccgttcctctatttctgcacttgggcattgtgccctcatcattatctctcttacctcctctgcctccctccatctggcatctttcttctcatttatggcatccttagctcctcctgcttcccatttttagagagagggagagagaagagaaaatcaagaaagtacaccagccggcctacttctactgactttcagaggttgaatgaagcttttctcagccctctgccctcacctcagtttggtcctggaactttgagaggaaaaacaccagaaggacttggcctcaggaagttttcttctgcctccccttactgagcagaaagcaggttggaggaaccacttggctctgtgacatttatagtgacatggtttggagaggtcaggaaggactgtcccagtggtgtctcttcaggctgctcacaactgcctgaaacctctcagtaggagaggtttctcatgatccagtgaaaaatcaggcttcaggtgtacatagtttaggataggctacagggtatgttaaattccttcacattggccagaagctggagaaatgtgaggacaggtaaaatccttggatattttcttctttacttccaaggtagcttacaacctggcctcttgaagtcattgggctgatgataactggtggaaatttgcaggtaattgccaatgacaatgagggagagaattggggaatagaggggccctatgaagaggatcctctgcctcgtattccatgcagtcctatgggctgctgcagtaaacctgggaggtcatcaggattaccacaaagactcgtgattgggtgggtgtccctctgggcagcctagtttccctagacatacaacacgtgttcttctccagcagtgcaaagctgagaaggggcctgagtaatcgttctggtcttgctccaggaggcaaagccacagctgtctgtgtacccccatgcaagtgggcaggaggggttccagcaaggctgcttgctgggggagacagggtggagggaggaacagcgactctggatcatagagcagaggtcagggaagcacagttaggatggaaagtctcgggcagaaggtgggtagaggtggataggcagtgtacatggtgtttcaccatgtcatcttgaccaggaacacggtggagagaacagatatagctgactctgtgtgatcagtgattttaaaatgacactagtgtcagactcttaaccagcaagggaacacatcttgtaaatctgggaaaactaggtagcccaaagggacacccacccaaacaagagtccttcatgttgaagaagaagaagcacttcttgataaacaatgaaacaagctgatatggaagaaattgttatgtcatgggaaggaggacatttttggtacctaatgattaatatgaaataataattatgtagtgattatatccttgcctctcaatctaagaatactcagaacattgtcatagtgaatttcagtatcttctatgtgaaaagcagcttagctagtgatatctgttattcatgcattcattttttctttcctttgccatatatttaccaaaacctaatctctgctaggtagtgaataaggcttttgggatgcggcaacaaacaaaatgggcatgttcactgcccttaaaatgtaaggtgaaatacaacctttatagtgtccactttcctgcgatggttaaggttttcttcgtggacaaatacatgatcaattctatagctattccatgcacatataaagaaaagtgaataatacctgttcacaatctcaaaatacctgttaaataaaatgtatcaattttaaacattagtgtgagacaaaaacattaagtaacagattgtgtgcgtgtgtgcaggcatgtacagttagtcttgaaaagatcaattgggagtcagtggagcatttaaagcagggatagacatgatcagatttgtcatttaaacggtaactttggcagctgtgtggaggacggattgagggaggccagagtgaagatcagcagtgaggagagactgttacccaggtgagagaggatggtgactcagagtaggcaatgtgggggctgagagaagaaaaggagctaaattcttcttggagatcaaataagcaagatttggcaactgatggaagagaatgtaaaacaattatctacttcctaggttggttgtgggaactaaatgagacattattcgcttcattttacaaacaaggaaatagagactccaaagtgattgagataaacgtctgacttccacacagcctttgatctctctactgcacaaggcataaaaagggtgtaaacagaggtagattcacccaggctaatggctgaaagcctcaaggcccttcacttgctgggatctcatccaaggcctcatacctaattttatattcataactttgtattcattttcttaaaaagcaccctccacaagggtttaagcttcagactccaggaaacctctatctacctctggccaagtaagtaacctcattgggtaggactgaaacttgatgggatgagacctaggatcaaaatctgacccagcaggcagagaaagtagtgtgtttaggttgggatcaactgggagagaaacagatgccatattggaggcataacaaaaatataactgttagtgtttattgaatacttcttgtgtcaaacagtgtatttattgactttgattttttgggggaagtttcttgtattatatcacttaattcttatacaacccaacagggtggttgctttcattatccccattttatatgtgaggaaagtaagccctggtaagagtaagtaaattaacaaagtatcacaatactaagcaggtgagcagcactggcatcttacaggcctgactttgatgtttgaggctgtccttaacctccactgctagagggactgtggtccgaagccagcacctctgatagattcttgacatgtgctgggcatttcctctcctagaggttggaggaagcaaggtctaattctgtcctgctcctttccaaaaaggaattgcttggtgaaatgtcagtgggagaaagtaatcaccccaccttcagatacagagttgaggacttatctgacatgtgccggagaagacaagaagattctgaggcttgaggccgaaggagggcatcaagagactccagcagccttattttgttattatgcggttgttattttgactcaacagttggctctggtgaaggggagagatggggcttatatgcaacaacaagtgagggcgatttgagggaaaacatgtgacccagactaggagcattgtgtccacattaactgaagctcacagaaatcctaaggataagtagggttttcagcgtaattttgttttttatgttctgatcaagattaagaaaaggaggctttgtcctttgatggaaggtgtggtgttgatggatgacccagagaaagcagagaggttcacctcctgctctaccttcctgtccagaacatgatctttagaaggaaaggtatagaattttcttggcttaaagggactttagatccaagatcagtaaagagattgccttgaagatttaaatgagctcacgttttcctgacctggacaagttacctccccacatgctgagagatcttgtaaatgaaatcactgacccctccctgccagagatgttggagaaaggtgggacatcaggagagaggctgggagactagaggggggcaaatacattgcgaaatttttaaagagaaaggagtgttctgtagccacaggtcagtgagcatcaggtgctctacaggatcctagacccggtcagcatggagcaggctggtgaagaggaagcaggaatcaaagagtcgggtcactaagactggtcactggagcttagcacctttttttttttaacaagcttactaggcagttaccaaaagtggaaagggcagtcttactccctcttctcaaggtcttcgacaaggtcttttatgaagcctttgtggattcggtgggaaactgtggagtggctgcagcaaattggtgaatttgttgaactgaccaagttgatggtcgctctacagtttcgtcacgggactctgccctatataaaataatcgtcagtagttgggtaataattattctgcaccaaagttgcagaagacagaaagttgtgaggaaaacagatagcttcagatggccaagtcagaatttgaaaaagaaaactcattcatacagtcaacaagtatttgagtgtctgttacatgccagtcatatatccatcacggagcagctacttctgggttgattctcctagtatggatggtaagcaatgaagaaatgtgtgtggtgtctgcatgcaatgtcagatgatggtaaagaatatggaggaaaaatttaaagtcttaggagataagagcaaggtgtgaggggggtgctattatgatacagtgatcaggggcagcttctctaaggaagggcccaaataaagagaagctggtagatacccacaaatctgggggaaaactatacctggtataggcaacagcaagagcaaaggccctgaggctggaacatgtttggcatctctagaaagcctgagtagctggatatcagtgagagcaagcatgagaggtcagagcacagcttgtccttgcaggctatgggggatatcagatgtcctgagggagagggaagccactggaagcttttttgatatataattgataagatccgactcgtggtttgtttttgttttgttttgttttctttttaattgagtcagagtcttgctctgttgccccgcctgcagtgcagaaatgtggtctaggctcactgcaacctccacctcctgggttcaagcgattctcctgcctcagcctcttgagtagctaggaatacaggcacccgccaccacgcccggctaattttttatttttagtagagatggggttttgccaggttggccaggctggtctggaactcctgacctcaggtgatccgcctgccttggcctcccaaagtactgggattacaggcatgagccaccgcgcccagccaggttcatggttttagagactcagtctggagataagcttagcacagtgtgatgggctggctcttcaaggatagcatgacacacatggcttagcaatggtagatgcgagaaaggcctagaaattttagtaaaaattcaccctaatattagcaacagtgttatttgcctgaggaaaaaactaacagtattaaatggtatttggtatttacagtgactggtagggattggtttttaccctccctcccctgcccaatctctgaagtcttttaggataagaaccgattggttaacaaagcttcctggatgaactcagcaccttattcagctggccactgccagccccaaccaacagagaaaggagcatcagtgaaccagttctggtgaaccagttcaccccactgtgaaaactcaaaacccaggagatgtggtagatggaaataaggatgtttaaggtaaagagagcctcatggtcaaggtgaatcactggattcagatgtttggaagtctgctcaatagagagaggagattaaatttggccacagcagttagtactgtgacagatttcttttccatatataaaatatgcttcctagagtcaacgctatctaaacatggactgggcccacgcagcatctggctcatccctggacgtgtatgtaaactgaggctggataagctttgggtgcagttatgtagagacttaagtcagtaaatggacacaatgcagtctgataaaggaaagagggtggaggcggggagacaatcaggaggagaaaagaggcagagaagtagaagcctgtggttgtggagatggtctgtaaccccaccgggagcagcagcatctgaactggttctccccttgctcccctttcttttgccctccagccaaaccagtaacaaagggcattgtctagtagtctgtgtcagcaataaaagccatggggatctgacccgcggcagtgtgtttcagcctgcgaacttcctggatatctttacggggaatcattcccggggaaggaagggcaggctggaaataatataaggagatcaagaaggaagtcgagcaagtgacacctttaaacaggccaagcgagccgggctcttccccctgggacagttagagttatgcagagctgtaattaacccagcagcccactggatatgtctatttcaccgcacaaaggctgttgaaagaaggattcttgaagaaagaggttccaattcaaatggtatttgagtaagtcccttgtcggatatactgtttctagagtttatggctataatcaacaaaacatggccattctttcatgcaggtttctcatgactttctgaataccaatctttagaaagaaaaggggaaaaaaaaggcatccagaattgtctaggggtagaatgggggaaagggaaggagggggaaatatggctcgaatcaaattaaggacttggttttcttttcagaggatgttgaaaacatttaaaaagcaggtgtgtccttctttcataaatgaagactctgagatatgtaagaaaattttcagttgtgtattcaagtccctcaaaatcattttatcaacctccctaatttcaattaattttttaacaaatattttttgtatgcctaccctatattaggcactattataggcgctggggatattaatatctctctcctgccttcctggagctaatagtggggagagatagacaaaaacgtttaagtatgtagactaattggtgtgtgagatgatgtgctatagagagaaaaatagcagggagggaaatacagtggggagggatgcaaggaaggccttgctgagaaggtggcatttaagcgaagatctgaaggaggtgagatgtggatccggtgggtgtatgcgtggtggggtcagcgggtggggagagacagcagtgcaggcagtgtgcacagggattcgtaaggtagcagtgtccatggtagtgtgtgtgaggaatagcaagcaggctgaccgggccagagtggagagggggagagccagagcactgggagatgagggcagagaggtcagttatggctggagtctgcctttgccctcaataaggcacccattcagttactcaagtgggccagcacacagtggtgtgtcctcccacatgctctgagtactggccattcagaatggttcccatcacacttaaaaccgtagagaataaaattacattgtcactgtgctactcttcacccttggatagtcctagagtcctttggcgtagcttttacatagtgtgccacatcccactgtactccctttcctgagaacagactgatggaccgagttacgatttatatgagagaaccccaaatcagaattcctagccatgtctaatttatatatcagcaggcaagttgttttgtttcttgtttgggttttggggcttctgttttggggtggggtttttttttttttcccagtaccgtaacttataatctcagatcatggaagagcattctctaatgagctttctaaagccaagagctctacccagttgctgggtaaaggggggaacatggagaattagaatgtttacattgtaactgatttatgtacactatatttgcatgtaagtgtactaaaatattttttaaaattaccagccattaaaaatgtgtttgctaatggggataagaatgctggatacaatgaggtaagctttgtttaaaaggatttaggagactcacaattcataatcaatatttcaacacactcgtctgcatttttagggcaatagatctgtaagtagaaacaggcgtatttgaagaaaaacattagtttctgagatctggccagctcctgttcttaccactctgtcatctctgattggattagacgtcacagaaagggcctcagatccttgtttcacgttaagtttaaccactccagttgaataccatccttgtggagctcagtggagagaaattaaatttctatcaccagaagtatggcactgaatcaggtatcaagggggctacatcagtaaacttcgttggctacaagatgtatgtccttcctgaggctctgtagctgttaagttggctctttccaatcacagtctgatctttcattttcccgtaatgcagttagacaacctagttattcaggcatagacttctctgtttttcattatccctgaataacatttgatgctgaaatagggaagacgggaaggacgggggaggggagccaagcatttttcacagcttgtgtgaaatgcttaatatttgaacgtctttaaaatatactgtacacatacattccaattttataagactaacataacatgttcaaaagttttatgaatttcagcatgtaaccagagtaaacgttagcctgttttaaataagccataatggcctggcaacaaacctgcatagttagcaaatccctcctctgtttatgggcagccattcctcaccaggtcactacaaaatacaagttttatcagtttctgtggactccgtaagttggtctgtgtactgagttcagcatgaatctggttttaagagcacaaaaccaagggcatcatgatgaggtgatatttcgttttgattttaatgaaatggcatgaatctgacttgcttaagaatatgtccaggcctctcgtatcctgtgggggcaacttggttcctaaatgccttccgtaagcacagggccacacagacgtagcaggcttaccccttcctcactggagtcaagagagtgctttgtgcctagaaaatgtttgtttttttggtggggcttttttttttttttttacttaggttggaagcgccccccagatgatgctttttaaggtaggatctcctcttaacaagtgagagcatcaaacatgctgggtcatgcccagttccatcccatcgtgtgtcctgggtctaaggtattagacacagtcatgcctctcaatggtgaaggttctatgttaccagatcatatatttcatggaaatctgctagctcaccagataaaatcctcccagcttcttcaagcgtggcagaggagagagacttcccatgtgttaaaaatctgctaaactttgcagccccaactcttttgcccgtagactcaccctggcctcagccatccctcaggaatcatctaccgtagaccaaactggcttcaggggatattccaacccctgatgtactctggcatcaaaagctcctttaattacaaataggacaccagagaacaggttggagcatttaaataagactgatctaaaggctgtgggccaaagatttctcacagagggcaacacgtaattaggtaatctgactcacaagatgaagtttactcgctttcattgtggtgccccccagggcagccttccccacctgccctctaggcctgtgtccttgtagcacttaccacttgtaagcccagccttctgggagaccctcagtcaggtccagatgcttccagaggccgactccagactcatccagtttcttctctctttgtcttataacagtcatggtcctcattgctccctaaaacatcctacttagtatttagagctcactatacatctgttcaaagcttggcttttggaagtctttattgtaccagtcttcttacctcctgaaataaggaaaatataagtataactgcccacagaggcatataaaactcctttccatttacctcatttattcgtcttatttaggggaagcgcagttcagggtgggcagtctagtttaagccattgagtctagtttaagccgttgttcaccatcatgattttatagcctttagttttattccctgtcagccatagacatccccagagatgcaagaactcatgcaggaaaacccatttaattaggacccactgtgaaggaccaggaaacagaccctaaagcactttatgacggaagctgttgatcaggaaacaggatgttttcctttccctgggtttaggtctggctcatactcctttggggagatctgggggcctgtctccatctccacggaaacagaacctgtaaccttcccagaatcaggttaccctagagggcagtgacatttatatctgcttttttgtttgttcgttgttctctttcctaagacatgtaagtggcaggttttgaactcctggatctctgcccaggggcctggcatgttgtatatctgccattctgatgtgtggagggcctcctgtctacactctctctgccccatggctagagacagctcattctgagagattctttttttataggaaggcaaagctcacctatccctaacatgcaaaaattttcacttgaggaggcggggaactggtttagtaaagatctttgcgtgaaattgaatccagtccttgccatccttcatgttcaactcaagtcctccttctataatgaagtcttccccagccagaagtgatctttctctttccattacatcagggccttttccacattcccacctttcccccctcatactgttgactagttttatttcccattagtgctttgcaccctagtgctcctaggtccatttaaagacctaaatggctgggatcacatcttctacttggttatttcccccacagcattcgatcacttataaactgtgttaattttccccacagtgcctcacatagagtggtgctcaattacaacttactaagtccatttgaaaagaaatacactgttggtcaagaaatctgtgtgctgagtgcttcaagggacacaggcagtataaatgagacatcctgccctcagggaatgtatagtctgagtggggataagacgaggccacatgaaaagtctactaatagcggccagggaccatggcttcctacaatacaagcactttgggaggccaaggtgagaggatcacttgaggccaggaatttgagaccagcctgggcaacatagtgagaccctgtctctacaaaaaactttcccaggtatggtggtgggtgcctgtagtcccagctactccagaggctcaggtgggaagactgttagagcccaggaggtgaaggctgcagtgagccaagatcacaccactgcaatccagcctgggtgacagagtgagactgtgtctctttgaaagaaaaaaagataaaaaaagcaaccagtaatacaattccatataggatctgggccagaaaaaaataagtactgattgtcatgatcatggtgatacgttagttatcttgggtatatacactgtttttacccatccccataacaactctacaaagtagatggtgctagacattcttagtctcagctctcttgtctttagagtgaggacaaatgattcgtccagtgagtacagagtgctgggattcagacagctctgtgagccctcacgtgaggctcaccctgggttccaatggctcagagcttctcctcttgcttctctctcattacccttgtgccctgcccactcccaacctttcaaatatattaaggaggattaaccatattgttcactgctattaaacaagaccagagacagagtctttccagcagaggtgacaccttggtgtctgaatgagaaaggagttgtccaaagacatctgccccacacagaagaaaattagacatatcacatgcctgctttgttataatggcataaaagtatgtgtatgttttaataagtcatgtactgagtgtactcagactatagcatatccatgtgtattacggtggttaagagctcatctctttagtaacaaacaggggttcaaattctgactttaccacttacaagctctatagccttcagcaagctagttaacttctcaggacctgttttttcattgataaaatgagtggggtaatacctagctcaaaaatttgttgtaatatttaaatatgaatgtaaagcacagtgcctgaggtcactcagtgaactgtgattgtggtgagcatactgttatatcccttcctgagccacagaacttgaatttgtgttcagagctggagactccagaacatctcccaaagggaagcaatttaaagttgaagtagcctctcccttctgtcagtgaggatgccaggtcttttctgagtttcctgtaagtcctctaggatatgttactttggataaagtctcactactttgacctgtggaaagaaattactgtccaagtacacaatttattttgacctcccaacacctttggacaattccaggctggctccaggcttcatcagaacaattatgtcctctctgtggaaaacattcctttcaaatgaatcagtagttactcaccttttcttttcccagccatatttttcagttgccaacagtgggatcagtgaggggtagtggtgtagctaacattagcccaatatagataagctccagattatccgtcatcttgtttgaaaaaaggcaggcctgccaaatttgcctacagttcccagtgagggaaagaaacaacaggttctatgaagaggaaggcacagaactagtcgtggaagtcacttttccagactccctccgttactcaggaggaaacaaacccagagtgtcttcttcaaggttaaactccctagaagctgatggaacctggccagaggctgtgaactttgcacagagggcatcatcagaatcaccctctgctcagtggatcgctgccctcccattactctgctggcacgtacctgatttggttgacatttccataattaatttataacagcaataaccctgagatgagcctatttataggtttgtgcaagctaggtaagaatatagattaaatctcagatcattaacatacttaaaggacttgggagagttttgtgattgtcaaatgatgtgattaaaaggcctccaagcttgatgtgtactgggaatccacaagtttactttccttgccaagctcagaaacaacaaaatagcaaaagataagcttacattccacccattcaccaaagatgttgggtcatccggggaactggaccagggtcatcactgatggtctacagctgctgccccacagatgaggatctgtgagcgtggttctgacccttgatatgccagcaagtgtggcaccaagagtcccatgggaagaattgctgtgactgtccacagcaatagagatgagtgtgagaagcacacctattagttgaaaggatgctattatgacctggactgctgtgcagacccaatcttactttctttcctcctttttatgttctgttgttctggttgttaaccttctgaaaagtaacatggattgcttttctattataaaagtaagacgtgttcaatatcaaaaataaaggtaagtacagagaagaaaataaagatcactcataattccaccacccagaaatacccactgctgaatttcagtgtgcatccttctaatagagtcttcattctgacatcatgctagtagaactgttctctggacacagaggcctcccattcaggtgcttgctttgacagatgtgtttcctactgaggaaagcatcttatactcagggggtgagaatccatccatcaagaagaaggaatgactaagggactccctgccttgcctgcaggaggctcttcaaaaaactaccacccagaagtagttccctctctctcttctttttacatttacccagaccactcaaccctatttatccttttcttacctgtatatgcaaatatgatggcaccaccaacgtcatccacctctttcgttcaagaccataacttcttttaaggctctcatgagtccttcacaccaccctccagcatagagaagggctcttcacccattattcccattactagtgttcaagacttgtttttttttttttgctccagttttttattagcaaactagctacaaaatgctgaaaatcaagttaaagttaatacatataagatcatcataaatgattgcacatgtacacagataattattactttcatttgttttattattttaatctacaaactttgagctctttaaaagtggagattagatgttatgtcgccagacccttaacttcgcacttggcataatataaatacttgattaatatttattgaattaagatgaaaatgaagagaaaatttaattacccagtctactttttttttttctatctcagtagttaagtgcagagaaaaaggaggtcatataaaaatgatgaaaaaatagtaccttagaaccatttttatggtgtatcagtgcattttttgtgctaaggtatcactgttaaccctagtgtggaccctttttaatgactttttaaaatcttgacgatgtccttttcacttctttcctaaatgaacattaatataaagccataaaatgttccttggagggttttatgagttactgtgttgtaaggttggggaaaggacacttggagccatttgttttatggagcttgattctgaagtccagcaccgcccctgacccttcagaggcacgctctgaggcatgaagcctttcttgaggacagtgagcactgccacttctccccgaaatacaccagccacactcctacacttgccacttccccggagtccacagtgtcaacctcaagccctgccctccacgagtagcctagacaccgtggagcagacgttactgatgatgcattgaacagctcttcttccacagtgcagatggattttccgttcaccagcatgaatcgcttttgccatatataatatcatgtagtacctgaaaaaaaaaaatgatgccaaagactagagatttggtcgaggacattggtttttctggctctttttgcctccggaactcttcttcagtttatatcagatgtggaagggaagcctaatctataaaacaaagatgggggtttgagtccccggggtttcccctcaccactgtgctaaccctaaatcagctttcaccacttacttgaaaaacccagggcccagagaaaccaaggtgtgagagtgtgaaaggtaagtgcaggacagatagacgataacgagggtgatataaataataatagcttacatttttttaggtcttcttgtgttccaagcactgtgctaaacacagactgtccccccaaaatatggcaaattgtgatgcctgaggcagagtatggtatggctgtctgggaactcttgaaaaggatattggattgcttgcaggcaagaaacaggccagattatcttggcagatctcgctctcactgtggttcttagcctttattacactgttggaatgggtttctcacaagtgatatcaagggaaaaaactagacggatatgtccagtgtatgtgtacgtgtgtgtgcacatgcacttaggacaactttgagccaggagtgtgagccggattagcacactgagttgtactttattctaacacatgcagctcagtagaagtctcatcttaagggacatatagaatgttgaggtagaaatagctcagaagaaagttgataaagtaataggatacgtgcttttgccaatctacatggccatatccttgcatgcttattttgacagaagagtcacagaacagagcaagttcttaaggctcattcattcccatttccctcttgacattttgagcaaaggactggagggaccaatccataaggggaatgcacctggtcatcttttcctgagcatcttgggatcaggtgctcttgggaataagatgatacgtatacccaagagcacttgatcagtcaggcagtgagtccatcaatccacagccctgttctgtgctggatcccatacctttgtacctgtgtggcaggagacaggaaggatgtgtggtggaaactccaggaacttagtccagctgaggagatgatacagacattggaaaacataatggaccaccaggaaatgataagcttaggaactcagagaacatcatttctaggatgaccagagaaggcttcaaggaagaagagaaatttaagcagtgcctcaaaggttgggtgggatgtgagttactcagctggggcagggagtagtctttgcagggagggaaactgctgaggaaagatacggaggtgagccgtgcacattgttcctgttggaaccacacatgtgtaaaggctctgagatgagtttagtgagagttgaaggctcatgttgaaaaacactgtgagaggcacacccagtacagactgtggcaagtgttgaatgcctggcggagaaacctagagccttttaaatagttctgagcagggaagggaggcaaggaaagcagttaaactggttcagctctcaggacaaatgtaaaatgaagggctcatgcttgtgtgtcagattgcaggtttgcttagaaagcacagtgcagggagaaacccgaaggagcaggattctgtcttctggagccctaaccaagggaggccgaagttggtgctttcattgaacgtccatgttctgacatgaataaatgccacgtcatgagtttgtggtcaactcctgtggtcaacttttaagcaagctttaaaacaacagcaaattgcttctatggaatttctcttacagcatcttgacattctggaaaagccagtgcagcagtcaagggagtaggtcctgtcctgtcatttacccaggcttcctagattcaacacatccctgtgggtcccgtcacacatctcaccctggcccatttaactgagctgggcctactgcagaccttcagatatttaatttgtaaacacttaataaagcactgtcagtaggtcggcttgtcttctctgtcggccacatcaaaatcaatacgtcccctgtgtattctgccatgattgtctgggctggggaatctaataggattaagtgtttggggtcctatctgacgccacagtccacagtcctagttagatgaggttaaagactggcttgccattgtggaggcacgattgcttaggggtctgaaaaatcattaaagcttgtcctcttaaacgttgattgttccctggtgatttattgacaaaacacaaaaaagtgctctatactgcactctaattatatgtatgaggccataagatctcatgggaaattaaataaaatttacagcttgatggttttatgctcctgggagacataccttcttaataagatcttatagctgggaatatttatgaggttaaagtccgtaggcttgagcaaaagacctaacctttccatgggaggtggggatggggtgcgttttgatttctttgaagataaatgatcgtaatgaaattttcaggggtttaggaaaaagtgttcagtaagacacatcaagcatttctccttaaaacctctggaggacaaagctgtaagggcacggggatttactgcgaccatttgtctcacataaggcccccatagtcctactccccacctctggggcacttcgtcctcctcctgtactctctgtggcttcctcgtcttattagcccccatcacactttgaaaaggtggggaggatcctaattaagggcaatgatgtaagaggtcaaggaagggaaaggaatttgagtaaggaaaagggagaaagactgagagaatcaatacatgttaagacagcccccagaggagtcactggacatttagtattttaacgggtcaccttctctttatgttaagggatggctgaggaccaggctcagattccacaaggattatcctgtgctgttctagacaaagaatcagagcatatctgggataagagggatttggggggagggcctctgcaggtgtcatgaagatgaagatgatatttatttgttacctttcttgactctgaatagagtgcttatcccaacgtctccgtgaatcctaaacgaagcttcatgcttgaaagtgggctgtttcaataagagtgaggagcatcgtttatgcagccccattcctgctgctttctctaatagttctgaaatggcaagaaggaggtaggtaggtagatagagagctgtcatatatatatgtgtacacacacacacacataattcctatgtattgaattatatttttatctactcaaaggaggataattgtgtggaactcaaagcggttgggacatgtcatatgtgatctatttttctgtttattttttctattgagttttttatatgaaatctgcatggccccttctttgtgtggggggttggagatggggagggcattgacagaagggttggagatcaagctttagagggacttggaacagatgggcacatcacctctctggggcccctgaatttgagagctctgctcccagccttttcccaccaggggagctcatgactggctgtcttctactgtgtgctccagtttatctccaagggtcaagcaaccccaccttgagagctccctacctaggctcatgtgaaaagcaaaggactatgtgatgaggatgaatggatacagcgtttgacctgctagggtgaggcaagtgaattgagaagttcctgactttcctcattgccaactagtcatgttcctcggcttccctcttccagaataaaccaaaataaaataaaagggactgcaaatgcccatgacttagatgtgttagagtccagcttctgtttcccccatttggtcctgattttcgaagtgaaggggagacaggactgagtggcatggtggtgagcaacccgtgtgcttagcccagcggctctctggtttgtcattgtggtatccctctctggaccacagtttcctcatctggaaaatgaagatctaaggctaggtgattttaaagtccctttcagctctaaaatattattttacagttgtaggatttatggaggagaacggcattccgctctatcccttgctttagccttttgaatgaaagtgagatgtctcatcagctcagatagagccagctcaagcccagtgtctcagataaaaggagaaagaaaaaaaaaacttattaaagatagctaagttcccttgataagcagcaagtgagaaatcctgatttaatttaaatatgatatttctgtcttcattaatttaaagcatgtatatgataatgtatccttttttatttagtggtctgccctgaagggaaagaaaggcttgattgtgaagcagaggggcaaaagcttgggtatattttaataaagatgaatatccctaaaaatgcttgaattattatggaagtaagatttgttgcaagttacaaatcaaagcctgaattgtcacttatctcctaatgatacttctacacagattattaatttcattttagaagcccaatgaatgttatattttatgacattgattaaacatcttgctgccatctaaccatccatccttttcattttcaaaaatccatatcggaatttaacaaaaacagctcataaatttgtattttacagcctagcaaagttgactggttctctactctacttaccctcgggcccattctgaactctgggcttgggccatttccactcttagaagtcagcttttccaaactgacatcatgttttgtggtcagagtagtacttggggatttgtttggaagagcacgtgtggcttctggagctgcaaagccaccaggggagttctgaggtggttggggttagcccctgacgggaactcagggtctcagctttcattctcattcttagacaagctagttacctccctcctcagtatcctagggataattatgccctccccagggggctcccagtgccactgtggggatgaatgagacagtagatgtgaaaggtcttcttgctctttagaggcaagcagtgtggtaatggatttaagagccaataaagaacagtgagattgtaggtttaggatcaaccttaggcattataggaaaggtgtaggatgacttgaaagcagggataaaagccttttgaaaatatctccaccatgttattatttatcaaacgtttgtcaaaagaagtacctctggacatagacagttctcaaaaaagatatacaaacagccaataaacatatgaaaaaatgctcaacatcactaattatcagggaaatgcaaagtaaaaccacaataaaataccaccttactcctgcaagaatggccataattcaaaagtcaaaaaataatagatgttgccgtggttgtggtaaaaagggaacacttctacactgctgatgggaatgtaaactggtacaaccactatggaaaacagtatggagattccttaaagaactaaaagtagaactaccattcaatccagcaatcccactgcttggtatctatccaaaggaaaagaagtcatatgaaaaagacatggcgcacacatatgtttacagtagcacagttcacaattgcaaaaatatggaatcaaactaaatgcccatcaatcaacaagtggataaagaaaatgtggtatatatacaccatggaatactactcagccatgaaacaatggcctttgcagcaccatggatggagctggaggccattattctaagtgaagtaattcaagaatggaaaaccaaatgccgtatgttcttacctataagtgggagctaagctatgaggatgcaaaggcctaagaatgatatattggactttggggactcgggggaaagggagggaggtgagtgagggataaaaggctacatattggatatagtgtacactgctcaggtgacggctgcaccaaaatctcagaaatcaccactaaagtacttatccatgtaactaaaaaccacctgtaccccaaaaaactattgcatttgtaaaaataaatttctgaacccttcaaaaaaaaagtatctctggtttcacgagactcatatgtgtgtttcctcaaaaccactgtgggctcatcctttccctggattggctcccattaggggaccccgtgtgttcctgtcacatttccttctttataattgtgatctttatgattgctgttcatttccatccagcgagggtgctggcacctggatcgccatgcagggtgcagctgtggccagctcttcctccaggaaggagacctgaagagacgtattctgagaagcctgaattcgactctacattgaaaaattaaggactggcaaccaaaggctgtcacttgttgaagaaaaaaaccttaattaaaaaataaataaataataaataaataaataaataaataaataaacctaatgaagctgagggtcaaggggcatcgggataaactgttttgcaagggttgatgacattaggaaaaataactctattaaatcagaagtctgcctctgccaggtaatccttaccaaaagtatgcaagaagcttgagagatcagccctagaaggaaaggtgccaccccagtcctccaagggcacagggcacaggggttagcatgtaagcttgctagtcaggctgctgaggctcacatcttgtctctcgctgtacccttggggaagttatcaaaccttgctgatctttggtttcttcatcagcaatagccctgtcacctagggacattgtgaagattaaatgaagtaatagtagtatatgtcaagtgcttattagtgcagtgtcaggccaaagttagtgcttaataaatgttagttgttgtttggccaggcacggtggctcacgcctgtaatcccaacactttgggggctgaggcgggaggatcacttgaggtcaggagttcgagaccagcctgaccaatatggcaaaagcccgtctctactaaaaaacaaaaaacaaaaacaaaacaaaacaaaaaattagccgggcatggtggcacatgcctgtaatcccagctacttgggaggctgaggtgggaggattgcttgaacctaataggcagaggttgcagtgagccaagatcacgccactgcactcccgcctgtgtgacagagtgagattccatctcaattaaaaaataagtaaaaataaatgttagttattgttgtcacgcgttggctggtagtctgtggtggtggtgctggtggtggtggtggtagtggtggtagtggtccttttggtttcgtttgttttgttgtttttgtattcccccccccccaaaaaaaaagaagaaaaggttgcatatcatcactttaaaagctgaagcagagcttttctaggccccacagggcctttccctgtaggcatggtggtaaactggtgtttagggacagagcatccttgagtgaggttggctgctgaggacagcccctccctatttgggaggcaagggagttggtatgataggagcgttactgggagaggacggtagccgcttagtgtgaagacttctccagcatgttgtgaaatgttcttgagtgacacattttgccctcctttttctgactcatctacctcatccttctcctttcctcccccgcgcccccctcccagccaaccctccatagtgtgctccaacactggcgatgttgcataaagggaaaatatggcgtgtttacagagagaattttcaagaagtgttaatttaatatgctaaagtgttcccttcagcattttacctttcttgttgttttcacaaaacagccaagactaaataatgagcccagggctgtgccctttggtagcgtgatagctcattacccactagcggcctccatctgccctcatggctgcatagggagccattacgattatgatggaaatctcagaagccattaccaagatgcaacagagggcctactgcagacagcctaatggactaatttgtaattgggagagggaaatgagttagcgagctggggccggttttgatgagagtggaagtgcgcatgctaaatgtgataaatgaataggaatgtgtgtttgcacagtgggctctacaagctttccatctctcctggggactggaggcgtgctgacaagccgtgaggagcgaggaggaaaggctcaggggaggcaagcaagattcaaggagagtagctaaggataaatcggtgaggaaaactaatggcagtaaaaatccaaggaaatgactgcatctgccatgaaagtagtaattaggaagcattcggtgtgcatgtctttaaccgttaaaatagggggatgagtagatggaaggctggggcggtggtgggccaagagagaagcccctcgtagagggctccgaagggagagcatcctcagacctggtggtctgggcaaatgctgcctgctcagaacggagccgagtccagaaacaccacgggcaccgcccttcgaggggcttctggaacccagcaatgggaaggcctagcaagctcacaggcagccattgtgcaaggcaaggaggccaggctgcagtgccagacctgcagaacatctgtccttggagggctggagagtcgcttcataagccctcgtgcccggcgctctaagctgaggagtgctgggcaccagtgtggctatggacagatttctgaaagctggcctttccttctgtttgtcatttggctcccagcatttcatctgcccagcctggagagtgcgccaggtgccctcatggaggccggggcttttgtttccactcacactgatggacctggtgaagggtaatccccccagtcggtctgaggccaagtcctgcttggagctgtcctcattttctgtttctttttggcattttctgtttctttttggtgtatcttctcagttctgtcccctaacctccaagccctggtgttctttctcctcagtcagaccttcttagccctgaaagctgcaggccaagccttaatgggcctctttttcccagcaacctgccgtcctcaaccctttctctggatctcacttttcctcatgggccagcctgaattgagcctcaggatcgtcctagctctcaggattcctcctgctcccaaacattctcatctcttttcctgggaggacctttcagccttcctaaatagcctaagggaagacgcgtatcccttcagggaagaaggaagcactggaaccaattaactgaaccccagcccagggctcttagaaccctttcccaaggtgagacagccacgtagctgactctgcctgcagtcccacctctgtcccacgggctcacttttcccatcacattccctagtacacaggaaaagttcccattttcttcaccaagcactagaagaggtttctaattagctccctaatgggatgatgacagtcctgttcagcaaaattttattgtcagcctatttgattgattatgtgagtgattgatcccacctactttgaaaatgaatttgaggaaaccaacaaaaaacacagatacattgagaccccaaagcaactcattctgggagaaggcaatcaataaatacaaaaggcagaaaaacattctcaaaacatagtacaaattaaagaaagttattgaaaaaacacaaatgcggttctgctgtgacaagcagtcatagaaaaggaacaactggatgaatgtcatggattaacaatggaagcatattatttaatcaggggcaactgactttttcccatccagtgtccgctgttaagtatagcattggttatgtcatcaatatccctaaaccaagagcctcatcatacagtcccatcaatgttgtataaaagacctagattttctgtgtaaaggtattgcttagatatccttcagtaaacccccccagaatgtgtcaacctaggacaaagccgtagagagacgacaaaaatcaggttcctgctgtgcccaagttcccactttagtgacgtagagatttatacttgggtaactctaattcagttacacagacagtaacaaagcatttagaaaatgcacaggaggacatcatcaacacatttgacaaatgtttcttgagtacatcctgtgggcaggcactgagctaatcactggagacacagcattaaataagtgggagaacatggcccatatcctcatgaagcttatgatgatcgaattctgacccaaagaaggtatggtgtgaggggagtatttgagctgagctgtgaagctagaagttcattagaaatcaacaacaatgagatacccagcaaaaccccaaatatttagaaattaaacaacatatttctaaaaaatccatgggtcaaagaggaaatcacaagagagattagatactattttaaactaaatgaaaatgaaaatgcaacacatcaaaatctgtggcatgcagccaaagcaattcctcagagaggaatggttgtgttagattacattaatagaggaatgcttgtattagaatagaggaaaggtctaaaataaatcaaaattccaccatgaggaggtaggaaccgaagaacacagataaacccaatgtgagaaggaaggaaataataaagaaaatagcagaaattattgaatagaaaacaacagtagagaaaccaaagccaaaacatggttctttgaaaagattaacaaaattgagaaacctgtagctagaatgaacgagaaacaaataataaaaaaaagaacacaaataccaattcaccaagaatgaagaagatgttatcagtgcagatcttacagacattagaaggatcatcaggacaggagctcgacaagcagaggggaggtaacgagttgctagttctgtgtgggtttgtggggtggagagaaggagttgccatagcaggcaggagctgaaaagatgtgaaccagaattgttggtttctacagtgacccaggacctgtgtacacagcccagttgactgcaccctataccagcagagttcccaccgttgagtggtggtctaatgtgcatgttagaccatagatgccgagactgacaggtcaccaatggaccataatgcttggctttcagggcacctggacttgctcaaaacatcgttgagcattggccagtaagtcaatctgatagatctgggtccacagcccctagaacataggggactttatttctccctgccaacttctggcttctgatcattcagtctcatggatatcaaaactgacctgatgccatcctgaggccatgatatcatcctttccacagtttatatgcttctgaaaatggagctttctttttaaaagattaagtctgaatattcatggcagaagaagcttgccaaagctggctgctcacctccagctcccaagtcagtatcagcctgccatggcttattccagacccagacaacatcaagagagaaggcgggtgtggcatgggccagtttcatccactggtcacaggaccggcacctgtcagccatgaggctgtagacagggtcctaaagtgcaaagaaaaagctgtcaaagcttagttttctccccctgctcagatgtttacctggcaggagtgcctgccgtgtctttgtgtcattgttgctctttgtgcaactggccttccttattctctcattatcacacactctctctctctatctctgtctttcatctgtcctattattcatctgagtgtggactcaaaagaaccagattctgatcctgggcaggctccctttcctttacatatcttaatgtgaccatccataaaatgagggaaatgagagtgccatctcataggctcatggcaagttaaatgacttggtgtgtgtgcgtgtgtgtatacacacacacacacacacatatatacacataatatatatgttatatatacacataatatatatgttatatatacacataatatatatgttatatatatacacacaatatattatatatacacatatatgttatatataatatattatgtgtatatataatgtatatatattgtgtgtgtgtgtgtgtgtgtgtgtgtgtgtgtgtatttttttgagacagagtctcactctgttgtccaggctagagtgcagtggcgcaatctcagctcactgcaacctctgcctcccaggttcaagcgattctcctgcctcagcctcctgagtagctgggattacaggtgcccagcaccatgcccagctaatttttgtatttttagtagagatgcggtttcgccatgttggccagactggtccctacgtcctgacctcaggtaatccgcccgcctcggcctcccagagtgctgggattacaagtgtgagccaccgcacccggccaaatgagttagtatattttaaaagcactcagaccagaacttgacacctaggaagcactagatgttttaccaaatcacaggcctaggtgtggtgttcttcagccttcctggcgcctgtgttcctcaggctgaccacgctggattcctcttctgttggaagctcctccaccccacccctcccagtggagacctgcctgcctcactgcctgcaggcagcctggcccaacagctgcagtataggcacagggggcattgctcaggggtgcaggtgttccctaaccctaagttgagacctgagggtctcattaggtcctccaaacttccaagattgtatacttaatgaattggagggtttcaccttcccccaaatagccattgagcgaatccagccaccactcccgtcaggtcctggctgttcatgttgacactgatgctggcgagaggggagtatcttgaaagggcagaacaattggggtgaggatggggaagaaaagggagaaagagatgccctcaggtggggaatttaatttagtcacatgatagtagcatcaggcacttgtgttttacttttctcagaacattctcacatgcattctcttactgtatccttaccacaagtctgggagctagctgtggccgaagtgggtattttctctagaaacaaaagagctgaagcctaggaaggctgaaggacttgctcaaggtcatgcagctacctagagacaaagcggagaccataagcccagaagtgctgattcccagggctccctgcaggggatcatgtatagagagtcactgtgaactgctgtctgagcaaactacgtgaccccctcttggcaagacgaaaggccttggcttggagcaagatggatggagaacactccgggcccacactatgctgttttgaaactgtgccagagaagaggagtggcctggaagtgcagccccctctgttgggtgtttctgagaaagtgtttttctcctttgctggatttaatgaataaattataataacttttgcgtttttatccacattatgcatgtttatctgcccttcccccgtaaaccccctttcccacttccacgtagtactatatttcttttcatgttttatctttgggaacttgccactgataattatttttttaaaaagctcattcctagtgattgctggtaaagatgcacacctcttcattttctaaaaatgtatatgctcaggaccaaaaattcagggaggcatgtgtgggaaaaggtatatttccacttccaaagagagggtactttttcagaagctcagaaaaggaaaggggaaaatgttatatgagccctggtggtatgtgagctccttgggggaatacatggttgtcttatctgtctccagctctttgaatagatcttgcatgcagtagcatgtgagtacattgatggaatgcatgtaccaaggagcagctggatggctgatgggctggatggctaagtgagtgcatggatagatggatgcccaagcaacaaagtgaaacctcatttggcttgttgtgtcagagagccttcttaattactactctggatttcactgctatattctattctggccaagtcttggaatttctttatgttctaggtgggaaaagattacttctataattcatcaaggaaaatactaacttgctcccccagagagctgggggaaaacacattaatataaatataattgaggagtggaaacaaagtctaggaggagttaaagcataagtatcagcctggatgtgaattctaatataggaattagaattcctatattaaaaattgtattagaaacctttactttcttgtgatttctgttagttcagtaagtaacctttcttggaaggtctactaattcctttcaaaaaagatatttattttatatcttactataatatactaagcactgttattgctagggtgttttgaaggggcaggagatggtatttaaaactgagttgcagttctaggcagttaaataaaatccactgaccagaaaaaaatatgtaaaatgataaggcaggataagtattcactgccaaaaagtcaacaaagaaaatagtaaggatttatgttcagcaatccctgagattaaaatttaaaataaataaatagggatagtacgatttgaaatcggcgtcctctttgaactaggaattcaagactcagaataaaatggtccttttcattgcagagctgatctttgtgaccaacatcttgtctccaccaggaacattttagttgagaagcaggagaagtcattgctaagaagcttggattttcaaagaaacagatatcaaattgagaaatctctactaatctttcccttcagagtctaggcttgggtattttttttttcaaaactacatttattttacagataatcaagactctgacagagttttatgtctttttatcactctttatcttgaaaagcattgttggcctaaggttgaatcagccaaacactcagcctcatgaagagcttgtctggggcccatggcgaggaaaatgccagaatgtaagtgctttagagacgggagccataattgcaatgagaaggggagctgtggctggctctgactgccctgcttcccacattttcttttaacgagtgtccccacgtccccaccgcccctcccccccgacactcagatcccttcagttcccactggctgccattttcccttgctctgcagcctccaactccactccacttaagagaacagactggagactgctggaggccctgaagtgatttattgcttagcaggaacttcactaaacttcccaagttgattttttttagttttgaaaatcaaacaaagttcaaaaagtaaacatcacaggttgacatcccagcccaaagctgaggaaaaatgtctcttgttacattttttggcacataatagaatttatgagcattttcagtgttttgatttttttccccagtcactgttattccttaccctccagagttaggtgtggagagattatgttggcctgtttccatggtgacactgaagaaaagtaattttttaaaggaggtttctactgtgttatttcacatgcatgaaacatcaacatctatgctgtgtggctattacccctaaacataaagacacagaaatggttggagtattttatataaatagacaagtagggtgatattttccttggtctcgtgccgaccctagtaacaaaagtctctcagttacccagggcacctgggagagagtgagggaacagttctgttcagtgttaagcaagctcctctcctgtgaataaccttttctttaaaaaaaaaaaaaaaaaaaaaaaagctcaagttgaaagtccaccccccttctacttaaactagggaccagatgaaaagttccttttggggctcactgttcaaagaaccaggattaatctctgttttcgatgtagcttacttggtcaaccactgcaagtattccccttatctgtccaaggcgttgtctagaatcttcttgccccagtaaacagttgcttacagtctcctagagtgaggttggttagggtaagtatatacctttagcagcagaaatttggtgaaactctttccgccaccctacacatagacacacaccccccgcacatgcacacgtcacatcagcatcaatcacacaccccactcacacacaccacgtacacagtcgcacacacacaccccacacatgcacacgtcacatcagcatcgatcacacaccccactcacacacaccacgtacacagtcacacacacacacaccccacacatgcacacgtcacatcagcatcgatcacacaccccactcacacacaccacgtacacagtcacacacacacacaccccacacatgcacacgtcacatcagcatcgatcacacaccccactcacaccacgtacacaaacacacacacgccccacacatgcacatgtcacatcagcgtcgatcacacatcccactcacacacaccacgtacacagtcacacacacacaccccacacatgcacacgtcacatcagcatcgatcacacacaccactcataccacatacacagtcacacacacacaccccccccacacacatgcacacgtcacatcagcatctatcacacaccccactcacagacaccacatacacagtcagacacacaccccacacatgcacacgtcacatcagcatcgatcacacaccccactcacacacaccacgtacacagtcacacacacacacaccccacacatgcacacgtcacatcagcatcgatcacacacaccacgtacacagtcacacacacacacacaccccacacatgcacacgtcacatcagcgtcgatcacacaccccactcacacacaccacgtacacagtcacacacacgcacaccccacacatgcacatgtcacatcagcgtcgatcacacaccccactcacacacaccacgtacacagtcacacacacaccccacacatgcacatgtcacatcagcatcgatcacacacaccacgtacacagtcacacacacacacaccccacacacatgcacacgtcacatcagcgtcgatcacacaccccactcacacacaccacgtacacagtcagacacacacacacaccccacacatgcacacgtcacatcagcatcaatcacacaccccactcacaccacgtacacaggcacacacacacaccccacacatgcacacgtcacatcagcatcgatcacacaccccactcacaccacgtacacagtcacacacgcacacaccccacacatgcacacgtcacatcagcgtcgatcacacaccccactcacaccacgtacacagtcagacacacacacacaccccacacatgcacacgtcacatcagcatcgatcacacactccacgtacacagtcacacacacacacaccccacacacatgcacacgtcacatcagcgtcgatcacacacccctcacacacaccacgtacacagtcacacacacgcacaccccacacatgcacacgtcacatcagcgtcgatcacacatcccactcacacacaccacgtacacagtcagacacacacacacaccccacacatgcacacatcacatcagcgtcgatcacacatcccactcacacacaccacgtacacagtcagacacacacacacaccccacacatgcacacgtcacatcagcatcaatcacacaccccactcacacacaccacgtacacaggcacacacacacacctcacacacatgcacatgtcacatcagcgtcgatcacacaccccactcacacacaccacgtacacagtcacacacacacacaccccccacacacatgcacacgtcacatcagcgtcgatcacacaccccactcacacacatcacgtacacagtcgcacagacacacaatcacttcttgaggcttcagacaggttgctttatctagggcaagtcaaagtttggaaacagaagaggtcatgatggattgttgtgctgtttcccttacgtgtaaccatggttagactttcttgttatgtaactgagaatacttggtttttggaaaataaaatggagagcactgctttatcttggagaataatatcctcatgcatgtggagaatgcctttaacttttccaaggttcttcctacatgttatttgaatttcctaataattctgaaaggtagattttcttggcattccccttattttaaagctgcagggacagaagtttgcgttacctgttcattaggggcatagctgagtcagggattctggaccctcggttttcgctgaggtcctgtgttattaatcctatacttggcatcttccacacagccagtctgagaaagcacagggcctgcagcttcctgggacagggtctcagacacgcagagaccatcaggaggagttcactctgctattaacaaatgtttactgagcacctgctacacatcagacactactccagccgcaatagtccaaacagtcaagaatccctacattctatgagtacaagggaatggtgagtgaatgagtaaaacacataatgcatgtgtcagatggtgattagtgccaaggagagaaagaaagcaggaagaggggtagacagaatgctgggagtgaaaagaagtgggaagaggtgttattgaggggtgacattggaacaaagatttgaaggtgctaagggagcaagttttgaggatgtctggggaagagaagtccaggccaacagaaagatcaaggagtgtggaaaccggcatgcgttgccttcctgaaatccacagagccgcatactcattgcatgtgtgtgtgtatttgaaaacttcttaaattctgaggttggtacatggctttaatttttgccttaatggcttcctgcacttggggagctctttaataggtgcattctggtagtagtaatcatcagtcctgggctggtatcacattacctatgtggaaaaaagcagaattgctttggcactgattgggtcttggggtggtgactatgttttcctggtttttaatgcagatcattgaaaacatgtcagggcctggtctcaagtgtttctcttaaatgggatagaatcatgttcttataagcagagggtgtaggaagggactaggtggggggttggtgggcagaagggttcttatattttaaatgccagtcagctgcaaccactagttaactggagcctgttcaaactcatttggagaacagttgaatttttaaagtgccttttgattctctctttcatttattttaactgatctgctgggattaggagcttggtaggggaacaccagaatgcttgccaaaatgtgtgaataattagagctgcgatgatgtgtgccagatagaaggggagtattcacacttctgattagattcagctaaatgcagttgtaaatcactgctgccacagtaacagcgccctgtcaggactgagcacaagaggaggctcagggcagtgaagagacgcagggcagccccaaggcatggggctggaccgaacctttgtggaagaggagggcaaggagaatggctccagtcaccagcagcccctgggacattggttttggcatctctctttcagctcacttctaccgtgttgagtcttgctgggcactgaggtggccaccatctcagcaaatgcgagtaagacgggtccctgctctcgggatgcttacagtctcacggaaggtgaatgcacaactgtggttcagtgtgatgcatgtgtccgcaggacagacattgtgctaaagggtcccagaggaggaattgggcctgctgaagggaaaggagaagggataggtggaaaggcagttatttccttcagagataaaagttgacatttcagagtgctcagcaagataagttagtggctggaggagttccaggcagagggaacagcacatgcaaaggcacagacaggcaaagccccacccagtctaagagtgcagtcctccaggatggccggggaactgggaacaacatggaagaggctggcggtgcaacttggaaacactgcaaataggttgggtcagaatgtgaagggtctcaagtgctcataggaggaagctcttcttccaattacgtaccactcccaagatcccagctaccccttggagagggtgggtttcccacctcagccagagaaccctgccttagccacagtcatcgatgggaatgtgttagtattctttggacaggagaaataaatgttgagaaccattgctctcaccagtggagagtcttaggaggttaagaaggtgaagaggaactataagatggttaagttaaaaagaaaactggcagaagctttggtgtagaattgttagtttacagcaaggtaagtctgcaggctcccagatgtagataggaggttacagtcaaggtctgaccaaatgatagaatccatttcaagagagatttcagagtggaatccagtcagacttgttgaggaagactccagctgtgtgctgggtttcttgctcctttctgaaccatccttgcctgatcctgacttttctgtacgtgtggagtgccatagctcaagacacgatgtccttcggaaaatagacagtgagtgtatatgttttacagtattgcccaagaggtggaatcctgtcatttcctaatcacaactacacgtttcctccctctccagcactgctctgctccctttacctaaggttgctaaaggtactggtggtcttcaaaaaaaaaaaaaaacaaaacaaaaagcaaatacccacctcttactcaggacaccccagtcagtggatgccttctctggcccctctcccgtcctgttcttggaaaagcagcctactttctctgtcctgatcatgcaacaagttgctctgaaatgaaccagcagcttgtggtgggaataaaagcccaggaaaaggaatgcagaaggaaagtgatggaacggcatgaaacccaaagcaattgataaaaatgagcaccacatggagaatgtggaaaggagaggcaagcataaaaatcacaaccacatctgacatctctagaaatggagagagacaaatgaaatctcacatgtggctttcctcaagtcagaaagattccgcttctccattcaggggcgggatgaaggagcctctttggaagccgtgggcctttctcaagttgttctaccacgcctttcatttctcccgcttcagccagtaagttcaagtgcttagagaaatgcttagcctctagcaccttctccaggcacaaaataatgggttgaccaaattgataattttttttttttttgagatggagtccctctttgttgctcaggctggagtgcagcagcatgatctcggctcactgcaacttcagcctcccaggttcaagcgattctcccgcctcagcctcctcgagtagctgggatttcaggcatccgccaccacgcccagttgatttttgtatttttagtagagatggggtttcaccatgttggccaggctggtctcgaactcctgacctcaggtgatccgcccgcctcagtctcccaaagtgctggaattacaggcatgagccactgtgcctggcccgaattgatacctcccaaagtatgcatgaaggacaataatttgagatatgaggaaaaaatctaaaatgactttttctacttatttttatctcacctattcagatttatttcgtgaatgtgtattttagaaatacattagtatactggtatatcattaagcatatcaataagtaaaaatatctcgggcaagttaaatgagttatttgtctgtttttactctggggggcacatgatcagaatgtgtgaggactgggagagtagttagcagtgtcactagctgaatgtggggccaggaagaatgctctagaactgtgagtccttgtggaaacaggggcattaactggatcggctgcctccttctagcctatgagatagcctgttagcttcccttgtagctcaaagagcccctggaaatcagtagtcagaacccagagaaagggaagttctacccgtaaaagagatgcccatgttttcttagctgatagtcactttgcagagccacacccacaggtgacaaaagcacagtggaacttaccctcaggccctttcaccatcacaggcctctcttctttcctggttttgtcgttgggtaggggtggtggtgttgcctcccggaaccctcatccaggctacatgagacatgcagacatgctccagtgtcatgaacctccccctcaacagctccttcccccctttctccacaacacaaacaaaaccatcaaactccatatgattgttataatctaactgtggagtcaggaatactgtgctgccctacgtgatgctcttttcatttttgcagccatctagctttcttttccccctaccccagcaacccacaaacttaaactccaacctagttcaacctcagaaatcccattaatgtcttagaggcaggtggcctgaggagcccttcacttctgctgtcagctgtgtctccatggctcaggaacttaccctcccacccagccaggctgctttccctgtcaatagcattctcattccctccatgtctgttagaacttgaccattagtcaagctgttcctgagatgtgtctcttgtagagatgtacactggttagaaatggaagcacctccgtgactttcctctccctgtcatggtgacagcagtgtgacaggtttgacagttccagtttctaggacctccagctgcaagtgctgcttcgaccatgtgcttacgaattgcttcaggtccacctcgtaccctttccctctccagccatgtttatcttggctccgtattaatggcacaccttctgaatgttggacaaagatagtagctcttgtgtaagaacacactatcgacagcaaatggaagatgttacactttaaggctgccagttgtccccacttgtgccatactgaaataggagatggcctgcatctgtttgaaagaaattgagtgaaataatagttggtgagtatagtcctgaaggcagtgaactgtgatggaatcaaggatctcttcctgttagagtgacttttgcccaccgcttccagtggtgcttgtagaacttaggatctcaagaatattttgtgtcccctgcagaaaagtagcaatgcaggttgttcacatccagaggtcatgactcccaacagactttgtttatagcagcccaggctcagtgaggtgtatagtgggaagggcccagtaccacatgggcagagaagcactcattaacttcctacctggttgtaaacattagaaagttcccattcagaaaagtacttaacagcaaatatcacagctatggtatagtcctgttctgaagcggatgtgttttacaggtgaagacttcaggaaaacagccaaagaagatgtgatcttccaagatatcatgtaccctccattgtttgtcagtagaggagttttgggcatttagggtagactcctcccacacatcacaaaacacttagcaacactgctttgcccattaaataccagtatctatcaccatcaccttgactcctgaaaaacagtcccacacagttgcaagtgctccccagggtggggaggaaaggagcacttctccagagggagaaccaggggaaacgaggtagcagcacccataggtgtgcctgtgcactgggtgcagctagtcggttatttcactcagactcttgatgattcaacacattttggaaagagaaagtttgtccccaaaagaggcacctgactggcccaatccattgtcacatgttaatggctgtcacatgacagccagttgctggatctgtttatgtcaccaaatagtcactgtctaattagacttacaaattctaagtgtagcattagatttacaaagtcagtaaactgtgatgtgtgcctgtgttatctttcatgatctgacagatcatgtttgaaaattggcccaagctaggcccagtggtttgtacctgtaatcccagctacttgagaggttgaggtgggaggatcacaacatcctgggaacagagcaagactcccgtctcattttttttttttttttttttgagatagattctctctctgttgtccaggctggagtgcagtggcttgatcatagctcgttgcagccttgaactcccagcccaagtagtcctcccacctcagcctcccaagcagctgggactacaggtgtgcaccaccatgccctgctaatgttttaaattttttgtagaggtgaggtcttcttatgttccccaggctggtctcaaactcctaggatcaagtgatcctcccaccttggcctcccaaaatgctgagattacaggcgtgagcctactgcacccagcccaaaattgtttttaaaaataaggaaaaaaaaaaaaagaagaaagaaaaccggccaaaatgcagagaaaagtttgactatcaatgcagcattactttggttttattttacatcagccatctcccctccgctcaagatttgaggttgcttgttagttgaactacttggcaatgaatttgtcattgaaacaaaaattttgaatttttgaatatgagaatttcattaataagtcatgaattgtaagcttgggtgtgaaaatctttataatactttatagtgagacatttctcatctgtcgtcttgcaggctactgcacaggagctcgagtacatagatttgttgtcaattaaatattaaagctttataggctatttttatttccttctgcttgcattccttcctccagctcctaatagccacatgtccagtctttaaatggagccaggtttagagaggtctaatgaagagggtttactgaatggggaaagggcagccaccgtgaccccatatcacacctttgccacacaatcagagacctctgttgaagctattctggaaaagatctattcttaccagaagctgtcctgcgctgtcagtgaaaagacattaggtgcaggtgtcaaacatgactaatgaggcatgaggagtcgacagcaaaataacagagattatgggcagagaggacttgcagatgaaatgtgaatagcagtgtagatgtgtgagtgatgcaggaaggaaggggaccggcaccgaggagcagtagctgtcccacttgcgggaaggttggacaatatcagttacttgattggtatcttctcctttgatatattaagtggacaaacatctaatgttttcctctcgaaatcatgagtttcctgcaagtgtttggggcttggtatccacgtttctgtaatcttctaagacaagccagaatctttttctgtttttatatttacacaggttttattgtgaaattgtcaggaaggatgaggcatgtttcactcattaattttcattgtcatcaaaacatcagagttacagtgcagtatcctgctattccagggcccacaggagctctgattgataacattctaccttcacaaaggttgtaatctaaatggaagaggctggaaaaagaaaaaagtatgattagttgtagttgtgtcaaaagctgcctctgaacagaccaatacactaagcaatcagagatttcaagagaggtagcagggcctgagactctaactcagtgaatcttgcttcaccagatgtggagtctgtctttggtggtttcgcagagcctggccctgagcctccatccactcagcgctcaatagatgactgtaagcatatttctatgcgttcattagcctcagggaggttgatttttacctcctagaggtgaattttaaagacttcctttttggatgagaaagagaaggctggtagagaaggaggagcagaagcaccatgaaatcaggtgggtgatggtttcctttcctggtgcttttaaccagttctcccagagtggagataaacatgaagttaatatggggaatgttgatcttcctaaatgcagctccaaatgatagacccaggacaggtttccaaacagctgttattcagattagaggcaaggacttgatgtattgctcccattagaaagtgtcctaatggaaagggcctgcactttctcctggccccatctgaattaaacaattggagtattttaaatcaagggtcataagtgtcaacaagatggagagctttgcctctcgattaaaagaggcttataagttacttaggaagttcctgccgacacagattgcacgtggctcctgtgaaccgtggttatacccaggctaagtccagccgttgtcctaaggagggagcaggccacctcagacagaaaatgcagctggagaatttaagtctcacatgccaagatcctgctaaccagagggtttgggggaggtaggacctttcatgtttctctgccaacttgtccccaaggtagggaccacaatcctggcaggccgggatggggaccaaagtggcacttgcctttcataacatgtttgtgcttgtttccgtatcagtaatgtcttagctccttatcaggttaattacccaccccttctttccaggctccgagtagaagtcatgctccaagaccaggcgctggccttgaacgtgatgcctcctcctggtttgtaccttgtttgagatcatctcaggcacagagcactggaacacggggagccacgtgatcccaggtgcaggctgagccaagcatgatccctggggtgtctttttctcccctgggactgacattaaaggtgcaggagccaatcaggatcataacagaaggtagaagatttccccagattgagaggagaggagagaaagagcagggcaagggggtggtgaggagcgagagagcagagcccgaacagcagtagcgagggcaatgcatctggagctacaaggacagacgtctctaggtagatgcccttatggcagcgcttctggagagagaagaaaatcccagtaatattaacagggctacaacaaatgaaaattggaaaataaacagatggaacatgcctcatagtttagcttttatcatcaataattctaaatctgcaagtgaatatggctaactgtagttcaaaccatctgcctattactgcctctcacttgaagagactgtgttgcatcccactctccaccaagactgagaggaagggagggagggagagggagagagaataattattctcagctgttctgtcaaaacagacacgtgctccgcgcccagcgtaaaggtcaactgcagatacaccatctatctctggagagggcagccagcagtcccacgctgctctcctgggcttgtggggaccccttctggctgcccttctgagttcaaatgtaagcgtctaacaggcaggctctgttgtttatttcggggctgagattcagcagtttcttatctatatgggggaaattaatgcaggtacatgtatggtgtgtcccaacctactctgggccatgtggagtcccctctgtgcctttcaagtcttctggaggctcatctggggtccagaacagtgctgtgagagatgaaaggacacgagtgctgtcccagcgcagagagctcagaatctggggaagcctggctctccaagacagggaccactgatgctgagtgagcaccaacccaaattaggcctggtcttcaccaccctcttttggaaaatgaacattttattcagaaggcaatatggtaagaaccttgaggaaataagtgtaaattgtaaatcagccacaaactcagttttagcctaccttgccttgcgtattccctcttgcaagactaaccagagaaacacagaatcaagcctttatcatttggtaaattgtttcatcaagaatactggcccaagcatggtggctcacaactgtaataccactgctttgggaggctgaggcgggaggatcgcttgagcctgggagtttgaggccagcctaggcaagaccacatctctacaaaaatttttaaaattagaaaaaaaagaaagaataccatatctgaggtgcagatgagtgtgcaagtaattctttttgttgttgttttaacatgacaacagctggcttttttatggagcttccctgaacattaaaaaaaagtaactaaggccgggcgcagtggctcacacctataatcccagcactttgggagactgaggtgggtggatcacctgaggtcaggagttcaagaccagcctgaccaacatggtgaaaccctgtctctactaaaaatacaaaaattagccaggtatggtgacgggcacctgtaatcccagctacttgggaggctgaggcaggagaatcgcttgaacccaggaggcagaggttgcactgagccaagatcgcaccattgtactccagcctaggtgatggagcaagactctgtctcaaaaaaataaaaataaagaaaaagtaactaagacataaaaaccaacccaaaataagatggggcacctgaaaagtgtatgtgtacacatgtgtgtgtgcatgtacctcatatgggcaatgcatgtgtggacacaaataccaaaaatattccaaagacttaattttttaggtgttgactactgtttgttcatagcccaatggtgttaacaagcagtagattgttagtgacaatcacactctctccagcacttacagcagaaggcttgatttaatcgaagagctgtcatttattattctgttgtgcaattccatgggggtagctaactgatcaagctcgggctacggggagcagagggcttttttttgttgttgttatgtctaaatcctcaatacaaattacagtatttctggactcccagtgggacccattagagcctgtggggcattaacgatcattaatagtgctgtcaaaaaggaggggggtagggagagaaggaaagaaagggagggaagtgaagaaagggagggtgcagaatagtagccagggagaagtgtggctttttttcagaaatggaaaattaatacatctgctttgttcacagtgccgagcatttgatgtttattaacaggcatcttaattttgcagattagtaccagtcgggttcttacttccgcatattgaaatccttccattgcctcagatccttcttctcttttcctcatccttcctccgccttcccaaaatctttctctccccagtagtcagtcctgaatctccaactccaacaatgaagacagaaagggactgagaaaatatgagtggggagagtgtcttcattcagaacagagtgtgtgcgcgtacatacatacaccacggttacagccataattggcaatcttgcctgtgatatcccattaactgtggttccttgtaagcatttaactgtatagttagtaatcaggtagaaatgttttaatcacttactaactagcatgcttatcagtgtgatggagaaagggcaaggtattaattagttaggataacatgctaatgtttgcattgtaacacttctgctatttaaagcaaggaagaccctgagtttgagtcttattcagaactgaagcctttttctagaatttttgttctctccaaattccatatctatgctaagctgacttgccttttgcctccctatggttgcatacttttctcctttcattatatttttcctttcagtctcggactcttgagatctagtcttctacatccatgacattctcaaaccacagaaaggaattttcccacaataataataggtgtgcattacactttctttcttcgcagcaataagtgccattacttcattcaagtgttgagtacctgtgatgtgctgggcactgtgcttgacacagggaatacagcagagggaagaaagaaccaaggcaccattcctgccctcatggagcttctgctatggtgggagagagacttgggaatcccataagtccatttagaatcacagccatggtgtatgggagaggcattgggactatgagagattataaggtattctgacttgggaggaaggttgggaaagtaccctacggaaggtacagttgagcagatagaaaagaaaaatagattgctgattactttgttccaggaaccatgttaagtatttttccatggattatttcatttaatccttataacagttctagaatatagggaggattctttagtttacagattaaactaaggtttaaaagagaatgagctgctgcctgtctggcccacggtataagcctactgcatagctcattgatgaatgaaccccaggtatggagaatttgacccttggatagtaactcttccatcttctctttttcgtgtcttttgacatttttgagcatagataaaccaggctgaccaatgcagccattttactctcatcaaggactcagaatggtgtgggtactgtgcacttgtttgagacaatgcccttccttgctgatagcttcccgaattgagcaaagcagatacaaaaaaagtgagcaagactctcagcctacaatctctagtgtggaagaaacaccctatttctttgctttcttacatcaacttcattttctacttgaaactgtaccccctaaagggaccttgcacttaagtcgttcccagtgcatcctacatccctagagttgtgtctgtgttctgtgtctttttgccaagggatgttgaaggctggaagtcctctaggtcttaggtcccccagatcactgtgggaagaccccacatccccatccctgtgagccaccaggagcctggtgtggccatttctcctggggccttgcttcctcctgtgagccattccagaatagggtgtggggccctggtgctctgacagccacagcttcctctgcttctccattctgggtgaatcttttccttagcgaagcccttccccatatcttaggcactacaattctttacttaagctctcttaaactttatctttctcattccattagattttcatggccattgaacttagcaactgaagaaaactagtttccctttcctatagggcagagagagctttagtaaccaaatgttcctaggaggagtggggaaacatttttattttcattccagtaacacagtggttctcaaagagtggcccaggtacccaagggggatccccaagaccctgtcaggagttctccaaggccaaaactattttcccaataataagacattatttgcctttctcacttactatcattctctcacaaatacatggtggggtttgccagaggctacatgacatgtgatttaaaatattgaatgcaaaagcaaatatgagaatccagacatcttctataccagacattaaagaaaattgaaaaaaatgtaaaactcactaatttttttgttttgaaaaagttatttttataaaaatgtatttaacaggtaataggtttattgttatttttaaatgaataaacattttacagttttctcagttttaatttatttatttttatttatttatttatttatttttgttgagacggaatcttgctctgtcacccaggctggagtgcgatggcgcgatcttggctcactgcaacctccacctcccgggttcaagtgattgtcctgcctcagcctcctgagtagttgggattacaggcacccaccaccatgcccggctaatttttgtattttttgtagagacgaggtttcgccatgttggtcaggctagtctggaactcctgaccttagtttatctgcccgcctcagcctcccaaagtgctgggattacaggcgtgaaccactgcgctcggcctttaatttttaattagcatagcaaaagccttttggaagttctcaaaaaaaaatttaagagtataaaggggtcctgaggtcaaagcatttgcaaactgccacagcagagcaaaggaagaaaagaaaaaccaaacatcagatttccagacgaaatccaccatgccacaccggcaatttccaaatgcggaaactggattgtgtcatccagtgagagaaactgttacttggatactttggccctacctctcttattttttttttctcaaatttgaagagatcataataaaacaacctcctaaatctaggtaatcacacatcccagtttccctgggacagccccaacttctatatgccctttgtcctgtcataattttttatttttatttttttcattttaaactttttttcattttctttttttttttttttttttttttttttttattgagacagagtctcactctgttgtccaggctggagtgcagtggcacgatctgggctcactgcaatctctgcctcccaggttcaagcgattctcctgcctcagcctcccaaatagctgggattacaagcatgcgccaccatgctcagctaatttttgtatttttaatagagaccaggtttcaccacgttggccaggctggtcttgaactcctgacctcaagtgatccgccttgccttggtctcccaaagtgctgggattacaggcatgaaccatcacatccggcctgtcctgtcataatttttaagtgttcccactttcactcttcaaagtgtcctggtttgattgataaattaaaggtcagcctacctgaaccccacccaacttcatgagcttataaatgacaaagtaaatacaaaatttctatagtccagagagtcaagaaagcatcccatttggattgactggctgggatgtggcagagagcatgcatttatttgtctgtgaccttttcctgtttcagctgtgaatatgggtccccacgttgatctcagctagggagctgggtattaaccatcaaggcagtggtgaaccgggtgggcctcccacacaaaaagctcactggcaactagcaaatccagatggcgcacatatccatgtgatattagccacatagaggcctttgcggggctttttttggacattgctaagcctgctgagtctaagatttcaaatgctgttttgagctacttgatttagaggtgaagccagaccacttggagggaagtgtgaaattctttggagttcttcaactcacttgtgactctataaaaattacccgggggccagaagcaaggaaggaggtaacgcttcaagtggcccttctgcctccacagcacttttcagattagggagtgacaggggctgtggaaccgtttttccctcccgctcctcagtaggaaaacatcgaaacatccatactgtcagctgacatgatttggggtgagctttaaaggactaaaggactccccccagaaggctgaaatccttgttaagcaaggaactttcatctcaggttctaggctcaggagcatggaaattggaattctttttaattgaccatatggttagttttgcagctttgtgaagctataaatctttggtggagttgtaacccagcagaagtgtcaccagaggaaatttttttttaactttttcctcttgtttcttcccaaaactcacttaaagaaaaaaaaaaaaccatgcagcttttgatatatacacactggtgagtgaagtgtgggggggcagtaggtcttggacaagtgagcgtggcagggatctgtcaggcagatccagcagttccagccccattctgagagctcgcaatttagcttttgctggtgccagcaattataaaaggggcctactcagctttaagcactcaagtgttgatggacaaagtgctagtttaacagatctgcgtaatggggaacaggtggataaatacaggattagggagccctttacagtaacagccttattatcacatgttatgtggggtttttgccttcatttgacaacttgggttgtgtaaaaaaattttaagtaacacaacatagaggaaacccttcataacaaagcactgaaacaattaatcaagatttatgaaacctctgggtagtagtggtgtatcaaccaaagtggctatttctgatcagacccacagcctcctaaatgaataaatggagagcacagcaccagaagccacagcctccataagtggtacaattgttttccataattgaagatagcaaaagcctgtgtacgatcaaagaccattccattaggagagtgaggatgtaataaggggacagatttgagtctgcccagcctggaaggcatataatctatccccctgtctccaccacagcaaaccccactggtgaagcttactccatctcaaatggtggctgtaatccaccttttgcccttaggaaattgtattagtccagacctaacccccttattaagaggaagcacttttgccatagaaatcatctacttttctgtttccttttttttttttttttgagatggagtcactgttgctcaggctggagtgtagtggtgcaatctcggctcactgcaacctctgctcctggattcaagtgattcgcatgtctcagcctcccaggtagctggaattacaggtgtgcgccaccatgcccagctaatttttgtatttttagtagaaatgaggtttcaccatgttgcccaggctggtctcgaactcctgacctcaggtgatttgcccaccttggcctcccaaagtgctgggattataggtgtgagccactgtgcctggcccctttcttttaaatcaccataggatttattaaatgagcactgtatagatttgttttacaatttttaacctttatgtaaataatgtcctctcttttacccctttaaaagctgtttcttggctacataatatgttttggctgtttatctatatgagatagagctctagtttattttaactgctgtatattattttattatgtgaataaaccatactttattaatcctcctattggatatttagattgtttttcatttttaatataatgacgaagtccacagtcaaccattgtttctttatgccaaggattaggtttgctgggtgtgttagtctgttttgcattgctataaaggaatacctgagactgggtactatctaaagaaaagaggtttattcggcttatggttctactggctgtacaagcatggcaccagcatatgcttggcttctggtgaggcctcaggcagcttccaatcatggaagaaagcaaagagggagccaatgtatcacaggggaagagagggagcaaaagagatgccaggttctttggaacagccagctcctgtgtgaactaagagcgagaactcattcatcaccaagggaaagccattcatgagagttccgtccctatgacccagcacctcccactaggccccgcctccaacactggggatcacatttcaacatgagatttggaggggacagaacatccaaagcgtatcatggggtcataaggtgtgagcatcttcaccccaactgcttattgccagttgctctgcggtggttgaattcatgcgtgtgcctgggaagtgtctgagagttccctttcaccatatcttgctgaacattgactgtcaacagacattttaatattctcctgtgtgataaatataaaataccatctcactattccgatcatttggattttcccaattactagtgaaattgagcatctttttacacatttataggctattcaacataatatcctttgtccatatttttattgagttgtttatcttttttgtatttacctgtaaagctctttatatactctggatactaattttttttggttgtatgttttgtaaccattcattatttccttgattccctttattaagtaacagaagatataaccaaataggttggaagctatagcatatagagtcatgcaggtgatgctcaggagttaagagtctctcctgcaggcagtggggagccgttgagggttattaaaatgaggaataacatgatcagatttgctatagaaagaaaaggaaagcagcagaacagaggaggatggattgcagagaggagaggctagacggtggtgccaattaagaggcttttgcaagaatccaggagagaaataatgaggacctgaacctaaaccatgacagtgactcctaggaggatttccaaggatttccgggaactatttgagaatgggatgggcaatgctagtgagaattcagtggagcattttaatcagccctttcctattgattcacagagttcctttcccatcttgcctcggtgaggattgtttccatcatcccttggccactcaagtctacttaccgggttagagacttgttgggtctatgatgtccagttagatttcccttcaacgagacccagggggacattctgccagccattgacagatcttaattctccctttggctctcacttgttcccttcatgccaccttgtttgcctctccctgactctccctctctctctcttttctctttttttttaaattttatttcccatttttaaatcatgcacagtataatacaataagcattaaatcatgcaaattggtctaggttacattttgaaaaatgttaagaggaaactgttaagagaccagtttctgacaggcaatgcattttaaagttgagggatttgaaatatttcagcagtggacctaaaacagcattataaattagttcaacttatcagccctaaacagaattattcatcttccaaaagggtatttcatggccgctgggcccaaacgatcgttcaccttcatttctgccctgctctaagggtaggtctcactttactgaattctcctgattcattactgtgtgttactttatgaattttttatcagcattttaatagctctttcagatgattgaatgtaactgattcttgtagcagaacactgattgaacagagagacagtaatgtatgtcgtaggggttagcttcaagccaagcaacagagttttttacctataaagatgtgctttttctcccctcactaagagtctctgcagatagaagctgcccccctcctccttccacacacccgcaccttacccaccaggatttaggcaggaatctgccattttcagtttccggcatggtactgccagcaaagagagggaaaaatcagcccaagcctgaagcaccctctttttgctcatcaaaagtatgaaatgattaagatttcggaggttcttgggataagagaaagacattagactacctcagaccagcaggaggatggtctgtgggaagagcattggagtctgagccaagcatgaatctcagctgtcccttccttgctgtatcaccttgggttcttcgtctcattgtcctgagctttttcactttcctgtagatcagaataacccacctttcctggttattgtgaggattaaatgagaaattgtattagaaactccaggcacatcagaggcccctcaggaaatgtttgctacatatgaataacgtacacgaaagcacttgtgtggcactgtacaaatataacttattaatataagccacagtgatgcttgaccaagaaaagactttttataatactgtatgctaggttgaaccatatgagattctattttaatagacccaaaatggcaacttcatatggttcaacccaatattttacattgtttgatcatctgtttcctggttacaatgaaaaaaaaatgtgagggatttgtgtttgggtagtgggggaattatatagctataaggaatattagagataattaggtgcaattttctctcctgatgagaaacccaaggtccagaccacactggtagtaagaagtagagatatgagaacacactcagttcttcccaaatcccaggacttatgcagcatatcacacagccttcctgaataagggatttgttttcttataacaagtatataaccggacttgaaagagaatccagatcctcttcagccttgaccaggattctttcttctgtatatgctcacctgtgtacagcacccaacactggggaggttctcaagagggtttcttagacaactgattgacttcaaatggcaactagagagaaatcaaaatgagttgtagacattggtacatgggtttggtggtatcagataagtgaactgacacctgaatcttagctgcaaatcccagccatcatttgattcttggtgtgtcttctacctcaaaatgatacaaattggagttgacatgagtttttagggaatctacagaaccaactagagttcagtgttttggggcaaattgtatatacacatatatacaaattgcatatacacatatatacaaattgcatatacacatatatacaaattgcatatataatatatattataattaaataaaatatatataatgtattattacatataaattatacatgtataatttgcccagaaacaatttgtgtccagttaatgatagaaattgttcacttaatatacacatacatagtttgcatatgtatacatatgaatacacacacacacgatttgtgtccagttaatgatagaaattgctcacttaatcatttgtatgtatacatatatacatacataatttgtatatacccacacacacatacatgatttgtatccagttacattaatgatggaaattgctcacttaagctctgaaagtcatcaaccaatccagaaaaatacataaatggaagaatgggctggcaagaaatgagtggaagtgaaatgtcttatttggcaaatgaaaatatagccatttgggcagatacttactcatgaaatgctgataaaatacttgaatcaccaatatccttgtttgcttccctgtttatgtcaacatcttaatgtgaaatataattacaatgaacattcagaaacagaatggcaaagcctggctaaatttattctaatgtccattcttatgctgaaagctaggtctccaaatgtacttctaaaattattttttacaatatgtactttaataggattgcaggattgaaatatagcttttgtggggcaatcaggacgcaggggagaagttatatgaaagttgggtaaagattgggggattttatggctgattttcatgatcctgctaaatcatgtggtcacagtgggatgaatgaagaatgaacactagaaaaacgtgtctttttgggctgggtgcggtggctcatgcctgtaatcccagcactttgggagaccaaggcgggcggatcacgaggtcaggagatcaagaccatcctggctaacacggtgaaaccccgtctctactaaaaaaatacaaaaaattagccaggcgtggtggcgggtgcctgtagtcccagctacttgggaggctaaggcaggagaatggcgtgaaccaggagccggagcttgcagtgagccgagatcgcgccactgcactccagcctgggcgacagagtgagactccgtctcaaaaaaaaaaaaaaaatgtgtcgttttgtttgtttgtttgagacagagtctcactccatgacccaggctggagtacagtgatgctatctcagttcactgcaacttccgcctcccggattcaagcgattcttgtgcctcagcctcctgagtagctggcattacaggtgcacaccaccacacccagctaatttttgcatttttagtagagacggggttttaccatgttggccaggctggtcttgaactcttggcctcaagtgatctgcccacctcagcttcccaaagtgccgggattacaggcatgagccaccacaccccgccaataatatgtacctcttttcacccatgtagttactgcttatggacttttctccattaaaaaaaaatcaaaacactaaaagcctttatttacactgtttgctctttcttttacatctactctgtatcttcttcctaattaagaatagttgggaacctccagggtcaaatagaaatggtggcatcaacacggtcatagagaactctgatgttcaaaggacatggccatggaaaatcaaagggaagactaataaagttaaaggaaagtttcaggtttgttgggcccaaggactcctgaaaggataggattaatgtgttttttgagccaaagttctgcccttgaaagggaaatctcctctgagctttgagtagctggtgctgcatcctttaaaaatgtattggatggaattaatagtgagcgttgccacatcccttcttcccagcccaaccaagaaccagggaaccagtcattctgtcacaaaatgaatagaagttatatccaaatgccaataaaacccagttagaatttaatgtaggacataactagagtgttaaatatgacaaactaactttgagataagtctgagagctcaagttccaacagaaacaaaaccttttatggacaaatagcttcgtatctcatatgctactcccaacagctcatttagatgaataatacagattctgcattggatctgtattggatggaggaaattgagacatagagcagttgtgacttgcctgaggacacacaaagttagtgacactggcagggttctaccatatcactttacttaatatgagcagcttctacttgattgggtgttctgtcagctggccatgaggaggggcaaaggaagccattcaaggaatctgaattgccaatgaggctgttagctgagtctactttttgaaataacttcatcatgatataatttatgtatcataaagttgacccatttttaagtgtgcaattcaattagttctttatatattataaatacaaatcctttatcagatatgtgatttccagatgttttctttcagtctatggcttgtcttttcattttcttaatggtgccttctgaagcatgaaagttttctatttcaatgaggtcctctttatctctttttttatggttcatgcttttgctgttatgtccaaattcaaaggaatgttttttaaaaataagtattatcaagtcttgttctctctctttctctctgacacacatgcatacacacacacatgagcaagcttaaagtcctgcatgaccccagatttcatctggaataaaacccaagtctgttgctgtggcccacaaggtcttccctgatctggcacctgtgcctggtctctcctcagccacatgttccagcctcactggcctcatttttttcctggaaaacgctaaatatgttcctttctctgggcctctgcttttgctgttttctctgcctagaatgttgtctccagcaattcttgtagctggcttcctcctttcatccaggtcccacctttagatatcacgtgcatcatgatcacgccttagattattcaggagatatttattctactaaaagagccttcttccagccaataaaaaatacccttttaaaaatttccttcgcagtactttctgagattattttgactttttaaaaatttacatgtgagcaccgtggagaccttgtctgggtgctcactgcccctttcttggcaccttgagcagtgcctggtacaaatgagcggctgagtaagtatttgtggaatgctcaatgaatgttaaactgagaagcagttcagagatcagagtcactgtttaaacaaatcaggatcttcaacaattctttcctaatgagcctttctttgtcaaactcatttcattccaatcactcctgtgtttcccccacgcttggagaaacaatctttctggtgcttcctttcattttttttgcagatgtccttgcattggttcatattcttttcttccttggaagtttcccaccccaccccgaattaggaagttcctcagggacagaatccatgtcaactactttatcttctgtctctccatgcctagcaaatgctaggtgtttggtcactgagtagatgaatgaatgtacatccctgaccttcacccttgttccttgagtggagaaaaaagaccccaggctgtgtgtactcttcatttctggaatgagggttcttgtacatcccatcatcagctctcctgggcttttattctgaaggctagtggaggcacaactgcaaaagactttgcagatacgacgtgtgaaatgccaagaggaagaaaaattgaaagcaggagttgcatcttgccatgtgatgtgaatacctttctggcactatgacagtctcctcatggtgggcagtgggataccatgtgagaccaagcaagggcccaagtcacctgcagctctgagatgcctgcagaattctgtggaaaacttcccaaatgcacttagaccccagggttttgatgatgttgatggttctctgttcagttttttagtttctgtcaaaatgtattatctaaactctttactcagtcctacctacaaaatacactttcatatttcttactaatcactttactactgaagtaaattttactagttcacttttccagtggactttgattaggacatgagaagtatttgttggcacctataggcagacttagatgcaatgttttactttgatgccaaaagtgggggaaggccttagaccaatagcatggcgtttgttattttagtttaccattctccctccaaacggcccatttcactgagactggggctatcttgctgcagcttggagtcaaacacacatggatgtgactctgcctttgcctctcagagcctcagtttcctcatctataaaatgaggctaatagtacccagctgatagggctattgagaggatcacatgaaataacatatcagatgttcttattacagtggttaggtacagagtaaatacagaataaggggtagctttattatgaggatttatatgattattagcattattattgctatggctgcaaccagtactaccaagaagagaaatgccactcaagcgaggacaactcagtaggtgtgacgtttaaaccaacagagaaatcagtgcatttttacttatttatacctttacctggttccataaaagttttatccctgtttctaaaaagaatgcatcaaataaattgaagtgaacacagaaagaaaaaatagcaactaagaaaaaaacacagatatgggaaactttttttataatttcagctttcattttggattcagggggtatatgtgtaggtttgttacttgggtatattttgtgatgctgagatttgaggcatgaatgatcccatcaccagatactgagcagagtacccagtaggtatttctttagctcttgccttcttccctctctccactcctctagtagtccccactgtctgttgttgccacgttttgtccatgtatacccaatatttagcttccacttacaagggaaaatatacagtatttgtttttctgttcctgtattaatttggttaggctaatggcctctagctgtatccatattgctgcaaaggacatgattttgttcttttgtatggctgcttagtattccatgatgtatatgtaccacattttctttatccagtccactgttgatgggcacctaggttgcttctgtgtctttgctattgtgaatagtgttgcagtgaacacatttgtgcatgtgtctttttggtagaacagtttattttcctttgagcgtatgcccagtaatgagattactggatcaaatggcagttctaagttctctgaaaaatctccagattgcttttgctgcagaaaacttaaagatcatgtaattgccacaactgagcttcagattttaaactgagattcctggcagccaaggtcaacttcactacataattaatttaagaatgagaccgccatttcttcaggattcaaagctgcttctaaaactaatttccaagataactttcttacctgggactttatgcagtgaacagtattccaacaacatgttctcctcaaatgcaataacagattttttatggctgcttctggtagcacctttttgataatagcaaagcagcatggcattaaaatacaatccggtgacagcagttctgtgtggggctaaggtaatatggccctagtgtgtagctgtgaggtggtcagacttgatccagggatagaatgtagagtgttttgaagaatggttgaactgcttgtccttcaaataatcttttgtaaatattgcttttctcagcttgccttttgataggagttgaatagcagacagtttgagattgtattctctgacaaaagcctggtgtgtttgtattctctgttcctggtccagggcagagccttatgccttagaaatcagaagtgcaagtggtaaagttgacatcttactgtaaaaattggactcctgcctgaacagaaggccattctccctctccctaggtggagctgcaggaatacttgcaaacaaatctagactcctcttcaggaatcagtttgggggcgtctaggggtctagtgtggcattcagacttgctgccctgggccttattcagtaggtctaaactgcagtgcagcgcactctggttaggggtagattcagaaggtaagatggcgcaaggacaagctctagcctatagctggaaagtacaacgcaccgtgccccacagcaccctttgagagacacctgcccagcaggaaggaggctgcactggaaacatcacctgagcactccaggcgaaaaccggtgaatcagctctagagggtggcttagatctttcccgcctgggtttctcactgccctgccccaagcagtagaaactgtaattccttcacacaagtctaagcaacatgatttcttcataaacctggcagatcaactggctataaaattttctcttaagaaattaaacaaattaacctgttcagtgaagttattcgaacaaaatggttacatttggaggcaacgctactattttaggttgctgtagttactgttgagtcattctttctgaccatggatgccaagaccatttatctattgacactagtttatgtcaaggtctataaggaagaacttgtgttaggtagagagaaaataataaagcagaaaggaaccatgcagatgatccagtacaatcttcacattttccagaggcctggaagtatttcctcaaagcctgggggaagtcctgactctcccacttacaatggtcattattccatgtgaagactgtttccaccatatagttggtcaggtatgtgtattagggagagataaaataataaaatgaaggtggctgttggattccttagaatccaggggcctcatccacattgataaatatttatcttgttctaattaggacctacatgcctacattaactggtggaagagctctcagttgcattaagctccctggcagaaagaaatggcctggaggctgcttcctctcaagtgagaaagggtcttccaggactgttcgaacaaaaggcatcagggaagtacctcttgagtctgtcctgtgaaagtcaacccagtttcttggctttccaggcagcctcacattgccttgactattactccagttcattaaatgttaatgggttatcaatataggaagagtaatcccctgaagtccctttaatatgttttattcttcctctcaaataaatgattgattaacatcaataggaattgttcaatatatgctgtctgcaagactccttgctccttgaggctttctcctgtggtttatagcccagtgcagacgcctcgatgagatcttaaatagagagagtggtaaaagtttatgtcagctcgtcagtgaaatggaggtggggaaggatctaataagtgcactggcttgaggatgatggcattttcataaatcacactgttcttttccctcttggtcggtcctgcttgtagaatcatagtatcttagagatggaaagggccttgaggttattttttccagcttcccattcttcaaggaattccttctatagctttcctgacagacagtcggatagcacctgcctgtacctccagggatgggccttaccttcctcctgaggcacgccttcagctcctctgcagttctgctagtggaagattttccccattccatcagttgtcatagttcctattcctttttctcacgactcaggttagagttgtaatcttccatttatttgattgcctctcctaaaagactgtaagctccaggaggccagaggccctttccttgttagctggccattccatatcatgccttgcccattgaagggactcaatgtatatttgttgaatgaatgaatgaatgaatgaatgaatgcacttaagtttagaaattccagaaagaactaggaagatattacataacatgaaaatggaaatagagtattttttcccagataccagctgatgtgctcaagatgactttagggtgaatatggaggaaggagtgaggggaagtacccaggaaagagtgacgggttatgactgagcaacattcagagcatgggaaaaacaaaaggatcttgactttttaatgcagcctggtaaatatcattgagatttggcaggaccaaaactgagcattggaaaagggatggaaaagtcttccctatgaggaaaggagcccacttgtggagaagatgaacactcgcatggaagcccacagaagtgagagaggtggcctggaggagggcactcgagtgaggagatgggcacctccagccttgggtcagtcacaaaggaaggacagaggcaggaaacaggagcattctggacagggggccctggccgctgctcacagcagctcatcttctggcgggagagggttagctcctgcccagtgtcctcacgtacgagagtggtgagtttctaatgcatcacctctcaccatgcaccccaagacagctgctcttctgaatcctacctagagaaaaaaaaataacccacacaattctcgctgtctctcaacctcccacatctaatgagtcacccagttttgtcacttcatccttgggatgtctcttgacatgctttttcttcctttccactaatgtagctcagatcccaaattctctctgggaccatcacttgccatacgcagctgagtcacataaagaggttgcccttacacaacagatctctgctcactgttgcctaagacaccgcacgctctgctgacatcgtttattcttcctgaagagtcctttagttcatcacctggtgcttgctggccaggttctataccatcttcaagatcctgcttctgaggccgtgtgcggtggcttacacctgtaatcccagcactttgggaggccaaggcgggcagatcatttgaggccaggagttggagaccagcctggccaacacggtgaaaccccatctctactaaaaatacataaattagccaggcgtggtggcacatgcctgtaatcccagctactctggaggctgagacacgagattcacttgtctgggaggcagagattgcagggagccgagatcgtgccactgcactccagcctgggtgacagcaagactctgtgtcaaaaaaataaaaaatcctgcttctgttcttctcttcatgactgcccgtccaactccctctgccccctggcctgtgattgtgttcccatctgtaccttcttacacttacctccatctgccttatgtgtgcctttgaagttcctgcccttgcctcctctctcccgacaccctcaccagcctctgaatctctgaatggtcttagtcacacttgcttccagtcagccttacaccccagcattgtgttttacatacaggctgcactcactgaatgtttattgacttgaatgggatgtttcttcctaagacatcaattccatgtcttatgatttttcatgcttttcaaaatattttcacagagtctgtttcagatcattcttggtgctggtatcacacaagctgagctgccttcctggggttcaccctttgctctcctttgctcatctccgttgttctggtctcctccagaaatctgctgaggtgacatcgtctccagtgacctctgccaatttgttccaacatgggaatgacatgctgatttaaaacagttgaagcatactccagaatgactagaaatggtctcgtgtttgaagtttctgctcattggtggaagttaaaattccagtttctccagcaacatttggttaaatgtccctatccagcattggaactgctcactgatctctttttttgggggggttgaacccctgcccatcttctcagtatttcaagggcatagtcacttggctgtaataactgctcaaactatttactcaccagttttaagtatagatcagcctggtgtttatgtgataaaattctagaaacttcttcctttgcatctttctctacctgtgcccaccaagaaaaggagccgtacttcaccccatagccgtagatcaaatgaaaagaaataaatttctcacttgtctctaccctatgctaccttttcctttgttaaaaagggagataaaagagaaaagaaaacactggtctacataaatagcactaaatataaacagtggaaatgggcttctgggctttgaactctacagggaagttgttatggcaacctcaagttgaattcactgggggggaagtgtcagtattaatgagataagatcgaacttgtgactccaatggtaactgtattctccaaggtttttcttcttactgagacaagaagcaaagcctttattttatcagtgacatctagatttagaattgggagacaaattgtgtgggcattggggcctggagtttagtttccaggatgaggtttctatttctctgttgagaggaattagagccactcctaacacacctgctttagctattcttgttcaaagcctatagttgtaaatttagaggatgggtaacatagaccattaattccctaaagagacttgaagttcacttaaatttaaggattttttttttttttttttttttttttactggagtgttacacagatttttctatagggataaggtaataagatataattgatattgtaactgtccagtggaggttaagttcccaaaacagtgattgaccatgggtcaagattcccccaatgaagaagaaattctaaaatctgaagagagagagaaataaaaaaaaataataaaaaaaaaacccaggtaatggaaagccctggttgagggcgagaggaaagggttgcagagcacgctgagcaggtactgcctatggaagtactgactctgacttcagaggtggggagacagaggtaagagcatgaagtatgtaaatactcaaagtgtttatactgcattactttatcatggaagtaagtaatgtatgaaatttgcattatagaaattagactgagatgctaatcatttcttgttcctaaagctgaagacatctataaaataagtttctaattcggagaggtgagcaaggatccacaggttaagcagacttcaaaaatataccatctagtgccgggcacagtggcacacgcctctagtcccagctacttgggaggctgaggcaaaggatcacgtgagcccaggagatcgaggctgtagggtgctagttcagggctgttgtgcactatgattatgcctgcgaatagccactgcattctagtctgggcatcatagcaagatctcatcttaaaaaaaaaaaaggagtatgccctccatctagaaggggaacagtgagccccagggcacaaagagagggaacaaaaaagtaagggtgggcaaagcaaatgaaggaggataatagcaaccagaaaaacttcttcccaaatgttgtttatttgttgaaagagtaaactcattcataaactatggccatgtataaacaccactgtactaacccaaggagacataggagtgcctcagaacagcagttggttgactaatgccaaaaagggcctggagcctctcaaaaccccaccaccacaaacacatgaaagagctacttcttctgggcagacccttaaatggaaaagcctagaaaataccaacactgcaaactgaactactttgcaattctctccaaattctgtcttcaccatgctggaaaaatggaataaagaaccaaaatcaacgatagcagtgtagattgcatgtaataaagagctaaaaaatttatgtatttcatagcctacaaagccccttcataaataatctttgcaaagcaatcatgtgagctagacaggacagatagagtgactctcgttttacaaatggagaaagtgaggcttggagagccgaccagacctgctaaaactgtacagcttccaagggctaaacctggaacttgagcccaggctgaattctctgtattcagaccctctgctctttctatggcaaagtgcctcaagaaaccaggcaaatcgtacctataaaagaaatgtcaaatcacgcagaattcacataaaattacttgaaaaggctcctgcctttcatcccaggctgtccttcacgctgctggcatatcctgcaaatgtcatggcttcagtgcccagggttttgccagaaagaacatgctgccagcctgccgaatgaaggatgcgacttgagaagcagcagaatttggagaggaacaatggagttctccttctagggggtgggatcagtgaccatagttctcagggggcagtgatgaaacagggctttgtgtctattcaggaatagtatccagaagctcacttatttttgctttccaaataagtaaatatcagaaaggatagctgaggtcagtctagaaaattagaatttgcttgggggaaaaatatgttctggaaaagataaacagtagcttgcagtttcactgttggaacatttgttacaaggtcctggtattgatcttttatcacccaatttccactgggagccatgatgtattaccacactgggaagctctaatgcaagtgcgtgaatcaagggagattctagacaacatctgtagtgaggcagcatccatttgagggagggaagattgggaagggggtgttgctagctgcaaaattccaaggggagttttgcgttgtgctgtgtgcaaatgcatatccgtgctggggagtgttatgggtttatgaggagagtgattaaaattgtatcaaagaggcttatgaagcttatggttcaagttaactgtatgaagtaaacagcctttaacggcctcctgggagtgtgacagatagtctgtgggtgttacggcaacatggtactggtgaatgttctggccatcccaaactaatcaccatctgtgagcatgggtctctggggagcgtctggtggttggacaatcatggtagttagcatttttaatcagcttctgtgcggcacagatagaaaccttatgctcaagcctttctttttctgtctgtgtagaattacttatgatgatgatagcagagccgacaagggtttgggttgtgcctctgcaggatacattctgtggttctctgccctccctcttccccagcccccagcctgaccgtggaaattagcctggccactgcttatggtcactgcttttattacttctctttaccactagcaaaagggatgtcaggggaggggggatgtttctgggtttagtgggactgctgcctcgggtcaggatcttgagtttgagattcttctctctcctgctttcctctcctactgcttccttcatcaccaccacctctagctctgccccaacattcactcacccatcaggcaccaacttcttttttcttgttcttattatcgttgggaagcattacttgagggcatcgttggatgccctctaagggacccaggcaaaaggggaagtcaatggtaccatccctagaagtaggcaggcctcatggatgtttttgctgtgcaacagacttgagcagctgtgacagactgtaaggtctgcaaaactaaaagtatttgtgatacagccctttagagaaaaggttggctgactcctggcttagagtattccttattcttgagaaatatttgatctagcaaactgtactaagatgagacataaatatctaaatcagaatatacatttcattaggccagtatatgcacatttcatggtaggtaactaattcagtgggctgattaaaataatttattgtaacaaaagtatttggaactgcctgtaattaaaactaagatttattaaagaaacaaaagtcgccaggcctgcagacagctagatcctgtgcgtgagggttgtcttagtccattttatgttgctctaaaggaatacctgaggctgggtaatttttataaagaaaagaggtttatttgactcatggttctgcaggctttgcaagcatggtgccagcatctgctctgcttctggtgaggcctcaggaagcttttattcatggcagaaggtgaagagggagcaggcatgtcatatggtgagagacggagcaaaagaaagggcttgggggtggggttccaggctttaaataatcggctctcatgtgaactgatagaaggagagctgactcatcaccaagaggatggcaccaagccattcatgagggatccacccccatgaccccaacacctcccaccaggccccacctccaacactgaggaccacattttaccatgagatttggaggggacaaatatccaaaccatatcaaggatgaaaggagagggtgtcagttagcttttgttatataacaaacccccccaaaacttagcgactttaaacaactattttaagtagctcataattctgtgggtcaggcaggtgattgtacctctctgggccagctcagctgatctctgctggcttctgtcagtcatctgtggccagctggggttggctggtctagattgtttgacttacgtctggtgaataacaggctgattggtctggggatggtgctgggacttggctgggacagttcatctctgctccatgtggctcttacccttcagtaggctaacccaggcttcactgcatggcaatctcaggattccaaggagcagcaagagagcaggccccagtgaatatgcactttgcaagcttcagcttgtatcgcgttgctgatgagccactggccaatgcaagtcacaaaactggcccagagttaacgtgggaagtgaccccaaggatgtggatacagggaggcatgaccaaatcagaagccattacttcaacaatctctgcaaagaagagaggtttccttctcttcataatctctaccacctttcatggtgcctagaatttacattacagatttattcctttgggtcttaaagagtctgcagtcttcaagaggacccctgttatatgaaggtgtagttgttcaaccaaggcctacccagagcttagctgataactgagaacagggtcgataccagggtatcagacaccaagaaagaatatgaaagggaaggtgagaaggcactagaaaaaaatgaactattcctgcattcgcgtatccagctacccacaagaaacccctacgtggctgttcagggggcacagcaaatccatactgtctcagaccaaccccatcaccttgccttcttccttctctccaacatgatttttcattctcgcagcaaatacagtgcctcgtcttgaccagtgaagatggaaatgaggggaggtggaggtaaaggcctgcagaacaaaatggaagaaagggaatgacaggtaggaaagggtagaaaattattgctgagtctaagtattgagggttcaactcagtaattgattccatccaagtttaagacagtggacacattcctctgtttttttggttccttatcctttgcttccactcctgaaaggattataatcctcattcttgtagttgtggatggttatggccagagaaggccatagggacagtcatcaaggaaagcagaggcctctcactcaggagatgcctcagcattttactgtcttcaaagacaacagcccaagtgctggagcagccagaaaggaaccggcctgatttatttatttatttagagacttggtctcactctgtcacccaggctggagtgcagtagcatgaacacggctcacttgcagattcaatctcaagcaatcctcctgcctcagcctccctagtagctgggaccacaggcatggaccaccatgcccagctactttttaatttttttgtagaaacggtctcgctttgctgcccaggctggtctcaaactcctgggcacacgcgatcctcacacctgaccctcccggagtgatgggattataggcgtgaggcaccattcccagaccagcctgttttctaatgggtgtccacattaaatctgaactctgcctcaagttgtagctgctgctgagagaaccctggctctatgcttttctcacaaaagagctgttccagactgcccttagaatgttttctcccgtggcagaacagctgttttctgttcagctgtcccttacattgtagctctatgctggaactagctcgtgtttaatgctgtgttatgggtaaagccctcttgccttgtaggtgacactaataaaatcacagaagagatcaaacctagaatctctgccgatgcagacctcatagtcagacaaagagttggatgcttccattgctctcctagcttaggctggagctggaattctcacagcaaccagcagggagctggcaagtaatggctgctgtgtcctcctagaccagggccagcctttagtagcagctgagcgtgggagtggcaggcaagcttggcaccatgcagcagtgggcttccttgggtgctggaagtacagtcagggaacccttgttctgtccactctgcctacacaatggttgccttcagtctggagagtagtgaatggcaatgagtaatgagtaaagggggaccctcttcataatggcaggggctgggagccttctgggttgaatattttgtagcactcaaagagatggccaactaagaggtcgctctggtattgccttttctctgcctccacatcggcaggcttccagcaccccactattctggatctcaacattggacaagtgtactaatgttcaagcaggggcctgggtgagatggcctcatggtgccctgctggttgctgccttttgctgctcttttacaatccctgtactcaagggttgatttctgacgcctgggagggttggcactttgggaaagaccaatgagatttttacatttgagattttcagcatgtcaaacataggcaagacagaatatcggggagttattgggaatatgaatttgtttgtttgtttgtttgtttgtttgtttgtttgtttgtttgttttgagacagagtctcactctgtcgcccgggctggagtgcagtggcacaatctcagctcactgcaacctccgcctcccaggttcaagcgattctcctgcctcagcctcctgagaagctgagattacaggcatgtgccactatgcccagctaattctgtatttttagtagagaaggggtttcgccatgttggtcagcatgttcttgaactcctgacctcaggtgatccgcccacctcggcctcccaaagtgctgggattacaggcgtgagccactgtgcccagcctttttttgttttttaaataggcactaggagagcaatatctttacattttgttacctgtgaacactcagcacaggaccatataggtaatagtaatggtgattatggtgatggcagtaatgatgatgatgatttagtatgattcaccaacaggttataagacttcagaatgtcacgaactggtgaaaaaaaaatgtatatttttttgtaattgtaggaggcctgcatagagttgaattgctagctttttatattgccaagtaagaatttttttaaagtatgaataccataaactatcaccatctatttcataaaaaaaaaaaaaaaaagatgtaatgtactggttaagagttgtacactcaaagaaattctgatgatacctgggctagtaagctgtgtgaccttgggaaatttaagtaacttctctgcctcagttccctcattgtgaaatggggatgattataactgtaactaccttatgggattattggcagaattaagtgaattaatgaatgaaaggcactgagagcctggcacagagagcacttggtgcctcttatatttttattgttgtcactaataccaaagaacaagacatatataatattagaataagtaacaattctgcacatgaaaactgaaaattcactgcattgttgtgttgttttcttttttatttttatttatatttatttatatatttattttttgagacggagtctcactctgtcgcccaggctagagtgcagtggcgtgatctcggctcactgcaacctccgcctcccaggttcaagtgattctcctgcctcagcctcctgagtagctggaattacaggcacccgccaccccacccagctcagttttgtatttttagtagagacggggtttcaccaggttagccaggctggtctcaaactcctgacctcaggtgatccacccgcctcagcttcccaaagtgctgagattacaggcgtgagccactgcgcccagcctgttgtgttgttttcatcttacttggttataggccagtggtgatctgggagccactggtggaccacactggcttagttagtcttccttctttcctccaccaaaagacatgcagagcgttactgccttcccacccaataaagaggatggtaggtgagaaaataaagagctatactgtaagcagagcaactgggtttccaaggagggagtgtaaaacaaaggatctcagtgtgggagtgtctaaggttgaagctgtcccaaggcaataccttctacccctactctaaattaaaggagtcataactctttgtggttcctgtaaaagtagttaagaggccggcacggtggctcacccctgtaataccagcaatttgggaggccaaggtgggtggatcacttgaggtcaggagttcgaaaccagcctggccaacatggcgaaaccctgtctctactaaaaatataaaataattagccaggtaggcacaagaatcacttgaaccagggaggcagaggttgcagtgagccgagatggtgccactgcactccagtatgagtgacagagtgagactccatctcaaaaaattaaaaaataaaagtaattaagagtcaaagggcatcattacatagagacacaaaatgaaagtcagtattgtatgcgcctttgccctgttttagaccttcttaacatatgggagcccaagtagcccaaccatggtggaagagaagatttcatggcctttctcattggtcctcaccgtgaatatgcagagtaggcacacctctctgcagagaactcctctaagaaaccagattcaatgatctgatgatcccgcttctgctgatatgctagaagccaaggcttttttttttttttttttttttttttcagtagaagaatcaaaagtaggccaagcgcagtggctcacgcctgtaatcccaggactttgggaggctgaggcgggcggatcacctgaggtcgggagttcaagaccagcctgaccaacatggagaaacttcgtctctactaaaaatacaaaattagccgggcgagttggcgcatgcttgtaatcctagctacttgggaggctgaggcaggtgaatcgcttgaacccaggaggtggaggttgcggtgagctgagattgtgccattgcactccagcctgggcaacaagagtgaaactctgtctcaaagaaaaaagaaaaagaaaaatcaaaagtaataacaggaaggaatgtgttagcaactgtagagtattagatgtatggctgaccttccaaccagctagctctctggtccccagccccactccacaacacatcctcaggttcccagttcaaaactttaaggccgctgaaacccaggctccatgcacattcatcattttagccccactttcagacatttatatgttggtgctcatgccaagccaccttggaaaacaaggacaagtatatgttcccctccacctccttcccaccagtacccagcgtgaggtctgtacatagtagatcctccataaatctggtgtaaaacaaaataaaagcaggtgaccttctgtaaccaagatgtgtgtagctacatccatccactcccagtactacaacattggatttttgttgctgttaaatcaaaattttagtctttcagaattaattctctttgcttaaaattaattatgacaggttgtgttttttacacactgctgaaatgtgtaaagcagtttgggagaagagggcctcctttcctgagttgatttatgttatatatgcaaactctattaatgttaaaccatgcttttcaatgaaattaagactttccagcaagcagctctctccattttatttaaagatcctagtgactgatgcacattgtgcccctgttgctacgataggagcggaggatgttggatctgagagatctcatgcttaacccttaagtgagaagtagcgtgtggtgtgggaaggtaacacagctctctcctgtaagcagaaatcaagcggtggtctactgagagccattttattacttccagagaaccctgaaggtgaaatgaaggaggaaatgaaggcaggtgggaaattaaagaaagaggagcagaaatggaagtaagaaggacgtaaaaatttcagtatcttgagaaacctgactgccgaacaaaatgtttgggctgggaagatggagaatgcacggaggcctgcaagaacatgggacagccatgacatgtgggctttgttcttccaaagagataaatgaggccaggcatggtggctcacacctgtcatcccagcattttgggaggatcacttgaggccaggagtttgagactagcctgggaaatatagtgagaccccatttctacaaaaaattttaaaaactagccaggtgtgatggcgtgcacctatagtcccagctcctccagaggctgaggctggaggatcacttgagctcagggcatcaagtctgtaatgagtcatgattgcaccactgtacttcagcctgggtgacagagtgagaccctgtgtaagagagagagtccaggcgtggtggctcatgcctataatcccagcactttgagaggtcaaggcaggagaatcacctgaggtcaggagttcaagaccagcctggccaatatggtgaaaccccgtctctactaaaaatacaaaaattggtcgggtgtggtggcaggcggctgtctgccacctgctacttgggaggctgaggcaggagcatcgcttgaacccaggaggcagaggttgcagtgatccgagatggcactgctgcactctagcctgggcaacagagcaagactccgtctcaaaaaaagaaagagagagagagataaatgaaacatctgctccttaaagcagtaatagcatagtctttaatatcaggaggaagcgttatatgttttatttaaaggttgttgatttatgaactttgtacctgtctattaagagtctggttcttgcatggttaatgtgtgaagttttaaaatttgtgcttctcatgtttaaagcatgatacccagcaaggcttctgacaccagacctttcccatattccatttcatagagcatttcatagaaaatgtttcatagaacatgtcatagatatgttcttttcgtagaacagttatatattctttccttcatcaaacatggattgaacacctattgtgtgccaggtatagtgatgggttctggatgaacaaaacgggttttctttagttctttgtaagtctttgaccccatggaattaaccgcatagttaattccacaggcatccttggtaacatagccccctctggtaacgtagcagaccacagagtgacaggtggaggggaccgaatagtgagacagtcacctgggattctatgattccacgcccctgatgctttgggctgggggagttggctgctgtcatttgtgaggtagagtcgcaacctggtacagcactaagaatccatttccttcttctcagtgactcacttcccaccatctccaattgctctctggtcatagttactatgttgttgtttgccagcagaaacagccatgttgttgtttgccagtttggggctttctgtcaacctgaaagacttccttctctccagccagtttggtcttgcagattttgttgtgaggccaacaaccaggctgtgaactgcctaagcccagccagcccttctttgaaaagccctgtggaactaggtcatcaggttgttggatggttcttacacagactgtgctgtgctgcaacttttaatgtgcactgtctatggaataccaaacttgtttccaaactaaatagtttccaatgaggatttaatgggagtttttcatttgaaatggattgaaaacaagccatttcctactcccatttcaagcaaattttggtccaattattttcctttttttaacataaagttaaatggactattctgcccatccctgactgagctgaaccgtgatttctcttgattatgcttttacactgcgaatcgcgaggctccagagacataatgggcgtctgtgggagagtggcagcaatttttaaaatcctgccagtgcttgtcagcttccactctggtgtctgctgtgcgggaagaaagcaccccaccaaaagaaaaaaagtctgccaacaaaaccagcgctgcccgcctgttctgtgggggttggcacagggatgggctcctctctgcaaacctatgtagggcatattctcagccactgaggaagcccggtttccactcatccagccctactcctcccactgttttccagccattagctttttgtggtgttgaaggtttctttctcccttttttttccttgcctcaatttttcttggtttcacttagaccatagcctcagggaaaaggagctcttggcaccctgccttccacttggtcctttaccttcagcagcccagcaaaatggaaaataagtgtctcatagtccttcttgggtggtaggttatttgttgttgtgatattgttggtggaggtggtggtcattctcttggatttgcagaagtttacagaaaactcgggagaagaaaaggcttcttgctaccatcctctctctttgggaagggcagctacccccctagcagatatgtggggagcctactgggcaatgccttgtaatgggaacagcctctttgctctcttacccagcagtgccaagaatttcactaggcccactgaagaagaaacacccttcaccccagctaccattgtagctgccctaccattgtgtgcagcccgggggaagcacacagtcgtctctgggtttctggtgaaagtccattgtgcctgctcagggctccttggtgcaggagcagtcaagccttcctggaggttgaagatcacgtgctgtgtttggtggctccccacttgggtttccatcgattcatggtattggtttgggaggtgctcacatcctcctgcaagtaccctgtagtgaggcttactctgaggatgcagctacatctcaaaacatgactccacctcttcctgcaaaatcctgactggtacaactgccagcacatccctttgaccttgagaagggtaaagcacagaggtggtaggtgacttcattagcatgacagaacgtcagagttgattagcactcaggaaaggttgtctaatgccagcctctgcctttgtaaatgtcttcagcatcaccagggaggggttgatctggtctctgcctgaacttgtgctggaaaacagttctgagcaggcaccccatggaaacctctaattcatgcaaaagtccccccctatgaagtgaagtctgtttctgttgctttttcccactggtgctaccccttcctgagtccacgaaatctaaatccagtcccctttctacctcttatccctccaggcatttgaaagcaggtacttattcctagctaagctttccttctctaggcctgctttcaggtctttcagccatccctcctattgcttggtttcccagccctgcatccttctaattgccttcttctagacatgttctgatttgttgttctgtttgttctgagctctgaggtacccagaatgaggtgagagactgtcacagcccttgacagagacccatgccaccttttagtgaaattggctgtttcgatagccttaaaagggtcgttcatttatttcaagtttaatcgagtcattcttcacatacataactgctcaccttatctgctccacgtatatgtgtgatttgtcattactgaacctatgtgcaaaccacatttattcctaaagatcatcttatcaggataagaaggaacatattcatttctttagtctgcaaagatatgttggatctgtgttttatgatccaatatactgctatttccagcttcacatcatatgcaaattcagctcaaccactgtgtgccagacattgtgctgaacctggggatacagcaggaaatcagacagcacagttgcttccctcacaatttattgggagggacagacaattgactgtgcttttccaatccagggtgacagcacaaaagaggggaactgcagaagcgtagaggaaaggtgcttcacagactcaggctttctaggaaatgtgatattgtgagaagttggccaaggaaagagctagggattaaagtttgaggtaggcagaactacatatgcagtgtttgaaaggtgacaaaaagcacggtgtcttcaacagcttatcaccaggtaatgctcctgatcctcatcagtggctgatgtgaatgtggaacctaataggatgaaagaaattaccattagaggccttcatcatctgccttcgggcacatcaaacatttatgaactcacctaattgtatttttgtcacagccacgtttctctgccttgaccacttgaattgcatgtgaaatgtatttatgtctcactgaatacagacctgttctgtctatgtcattgctcaagtttaccaatctaaaaaaaaaagacttgttcttatgacttgttcttcataacccaggttggctttgagtgatcctaaaagcttccttccttcctgagagttcactagctctcttcctaataatctgttttattttccaagtcattggttaacgtagtaggttagtggcagagttgcacctagaccccaagtatctgaactcctagtctagacatctttcctttctattgctctgctcccccttggctcatctttccagagcagagacactacacaaggtttttttaagagcagctggtcagtccctgcatccaatgtaggaggcagcaagcaaggctagcagttacgccagggagaatgcaaagtggggtgtcctctttccaggcactggcgcaggccagctacatggcatttcatctccttagcaggcctctggggtaaactttatgtgttaaactttatggttaacagagccccctgctattcattgtctcctttatttatcaaccagccccatgaagtcagtggggaaatattcttgttcccatttagcagatggggctcaaagagtagaagagacgtgcccagaggcacacagttatactgagtagctgagccaggtgtcttaaatccaggttgtctgacttctggtgccccaagctgacttcagatttcttttcttcttatatcaatgatggcatcaactccctgacctcccccttctccagaatgttgcctgggtgattgggtaagaggatataaatagtaagtgaaaaaaatagattcagttccaagcactaaggggctgagacaactagacactgtggcagtgctacagacctttagatcatttttctgacactctctagctaaaaaggaacatggacaagtgacacccaaaagtccctaggcttaaaccaactgtcttgtggaaatataatataagtatgagctattctgagcaggatgacaggattggaattcagtaaagttttagatggactttgagatccaaataagggaggagtattataaagagctctataaaaatggtttaaggaagggtgtggtggctaatgcttgtaaccccagcactttgggaggctgaggtgggtggatcatttgaggtcaggagtttgagaccagcctgaccaagatggtgaaacctcgtctctactaaaaatacaaaaattagccaggcacctataatcccagctactcgggaggggtggtggcgggcacctgtaatcccagctactcgggaggctgaggcacgagaatcgcttgaacccgggaggcagaggttgtgctgagctgagatcgcaccactgcacttgagcctaggcgacagagtgagactccatcttgggaaaaaaaaaaaaaaaaggttaaaaatgccaagctagcagagagagggactcagacacacacacctaagttgttgctccagcctaagctggcccaccactacctgactgcagtttgttgcctgtcccgtcatgcttgccttcaaaatgcctttggattgttcacaagctcaggagccatgggcctcctcctgttgaggggtgtttattgtctaaatcccttacatgtgaattaaaaataggcaaaggtaaaaaggcaggagttttctaacaggtatgggagtgctgtagtaggccagtggcaaagactatcgccattttctttgcctgggacttgttgagtctttgaagtctacctgaattccagagtctagggcttcttgattccttagcaagagcaaagggatgtgtaccctctctttcaggctttggtgaattagaccttgagacttcataattaaaatggatttaatagaggcagggaagctgggatgtctgccccagtaagcaggcatcttctgtcagaaggagaatgtgtcctttgtatttaaacggtttctccaaaaggctctaaatgagatttgggacttaaacaagatttggtgtgatttgctaattacccaagttactattacctgattaacacaggaatcctcatagtctgttgcagtgcctttcttccgggtgccaggaggcttgacatctgtcacctgttcacttggaggcattttaagtaacccaaattatgtatgtcttttctgctttaggatttggtgcctgatttttacatttaaaagttaataactacctaaaggaggtttgctgccaaaatacaagagtgaaaactgacaaatctgtttgttgctgacagtgaggtggagatcttggtttattcattccaactagttaggccgagaaatgatacacaggacagtacagagctcttcctggtgaccatcacaggcatcaggaataaatcccctcaaatctcactttgccccaccaaccttaattgaggcctccgcttgagcagtgacagaactggaagggttggaaccagaaaagctaagtgtctttctcaaaatcacacaggcctgcagttaggatttgtctttcgttgttttttattttcaagataataaaaggtttccactttgaccaccaggagaccatgctgactttcatttcagagatggggcttcagtgtgataaagtgatctaggttagagtcttagcaggtttcccttgagatctgaatggctgcggggtgtgctgggggctctgtacagcagctgttaacagttttctccttcccatgaagacggcttatttacctgggtctcagttctgaagattgtttccaggtatgctgtgtactgaagggactgagcgtgatccaaggagcctgggacctatgtacttggtgaccagactctcctctccaaaagcagggacccaggggacctcatccagcatcctgagaagcctcgctttggacaggcctgaaatttcccttccttcatcctagctctttcatccaagacagtgattcgggaaacagtatttcaaaattgaaattcaggccttgaatttcaagtctagaagaactgtccaaatcatcggtaggaagagcttggaagaaagggaaagtcccactgtaatgctaaaagagagccacccagccagggatggtctgcatccagaccagagcacaggtcaaagggaaagccgagagcagttccctaagttctggcatggcttttggacgcaaagcagctgggctgcgggcatgctgtaaggacagaggaccctttagggttccatctcttcggagagaaagtccctgctgttccagttcactgagtgtttaagaggaaataacggcctgaggcataagccactcacccatataaagtgaatacttcctcaagggcacaaagagaccacttggtaaatgacttcacccacctgctttagatggtgctccagtgcactgagaatgttaacctcattcacccttctgtggatgagcagattattcctagaaaatggtccgttcatgtttgaccaggcatagccccactgtgaatgacaaagtcttttttgacctcccacgatctttctccctttctgtctcagccaagccttttcttctggaaggagctactctcttttggctagacgatcattcagaggagtcacctctgtccctccccctactgatacatctcagggtctcagagccgtttatgttcccatttttgcatcttgacatagggatgcaaagatgggaacatcaagcatcagttcttccgagccttcatagaaggagtggggggagtgggtagacatggagatgaaacaagactggccatggactgatcattgtgtaagtctggaaatggttgcacaggagttaatttaactactttgtttactttcatattggtttgaaatttcccataacaataagctaaaaacagatagtaagggatctcaagtgtcttgggcagtggttttcccattgccacaatatatgtggtgaatgggcattatctgcttggaaaattaacaaaattaaaatttacatatagatcagtgaaaacactgctacagagttaacttaaaattttagctgggtgtggtggctcatgcctgtaatcccagcactttgggaggctgaggaatgtggattacttgaggtcaggatttccagaccaagctggccaacatggtaaaaccccatctctactaaaagtacaaaaattagccagacacagtggctcacgcctgtaatcccagctacttgggaagttgaggcaggagaatcgcttgaacccgggaggtggaggttgcagtgagccgagattgcaccactgcactccagcctaggcaacagagtgagactctgtctcaaaacaaatcaaaaaatttaatataatatgtgttcattataaaaatcattcagggccaggcgtggtagctcatgcctgtaatcccagcactttgggaggccaagatgggcggatcacgaggtcaggagattgagaccatcctggctaacacagtgaaaccccgtctctactaaaaatacaaaaaaattagccgggcatggtggcgggcacctgtagtcccagctgctggggaggctgaggcaggagaatggcatgaacccgggaggtggagctttcagtgagctgagatcatgccactgcactccagcctgggcgacagagcgagactctgtctcaaaaaaaaagaaaaaaaaaaaatcattcaggtacagccagagagagccactgtagatagtttgaaatccaaagacgtcttatgtgggcattacccacagatgtgcatgcctgtgcagcttaattttagattttgttttcttttgctttgttgttttgtgtgtttgatttcttttcaaatcagatttatgtttcttaccagctcgttttaacaactttattcaaatataatctacatgccgtaatattcacccgtactaagtgtataattcagtgattttttagtaaatttatagcgttgtgtaactattgccacaattcaattttagaacattttcatcattccagtaaaatccctcatgcccatttgcagttagtccccattaccactcccaggtcaaggcagccacgaacctattttccatctctctagatgtgctttttctggacatttcatataatggaacaatacaatgttggtgggtttttgttttgggagactgagtcttgctcagtcgcccaggctggagtgcagtggcgcaatctcggctcactgcaacctccgcctcccggggtcaagcgattctcctgtttcagccttccaagtagctgggattacaggcgcccgccaccacacccagctaatttttgtgtttgtaatagagacagggtttcaccatgttggccaggatggtctcgatctctccacctcgtgatctgcctgcctcagcctcccaaagtgctgggattacaggcgtgagccaccgtgcccggccgtaatgtgtggtcttttgcatgtggcttctttcactcgtcctaatgttttgaggttcatctacattgtagcatttatccataatttgtttccgttaattgctgaatagtattccattgtatggatataccacgttttgtttatctgttcatcagcttatggacatttggattatttctacttttttggctattattaataatgctactgtgaacactcacatacagctgagtggacatgtgttttcatttctcctggtagatacctaggaatgaaactgctatgtcatgcaataagtttctgtttaactttcttaagatactgccacactgttttccaaatggcagcttcattttacatttccccagtaatttaggtgcttctgatctccacatcctcaccaacatttgctgttgtctgacctcctgaacgtgaagtggtatctcattatggttgtagtttgtatttctctaaggatgttttgaaatggggaactgtgcgtcttccaactttgttctttttcaagattgttttggctttgtttcctttgcatttccgtatacattttcatatcaccttgtcgatttctacccgcaccccatccctccccgaaagtctgctgaataagggtgttgagcatcttttcatttgtaattagccatattcttggatgaaatactattaaaatcttcttcccactttttaagtgggttgtttatcttctaatagacttgtaagaattctgtatatattctgtatataagtccattatcctgggtatatgatttgcaaatattttctcccagtcagtggcttgacttttcatatccgtaatgctgacttttgaagcacaaaaggttttaattttgttgaagtccagtttatcagttttttttttatggatcatacttttgttgttatatctaagaactctttgcctaacctaaggtcacagagactttcttctaagaagttttataattttaactcttacattcatctatgtggctgaggtacttttttgtgtatggtatgaaataagggtctagttctgtgttcctgcatgtggatatccagttaccccatcactgtttatcgaaaagactattctttccccttgaaatgcattgccacttttgtcaaaaatcatagacaataaatacacaggcttatttctggactttcatttctattcctttgatctatatgtctatccttatgtcagtaccaggctgtcttgattactatagctttgtaggatgttttgaaatagggaactgtgcgtctcccaattttgttctttttcaagattgttttggctttgtgtcctttgcatttccatatacattttaggatcatcttgtcaatttctaccccccccccaaaaaaaaaaaagtctgctgagattttcatagggattacatttaacccacaggtcaatttgggcagaattgcctttttaacaatattgagtcttctcacccttgaagacagaatatctcttcgtttatttagatctttaatttctctcaacaatgtattatagtttttggtgtgcaagtgttgcacttcttttgtgttattgtgaataaaatttttaaaatttctttttccaattgtttattgctagtatataaaaacattgattttcatattggtcttctatcgtatgacagcccaatttttttattagttttaatagctgttttgtaaattcctttatcagatttttccgtgtacaggatcatggcatcttggaatagagacagttttgcttctttcttgtccatatgggatgacttttctttttcttgcctgatacagaattttaggaattaaaactcatccaaagtcatgccaaagatcagtgattatacttatgatatcaatgaggagacaaaagaggcaacttttggaattttaaatgagccttacagaggcaaagggaagaatgggtgactgcattagcaaggaagtaaaaataccactctacagccagacatggtggctctcacctgtaatcccaaagctttggggcaccaaagcaggagaatcacttgaaaccaggagttcaaggttacagtgagctatgatcatgccattgcatttcagcctgggcaacagagtaagatcctatctcttaaaaaattttttaaaaagccacttcgcattgactcaggtttcacagtgctcctcttagtgggtggttatttcagcaacctgaccagaacagacaagataagccctgaaacaacacgaaggagccctgagtaggaaaaggtagacaccacacactctccaggctcatttatgtaacccactggaagatctctggtctatacagaacctcatcttcatgtctacctattgttttaaaaagcattggcacttggttttctagcttgttgatggttttgttttgtttttgcagctatactttaggaaaggtgttagagaagagacgaagtaggacttgaacataaaggatgccaaaaagtgaaaggacagtagctgatagtgagggggcatattggaaatgcatttaaatatcccatgtatatttcctggacacctacagggacaaatcttatgctcaagaatttaaaagcaccactggtaggtcagtggaaggcaactccccagacttgataaggtctgaggacattggctgagcaagccaagactccagtgacgccatccatttcttttgtggctgatgaatcagattcaagtacaatgctttataattatccctatgaaattctagcatgttagtgtcgacccattattctagtccttcggcacctctttggattctgattctggttttatgagttgaagattaataactaagctttgaaggatggggggattgccaaaaaaaataagctgaacagtgctttttttgtgataatcctgtgtcctcaaagaagttaagccccatttgctgcagaaagaactcattagctcctgtagcttctaaggaggatcctcatcaaagaatcttttttaaaataagtatgtaataataaaataaaacccaccatctagccaggcttcttgctattggagtgggaatttacagataaactagggaggaggctacactgatgcatgtggtaatgggttagagttaaaaatatcagtatgagctcatgtttagcttaacatagatacaaatagtcacatatagaaatctttacagatctgtgcatataaaagggttagtacccatatgtatttctgtgccctgacaactgagatggcctgaaagaaacggacaccccagtgtcaacaagcacaccttcatctagatcttggttcctattaccattctccaataaaaagaactaggactcctgagtgaaatggttgcttctggaactcaggcaggaatatacaagatgaacctggagtatgttatggtgccagaaagtaaggaagtcctaaaacaaaaaacaaaactcacactgataggggcacatcaaagaaacacagaggccaactgaaagagctaatggccactcctggataattagagcaaaacaataaggaagcatcggattataacccaaagtataaaataaatatccatgactccatactgatagaaataaataaatggaggagaaggaacaaacctcccacacagaagaattccaagtaatttacacagatacctcaccctcaagcaggggaagcataatgccccactccctcaatgtgagttccaggtagtggctccttcccaaagagtagtaggggagggggaggggagtccattgacagtggagagaccttcaacctggtgaccaaggacaatatcagtagtcacaaatcacattaatagaacagaccattgatacaatgtgaaaacaatggcatttcacctctgtagtcttcctcccaaaaacctctcaacccagtcttaatcatgagaaaagcatcagacaagtttcagtaggggggcattcctatagaatagctcaatattcctaaaaaatgtcaaggtcaccaaaaacaaggaaatttgaagaaactgccaaaagaaccctaggaaacatgacaactaaatgtaatgggccaccctagatgggatcctgggacagagcaaagatactaagtacaaattaaggaaatctaaataaactatggactgaagttagtagtgctatgttagtattggttcattacttctaacacacatgacatactaatgtaagatttagtaataggggacactggatatgaagtatatgggaatgctctttgctatcttctcaatttctctggaagtctaaaattgttcttaaaaagaaagcctatttaaagggaaaaccaccatcactaccaattttgataaacttgaagggttagcatcaattatctggaaaatttatttgtgagaaaaccttattcctttatgatcattgataagtgaagcattgctgaattatctctgcctctctgagcaagttaatactatatttttaagagaagaggagaagagaggggagggagtagggaaaagagtatgtgtatctttgtgtgtgtatgtgcgtgtgcatgtgcgtgtgtgtttaaacaagagaaaaagtgaattctaaattgttaaaaccttggagtggaacttaatctaatttatacgcagttccactagagatgtgcaaggatttttttgttgttgttaaagagaaaaactagtttcaagcattattaagcttttttccctcccagaagctaagaaaaccatctgtgagaacctgtttgcatgtttgttttctacaataaaatgcaaaatacttcttcctgttagcggattataccatatgtctctccctgtaacaaaatcagcatgtttattaatgaacccaatcagaggcaaagatttagaaagatttaaggaactgaattttccattcaatatttcagcaaaagaaacttctggttagacatcgttgttgtgcttggaaaatagaaggtttgtttttgctttgaactcaatttacttggcaggggacagagagcaggaagagaggcctttgaaaattttcgtaaaaaaggtctgcatttagaaatggcccttcctgcctaatgattcccctacggatttagacctacagtttatatgtgactaatatttaatttgatcagttacatttttccagacagactaattaaagtgcttgatggcccagatcccccaaatctgaagcagtaacaggcctgtgggcttcctggagtaacaggaagtgaatgaagtagtttcagccatattgtcaaagcaacccccatggtactcataatggaaacatgtgaattttccagcacaaacactttcctcacagccctgttgaccatctgaataatcaaatagattggtagcactaggtatagcatagtgtattagaaagaaatatgtccagccagacccagcactgcagttaaagtactggtgctgtcacgagccagcagaaggcctggagcaaatgacgtactctctctagaccccagcttactcctctgacaaatgaggatatcagctctgctgttctcttgtttctgacttgtagaagaatggacttgtcagcagagaccgtaagcagtggaaatcccaaaagccagacagaccctgtgcgtattttaggggatacattctgttctggtcattcagccttcacccaagccatctttttttctatttggtggcatagacacagcccagccaacctaattctcattttattgcattcattgttcatgtgccacagttttttagaaatcttacaagaaaatgaagcacctattaccaggacaccactgcaagggggaaaatgacacttgggcacctggaaggacaaagacaggcagtggaggcatcatggggttggattcgagtaaccctctgccttcttcctggggtctgttggcagtgtttttgtgctgtggtcatgatacacacaggtctcacaaggcaggcagccaagtgttgactctgtctttgtaggcaatacagaaaactgtctacttgttccagtgagctaaatcaagtgagaacaggaaagaggtttgtgcaactttggcaactatagcaggaaccactttaaatgggacagggcaagtaatgctaaatatttgcaaggtgatttttttttttttaagactttaaaggttgtattgggagaccttgagaaagaggcctttctttcttttttttttttttttttttttttgagacggagtcttgctctgtcgcccaggctggagtgcagtggtgcgatttcggctcactgcaacctccgcctcccgggttgaagcaattctcctgcctcaaccctcccaagtagctgggattacaggcacgcgccaccacacccaactcatttttttttgtatttttagtagagacggtgtttcaccacattggtcaggctggtctcaaactcctgacctcatgatccacccacctcggcctcccaaagtgctgagattacaggcatgagccactgcacctggccttttttttttttttttgagacggagtttcgctcttgtcgcccaggctggagtgcaatggcgcgatctccactcaatgcaacctccgcctcctgggttcaagtgattctcctgcctcagcctcccaagtagctgggattacaggcgtgtaccaccacgcctggctaatttttgtatttttagtacagatggggtttcaccatgttggccaggctggtctcgaactcctgacctcaggtgatctgcccacctcagcctcccaaagtgctgggattacaagcgtgagccactgtgcccggcctcttttttttcttttcttttctttcttttttttttttttttttttgaaacgaggtcatgcatgcaggctggtcacaaaccaaaaaggccttttgacaattcaactacctcaactctgggatgggcatttattaataacccccaacccacccaagtcctccaaataccctgccatccaggggaaaacacataaacatcaataaactgcatgtccccaagggatgctctttgccccaggatagtctggcctctcgggagatttctcttacctccagggctttgtttcaccagagaagccagcctggaggtagaaggggaagatacttagcagcaaaatctgctgccctgtgcagccaggccaggggggcagtcaggggctatacaggctgaaaagctgtccaggacccagagctatgtgactcataaaggcaggctgcccacccactgaaggtctccaagtggcagtccagatggacagtgatcagctgtcacattggacggttggcctcctgtgatgacaacactgtgccaaggaggcctgggttgaagctttgagcacatgttaattggcttagctctattccaccactgtagaattttttagttcaattcagcaaatattccctgggttcctgttctttgccaggtaatagagctggacactgtgaatgcagagatggataaaatatgtcctttagctgatggagagaaaaacatgagcaaataaatgtcatttactatgaaagatactagagtatctggaaagaacagtggagacagagaagggatggatggctgaaagtgtgtggttaaaacagtgcccacccatcttgcccagacacaaaccactcaaaaccaagaccctgttggaggaagcattcctgtgagtttattagagcaggatttcctgaattcttcctaggaatgttaaaagataaaatttgaaaaaaggattccaagagcaaataagtttgggaaatagtgagttaaagttagacaggttgctttcattggtagctcatgcttaagtgcagaacttctcaaagccttgagtatgctgagcacattgtgtgattaccccaggggaggagatggtattgagaattttgacttgggagcctttttccagagttacctccttggacctgggaccctcatattcttggaccctggcacagtgtcctgtctggagctgagagtttgcagagtggccttctagtcccagcactcccactgtgactgaaactgtttggctttgggaagtctaaccttctctgatgttgtttcctcattgtgttaggcaatttttgcatctctataaagaaatacttgaggctgggtaatttataaagaaaagaggtttcattggctcctggttctgcaagccataaaagcatggcactggtatctgcttggcttctggggaggcctcaggaagcttttttttttttttgagacagagtctcgtcgctctgtcgcccagctggagtgcagtagtgcgatctcggctcactgcaacctctgcctcccgggttcatgccattctcctgcctcagcctcctgagtagctgggactacaggtgcccaccaccatgcccggctaatttttttgtattttttaatagagacagggtttcaccttgttagccaggatggtcttgatctcctgaccttgtaatccgcctgccttggcctcccaaagtgctgggattacaggcatgagccaccacgcctggccaagaagcttctaatcatggcagaaggcaaagcgggggtaggcacatcagatggtgatagcaggagcaagggagagagagaggggcgatgccacacaccttcaaacaaccagagctcatgtgacctcactcactgttatgaggacagcaccaaaccatgagaggtctgccctcatgacacagatacctcccatcaggtcccacctccagcattggcaattacatttttaacctgagatttaggcagggacaaatacccaaactatatcactcatctagaaaagaagggaagagtgacatctgcctatcttgcagtattgttgtgaaataatagatgtgaaagcacttcatactcataaggactgggattgtcattgctgggttgtgacaatcgcagctgtgatcaagtcttcgaggctttagttacttgactgccttgaggttgtggcctcttgttatgcctggaattctcccttccttcacttctttacccaccccttgagatacttcttataaccatcccctaagttcaatgttggtagccctgagacttctgtccttggatcccttctcttgagaccatttatctcagagctccatgtgtcaacattacctgtcttctgataaccacccagttttctgtctctagcctttgcttctcccttaagttctggatccaaatgtccaacttctccccagataccttgatgtaattatctcaagctgcatactagtgcctcaaactgcttgcccttccccacacactgtgttccttcataactgggtgtcatcttaaaagtacttctggtaaactcctgctcatccttcagaacccaactttagtctagtctcctcttggctgacttcctcctgtgcgctcccagagaactttgtacctacacctaacatgccacttctcacactgccactgtggccattggtgtagttttcattaagtcaaggactgtgctttatttgcctttaaattctcatccttgagcagagtgcagggcgggcagtaagtctaattggatgcatatacctcattctagtcatgcccatgcagcagaggggagtttcatctttaatgccacatctggctttacactagaggcctgaacctgccggatgcacaattttgttcttttccctgctggctaggatttgcaggcacccagaagctgaagaccctcggggtctccagaggaggtcacatgtgcctctggccacagccacccctggactttcagctggccagtgctcccagctcccagcccttggctggcagaggtgagcaggagtcccacccactcctccccagcttagccgagtcatgttgatattctggcggcatagtcaggcttgttattgagcacatgctttgcagattagcctgtttgtatagccaatcgaacatgtgctccattaaaaattaaagcatcctgttttaaggatggagcaggagacatcagctgccactgtgtagcagacatgcaaagccccagagcccattaccataggttacagcaaatgttaatcagtgccagtgcagttaaataatgcagtttgtgcagatggcagctactacatctcctcacagatgtgtcctcaagtcccggaggctgctgtatcacaggagttgtcgggagcagtcagatctgatgctgactgtcaatatcaccttttgtgtttgtgtgcatcctccagccagctgagaggcaacgataggatgactccaggccctacttccagcagcccttccagagctggagcagggggtctgtgcagggctcacaggagagcagaaatatttcactaaatcgccaagaacactcagagtaaagctctgcagtctgctccatgaaactgtacccagctgcatcctgcaagaggcttcccagccaggtggagtggggatggcgttcccaccttcactcttcactgctttctgcttgctgatgggcaagaattccacaagtattcttcctggcttccataagcacagggacacctcactgtatcagaagttggagttctgacagcacctactgtgcacagggcctgattctgaatggcaaagtgctgttcccgaagcccaggcacttggctctctggtccaggtgtccctaccctccagcccctgaacagatactctgcgtaaaatttaggaacaaatcgccactcatgctgccagcagtaagcagcaactgttgtggcaagaaaagaccaaactgtttcaactgtcccagctcttctctctctctgtgtacttccttactagcagctgtgggggacccttccatgaaggggcacctagagcactgacatccacatgtgggcacctgggggcattccatctcagccactgtcaggagcaggcacagtgactggtccccatgaaggtggcctgttatcaagagaagatgaaataaagctcgaggtaaccaagtgtgggaaacttgtatggaagcaggggagattgctcttgatatagttaagtgttttacttaaaggtgtaagcctcagctttctgaaaaatatgctactgtagaacaactcatttctgaatagcatcaaatatgtgaggtgaaaatgtacttatgagaaaaatagttaaaagtttattcatcctatttcctttctaggttgtcagactatgtgctattcttcattcctagatgggaaacattgcatcttatgaatgtaacgtgttgctgtagacaaatattcttgtggagtgaagcccagggacaagggtcttttgctttccttgcaaaatgtagagacattattcctgtttcacctttgaaggccatgccatctgataggccatgccatctgatatggtttggctctcaccttgaatcgcaccttgaattgtaataatccccatacgttgtgggagggacctggtgggaggtaattgaatcacaggggtgggtctttcctgtgctgttctcgtgatagtgaataagtctcacgagatctgatggttttatagaagggagtctccctgcacatgctccctctttgcctgccgccatgtaagatgtgcctttgctcttccctcatcttctaccatgattgtgaggcctccccagccatgtggaactgtgagtccgttaaatctctttttctttataaattacccaatcttgagtgtatctttattagcagcgtgagaacagactaacacaccatctgatctgatggcttctacccttcctttctttctttttttttttttctgaggcggagtcttgctctgtcacccaggctggagtgcagtggtgtgacctcagctcactgcaacttctgcctcccgggttcaagcaattctcctgtctcagcctcccaagtagctgggactacaggcacacaccaccacacccagctaatttttgtatttttagtagatatggggtttcaccatatggtcagcctggtgtcaaactcctgacctcaagtgatccacctgccttggcctttcaaagtgctgggattacaggtgtgagccaccactcccagccagcttctactctttctttacttcccagtctcaacatcatttgtggaagattttagcaccgactcactcctttccttccattaaactcagcaatgacatgagcagctcatctgagccccaggcctctggattcctaacctccttacctccagtggtctttcctttatccacctctgccccccattcccattgttatgccctacgtcttgtcactacctataatgatgtcagtttcaaaattgtgatttccaaaccattagctgcaaagagttcaaggaactgagaggccaggatgctcaaaacccaccactggcttcacaccacacttagaacaaaggtctttcccctgctgtgagcctgcctactgctctgacttcgtctcccactactctgctccagtcacgctggcctttggtctggccttccaacaagctgagctaatttgcaccacagagattggttccattgcctgaatgctctatcccgttatatagatggtcgcttggcttgttctctcacttcattcaaatgtcatctccttggagagacttccctgactaccctattaaaacaacaacagtacatcccccaccccaaatcactctatctacttatccagctttgctcttcttcacagcactgagccaacatttagacagacacacccacacatccatatacatctatattcacttacttactgcctgtctgctccattgaagtgttggtgccacaaggacaggggttttgtctgtcatattcgctgctatatctgatgtgcctccaatggtcttccattggaaaatcaattgaatgaatgaaggaatatgtttgggctggaagcaaatgttggaaatggagttttaaaacaacagggttattttttaagctttctaataaactttctatcaaaagcatttttcaattattaacacttcataaatgaacaaatttcatcttctcaaagttacacttaggtgccaactagagaaagcagaagaattcattttcttaatattttgtgaaatccaggatagattattatttcaagctataaggcttccagcattagccttgaaacctcatctttattttgcttcactgctaggtgtctccttttttgtttttcctagaacttttgtttgacttctaattttgtcctctgattgaggactgaaacaacgtgtaataatctcacaccaggcaaatatagttgaaatttttagtggatttgattacattcttgaaagtggcaaaatcaagtaaaagcagatagatcagaagattgaaagctttggcttacaatcattctttttactttttaggatgtaaatcatcgtattggtcctttttactttagacaaatatgaccccataaagttttaaaagtttgtgtctgtgaaaaaaagcaagatgaattgtctctcacttccctggtttggaagagaagttccaaagcagggctgaactgtcatcatcatctaataattttcctttagttttcatttttcctttctaaatcttagcatgtgagatcacaggctccctctccaaactcatcagttgtctcttgttttaccagtaagaactgaacccctcatctcaaccagtctgtcaccaaggcacttgctccaaagactctgtaccagtcgagatgcttttagctgcaagtaatagaatgcctcatccaaagtagccatagggtagccatagggccaagcacagggactcacacttgtaatcccagcactttgggaggctgtggtgggattgcttgaggccaagagcttgaggccagtctgggcagcatagcaagatcctgtctctacaaaaattttttttaattagcctggcatagtggcacgcacctgtagtcccagctactcaggaagctgaggtggaaggattgcttgagcccaggagtttgaggctgcagtgaactataatccactgcattccagcctgagcaacagtgatgagatagtcagaggtaaccagatgtgtattaggctgactcctaggaagctttacgttaggttgataagatggctacaagcatggtatctccacaccatatacccaaggagggaaggaaaagggcagacctactccttaattgtgtctttctttttagcaggaaggaaaatcctttccgggggtcctgcagcagattgccccttacagataatagccagaactaggtcacgtgttgataaggtttagatacttgttcccttcaaatcttttgttgacattgcatctccagtgttcgaggtgggcgctgggaggtgtttgggtcacggggtggatccctcatgaacggcttggtgtcctccctgtggtaatgaatgagttctcactctactagttcacacaaaagctgcttgtttaaaaaagcctggcacttcttcccctctcaccacgtgccctgttgactacccttgccttctgcctcgagtaaaactccctgaagccctcaccagaagcagatgctggcaccataattcttgtacaagctgcagagccatgagccaaataaacctcttctctataaattatccaccctcaggtattcctttatagcagcacaaaatggacaaatacacatgggtgccacaaaccagtcactagcaaatatagattagaccacttggttatctcctggcctggacacatgtcactttcctacctgaacaaagttgatgttttctaataacagagaatgaaggatgacaagctgccagggtcgacaactaacaatgtctgctacagcagtacaacccgttactcctactgaaaaaactcactccaggtggaatagtagcttatgtcagggtctgtattgataggccagtagattataaagtatttggaagtgatcttagaatctctgctcatttatgtcaccactgtttcatttacatacctctaggatagcacttaccacgtggcatcatgattccatgtccacaggtctgactgttcctaccagattgtcaccaggaaccccttatttctttgtgtccagagtacccaggataatacttggaacttaatagaggtagaggctcagtcggtgtttgctgaacaaatgaatgaataaactaacaacaaataatgaataacatattcctgaagccatgcgttatgaagaacagttggaataactataggtgtttacctggggaatgaatgaatgaatggacaaatgaataagcaaatgacaactaagagatttttggagcggtgtccaatgaactgttgaaatgacgagaaatgttgacatggagaagagatttgaggaatacagtgactttttgcaacgcaggatttaaaagccttttaagtgaaagagagatgagacttactttgtgggatctttaagggtagagctaggaaaagtgggctgaaactacaaggagacagaattgtaaaactaaaatctaaaagtggagctatgtaaagatggaatagactgcctctggaaagaatgagctcactgtcaccaagcagagagtggctaggcatactctcaggcagtggtaggattttatcattgaagattggacttagataagaatgatacttattccctggtataactgggggtcctccctcgtagtgagggtattctctgaaagtatgaaaaattaaacttttaccacttaatgttaacatgaaggaggtatgtggtagccctttccaaagtaccaagagactttatgatgctatgagacatcttggagtaatcccatctgtctttattattcccaattacatgtgccatttccctgttgagctcatttctgatagaagaaatgttttttaaaagaaaacgatgttaatagatgtcactggttttgtctgtcttaacggattctgtttctcacttcaggacattatccagtttatactttattaaaattggcctcatgcacccttgaggtgagtgggtagagaatgaggagaagagcctcacttcccggagatggcggagagggattgggcccaccaggtattctttcaaatgggctgccttactgcccacctgcaggactgaaaatcagagaaaagcggtggaaattgagaaactgtaggacatcattcactctcgtaattacagtgaggaagtgtgctgcatatgtatgttccctcagtaaaacaggtgttctgcccttaaaatgctaattatagactattgcagatcaatgatcttcacttatttcatattgctgctccattttttccacatttaactaccctgtgatatagaaagcttgctcacccttgaaaaaatcaaaatgcatatggattttctgaaataagccccttttctggaagtattttgtggttagtttcaaaatgcaatatcctgagaaaggtttaagtcggctttttattttaatatataataaaaaagtaaaatcactaggcaatgagcaattttacttccattagcctaatgtctttgtggtttcatctgaggtcactagtagattatttttcttgcattatttcatcagctgtcagttctattacaatcatgtaattcattcagtgctgtgatttttcaaagacataactgtaagcttagaagacagttttttggaagtttatttagatgattgtagggtgtcagactgcctcaatcttctccatgctcagtgtctgaagggtcaccaacagattgtacatgaccttagatgctcgagtaattatcaccactatgtttttatacccagcacataaaaatatatctgcactttctttatcatcatcttttgaaagactgtggcctgcctatgggctgggcaattaggtttactacttagattacaggatacatgatacagctcttatttaacaccaacaataactctttttaaggtggtttcatttcaagcttagtctattaatatattcaccattgggctttgattacaataatgcagtttatttatgtttgcatatagtgggtatcagtcaagaaatcatttgaaaatcattcactgaacaccagctactcacagcttgttagtttctggtggttataaaggaattagaaattctctgctcttgaacatattattgtgatccatcaaagcctctagcaaagtagtcatttagtttggtttttgtgaggtttttttagtacgaggataatttttaaatattaaaaaaattaggccaggcacggtagctcacgcctgtaatcccagcactttgggaggccgaggcggatggatcacaaggtcaggagttcaagaccagcctggtcaatatggtgaaaccctgtctctactaaaaatacaaaaattagccgggggtggtggtgctcgcctgtagtcccagctactcaggaggctgaggcagaagaatcgcttgaacccgggagggagaggttgcagtgagccgaggtcgtgccagtgtactccagcctgggcgatagagtgagactctgtctcaaaaaataaataaataaataaaaattagaactctacatagtaatagtttacctttattatcttgtaattttaaaagtacaaaatgcacatttaagatacatgtgcataaaatgatatgtctgggatttgttttaaaattatctggaaaggtgggagtagtgggaatgggtagatgaaataagactggccatgagttgataattgttgaagctgagtgctggtaggtagcagtttattatacagttctctctacttttatggaaattgttcatttaaaaaaaggaatagaaggttactatgcacagggagcagtggctcaggcctgtaatttcatactttgggaggccaaggtgagaggattgcttgagcctaggaattcaagaccagcctgggcaacatagggaaaccctgtctctacaaaaaaatacaaaaattagcccagtgtggcagtgcatgcctgtactcccagctgctcaggaagctaaggcagcaggattgcctgagcacaggaggttgaggctgcagtgagccagggttgtaccactgtactccatcctgggtgatagagcgagacactgtcaatccatcaaacaatcaataactatgaattcagctttgcttttaaaaagaaaatatattttaatgatcattgaagcatttccatatacttgaaaaatattaataattgtatgagaatagcatataatttcctgagactatagacagagctttgtgctcatggactctgaaccctttgttgtaactattagaatacaatagacaagcaagttcaaggtagcttgatacatactgtacacaaacactgagcacattccaagggatgtgaaccttaactacagaagcgtgtatggagctgctttaatttactgtgactgtgttgcatagaaaaggaagacgaccgtgctgccacttaagtactgataacatttaacactgtgtgcataagattgaggcagcttggaaggtccagaatatgaagcaaagaatccgatccattcagaaaccaagaaacctccaaataatagcactttcactctaattcagcctctgccaaatttgcctttggccaattgtcaccagtgccaaattaccaacagacttccttttctggtcttagtcatgttgacctcttccttctgtctcctagtcaagcagaatttaaaacatttacattgtatttcaatttctatgaagatgggagaggaaaggtgtatttcttgtcttttgtccctggccagcttctactgggaacttatttccttgaaattcctgtcctgtaaaagcatgcagatgaaagtatctttaatgtataattacatttttatatgtgtataatcttagattacatgggaattgagtatctggaatggatcggccttaggaaaatgtttctttttaaaaactattaaatattggaacattatacaaaaaaatagcattgaaatatttaatctgtggttcaggtctgttgttcatttaaaggtttaactgtttcccactgtttaaatatctctatctgatctttcatgctaagttagcatgtccaaaatattgaaaaacagatgaatgatcaaggaacttaaggaatactcctccagtgaagccagaaggatattcttgaggagaaaaaaagaatgcatgaaacttatttaacaagaaagatttgagtcaggtaatctacataatatatccactggcattaaggctgtcatcttggtattgcatttctggtacgaatttcgcaatagctgtctttcactgtcggttctaataaagagtgttggtcagcttaaattccctgggagctcagagttatgttttgtgaactgcatgtgcctgaggcctctcatgcatgatttaaactgctttgtaaatgtcaataggtggaaaagcattggatcccttgtagatttctccaaatcctcaaagatgtgtatgccatgtataaaccatgctgcactctcaaggccattgccgttttttatacttgcctaactgggggtttaaggtattgctagaagcaaaatatcagtgtgttcatgtctcgatccaactggccaatgaaaccctttattaggaaaacctttgcaccagagaaatgtctccagtgacctgaaatgggcacacctcatgaatgttgaatgttcttcaaactctatttcttcattcttgacttttttcaaaacatacatttgacttgattgaatttactgatttcagagtactgcatccattccatggacagcagtatggggtcatcaaaaaaaatttccattgagagtgcccagacctgggtcctatcctggttctgccactctctggctctttgtccttgggcaagccacttaaccttttgggggccctgcttttctgatccattaaataaaggaggttgaattaaatgatctctagttatccctcacagctccagcatcagtgattccaagagatagtgacagaaaaccagtgtgtcacttttaaagccagggaacacatgtgactttttaattgggctcattccactctctgggcagtacacagtgccggcagaagccccaaaatggccagcagcaatggcgtagggaggcctgagtgttagcttgagggttcatcaactcattttcgttcaaagcacttcctggtgattgttttccatggacctgggaactgcactaagggcgctcctcccacagtgtgccctgaccccccaggtgtgttctttaggtaaagctgttttttaatgtctgaagaggccaaagcaaatgccagtgagggtatagctctctaggatctccagaatagaggcaccatatgagcaacaacactagactgggtttctcagagtctgtttctcacacactttagtacctctcagcttaacatggtacctggagatagaggtgcttaggaaatgtatgcttagcaaatgttgcagaaagagtttattcggagtcatagagccatcggagcagatggtcttttttgttttcttcttcatgttttgactcctacatagttcagaataagtcactttggtcttttctttgcacatgttcactttctaatatagtgtcttcttggggagactgttttatggggaatatgtgagttcatgtgttagctgtggagccagcctgcctgaatttgaatcctgacttttcctctaactgtgtgaccttgagcagtttccttaaccattctgtatctcaggttttaatctgtaaaataaggataacgggagtacctagctcttcagattgtgaggattgaatgggatatacacataaagctctcaatgcctggtgtgttaaagtgttcgcagttgttacttttttaaatgtttttactacttttgaaatttagtgttcaaggtgaactttttacagaagagccagggcaattggatgcactttgggggaaaaaaaaatcacttgcctcatccccatcttctccatcgcagtgaggactgttctcaagtgggcacacaggacacctgtctccttcatctgcaaggccccagtggctgtgctggggtttgaggtctctcgttcagaccaggtatgtgagggcttggttatcatgcactgctcctgaatccaccatctccatgtccacatccttggcagggagaccagagccaactgggaactctgccacctggagagacctttgaaacactgtcgccaccagtgttccatttgtgtgtttgcagaatgccaagtaagcacattctttttcaccctctgacatgacctcagggttactttctgtggctgttgacaaatttttagacatcccagttttatcagcggaaaccttgaagagtgacaaatggttcttggaagagttggtacatactataaaaatgtcagctggctcatttataacccagtgatgtccagtgtctgagccgtgctatcagcatggtctatagataactcaccctcacgatgctccgctctccccaagtactttgtgcagctgttctggttgaagacccagttgacatctataatagatatcaaatggagagcctcttattttatcactctctgtgtttcagcactggcggtccccatggactgtcagaaacaggcagccagcacgttatgggaaaggtgacttgctgagtccctgtgccctgaggacattattaagtgctagggaaccttgttagctcataaagttggttcaaaccaattattgttctgcgaccattaccattgccaagaatgtaactcttttaaattcttgcccataaagccgatctttccattacattatatcatagagcaagacttctgatctggccgcacttgtatcccaccggctgcaaagactaaacattgcatttgctgctcaatattggttacccttcagtgcttcatggaggcagcaagactgctatttatagatttactttctgtctccctagttcagcacagtcagttttgacacactgtcccagtaatctgatcagccatgctgcttttaaatgaaggtctaggccttggcctctgcagagagggtgacagctgtcagatacagatagtaggctacagatcctggctgctaaaaccctctcattcattcctgttacagatcattgaccacagcttgaagccatgctttacagttggccgattagttggcaagagatctacatactgtattagcaaggtcaaccactgagataaaggcaaaaacgtaaacccctgcactatttttaaaccagtagccatttgttaaagctggttattttggtacttgtctccgttcccctcttttttttttctcccaaaacaaaactcaagaaacttgttaaaactcttcggcagctaacgaagatgcctcagataatgagatggttcaaacctgagaaggaaagatgaggtctttctcagaaactcatttaggaacctcggataggaagccgtgttagctgtgcttataccttgttttaatcagaacgtgtctggaaatcttagtccagggagacctggatgaaagtgcagccagtttgagtgctctggccatgacagtaggttaggcaggtctggcctagaaagaggtaagttatgattcatacaagtttaaatcctcgctcactcctgaatgaggtggttgggcttggttgtcagctcagatgattggacccattttgtaggtgtttccttctccagagtccttccttcccccagcatcttgtctgtaggtattctaaagccaggcattattcaacacactatattggacttgtgtaaagagaacttgcaccctgggaaaccttgtgttaaagtgattaattgacttcttcatattcagtgaagatccttgctgtttcagaatcgacacaaacgaccaaaccttcaatctcatctttactcagaaaggggtccacctataagattttgaactctccttcaccatctgaccagcctcctctctgctttcacctctcctatgccttcactcccactgaacgttcctttaacttcatgacagccaccttcccctttacccttctctgtgtcctgctaagactatgtggacccagctggggttcccattctttttccaggttatactctctatggtctctattttgtgtcctcctccctctcttctgtgaccttactgcatcttcctgttgcattcccatctcccatctgatctcttgtctttcactctctacctcttgttgacttatgaccaagcacagtttccttagtgtacaggggcacccaaggcccttgacaatatgtctgtccaccatcttgtagtcttgcctcctgctttgtttcttctccacctctctaaggccccatgcacacatttgctgaacacaccctgccctgtcaagcttctttggctgcctttgctattcctccaccacgtaggtcctttagaatggcaagccttacaatgtatagtatatttagtatacatacccagtaaatatttgtaggacgagtgcatgaataaaagcacaatgtttgacattgttatcagcattgacccaaaccctttgagctagatgagcaataaagattagaagaaagaggttaggtataaccacaaacaaacttgagattgaaggctcgctagaagtagaactttgggtggatttctctctgtgacttgattttcttgcctataaagtgaggtaagtgatatctgctttataggttgttgggaggatcaaagaagaaaaaagggaagtaaagtgcctaacacagtgtctggcaaatggaaggaacttgatagatgttaattacctagctgtgccatataactcccaccccatcttcagtgttctgtgaaatgtattttcattttacccttggaaaggtacaggacaggatggaagaccagtttgatgggagagaaggctgggagttacataaacccccatggttttctgacttttcactagagtcaataaggagatgtttaaacagactttggcccacaaaaggtgactcactctcacattctcagcttcctgctcagggaatcagtgtggaaactgggcttccacttctcagcttcaaactggagctgggaaactttcgcctctgtggaggagccttggggaaatctcagcccagctgccatgaggtgtgcaaggggaggacgtgtcagccctggaaactccacaggcctctgttccagatgcacagggcagtcacgtctttgcaggggtgaagcaggaggacaccctccctcctgttctgttctagcagccatcatgaggtgggacttggagggaatctgatcctgttaggggaacgatccagtccggtgcagagcagctttggggtattaatgactgtgtgttccacagggggaacttgtccatttcatttatttgcaataaaatatatgagaggaacatctgcaggcagcttatatatttgtcaaatttagaagtaattcaggcatatgatggggagccatggcgattttatgaattttctattgttatgcattcgagttcccatggcatcgtttggcctagctatggcagcccagagaacagaggcggtgctagcagacccacgtgacacatgccgcgggcttgggcggatgcctggcatgtgaagtgatccagggtgctggcagatgcagacgaggtgggagggaggtggaggaggggcatactcatgttttaggaggggaaatacagggtcacctttgtggacggcaaatagccaggtcctgaaacttgcttctaatgaattccttacatgctgttgaaatggcaggaatcataatagcttatttcatgtgcctttgaagggttccagcaaatggagtctaagagaaggcagggatggggggtgggggtggggaggcaggaaaagggggggcgagagtgaaatattactacttaaaacatattcttagacataataaagcattaaagttaaaatattgttgagacagctttcattatgcatgttccaggcctcattatggaataagcagaagtgactgtgcagccgagacctaacaatatctgcactgaattcctattatgtaagaaaggctttctagtccctgccagtgtcgggatgtggtggttggttttcaataaaggtcagaatcggtgccacactgaatagagctaaaagtgtgtttcattcttttgtaggccacgggcactgttggggattgatctgaaaatctggtctgttgcgggcctttgctctcaagggagattaatattttagctattcctttttgttcagtgcttctaaatgtatttggaatgaaaagaaaggttaaagaggggctctgggacggctagcttcagagactagatcatttcatgaagggaaatcaattaaaaaaggttgactgtgaacatttatccatttagcttagccgctattgaattttcatgatggacttcgactcttcggagagaacggagttaatggcaattgttcctttctcctcaaaatttattatctggtttattcatggaaaacactccatcaaactagatagaggccttaggcctattgatagatttgcctgtgtggggttggaatggggaggtttgtcacagatgtccagcctttgaaggaaaattaaacaagtatctcattacagaatgcttcactggtccccggaggtggccacagacgcagtggatttaatgagctgggaacgtcaatgctgccaaagtttacctcgacctgtctttctgaagaactcctctatttaggcccactcaagcaaaggagaaaggcaccacgctgttttctccctttcaactccaaagaaggggataatgcactttttgtgccatgcatccagaggaattatgtgtgctaatttgattaggggagatttgattaactggaaaatgagggctttgctaagactttcacacgcttaatttatcccttgcaaagcagacgcaacattgtgtcatgaaactcagaaggcatatgggaacagtattcagtggttagacggcctttcagacccaacaatatcaaggattgccacggttcatattgggataatcattttagagcattcgctttgctgcagaatacaaattgggtttggcattgccagttaaacggttcaaaggataatgagattaatatagtaggaaacttagctgagcaaaaagcttttttttttttttaacaccattgcataactagttttaaggggaacttagttgaaaaatgcttggttttctccaaagaatgcattaattatgttttgtggttccatacactcctggtctttcttgctaaataaacatatcgtgcatcatccagatcttgctgaaatttgggggatatgcattgaagcagcccctgtttctccatgaaggtgtatgtctgtgagcctggctgtgcagttgggaggcctgggggagaggtcatgcttctaccatggcgttttccattttccttaaaatgtgcctcagcaacaggctgccaagatctaatcctgttcccctacccccatagcagttggggaattaccaacaaagtctttaccatctgacattccccaagggctgtgtaagggggcatcttacccctgctttcttgggagtatatatttttaaaaagttgaaaggagaccagcaatgccaatctctactaacatctgaaaaaaggtcttttttaaaaaaagcatttcacattcagaagacacctggaaggtccctgcagagagagctctgggctccatgtgccaacgatctttgaatagaatcccttggagtttctacccgtatgtcttttttctaaagatccccttgcccttgatgattgcaaacttccacatagcttcagaagccatcttcattgtgccaagtttatttacaagcagatttggccctctctgtactttggcctacatagtacaagcaacgtttgaactcctgttttgctcttagcaccagaagtttgggcttttccattaaaatcagtcaatcaggaaagagtgcatgcatgctgggttttaactttaacacaggctgggtttcaactttcatggtgaattaggactgtctcctgccattctcccttggcttgctgcactgtagaaaactgtgaaaggagccactaactagggcagaccactggcccaatttgaacaggactgctttgttttagctggacctagaggtttaaatcacaagacggctactggattcccttctccccgaccccctcatggccaccaccactagccctctgtaggaggagaacttcactgagcacctgattacctgttctcgctttaggattagatcaagataggacagagaggttgttcatttgtaggcttgttgccttactgtaggagtagttggattgagtcaagccatccttttccttgggaaacaggcccctgccgctttaagtggagttgctgggtaatcgttccgctcggttgcataaccagaaagggatgtgtcaggactgggacctgcagacagcgaaggctttattaaaacgctcgcagagacctagacagatgagtggtctccagttggagttctttccatcttccccatctgttcactgcagttttaattaaatctactgagattatttttggccttctccaggaacagaaagccagcctgtgccaatgtccactcgtttctgtgctttactgccagccactaatgagcaggcacatggggcacccctgcctgtgtgcacccccttcctttgccagccatcatgagttgctaatagggtaggaactaaaagtgccaagcccaggcctctccaccttctcccacctccacccccaccctcagccccaccttggtgctaaagaaagccagctaacgaatgattccacttgtggttagctagctaatgggaatgacaggcttcaaataaccttaaagcatgcagccccaatgcttgtctgtctgatcagggcccttctgctggcacctgacactttcaataccataatggcattcacatgcattctttttgaatgctgtcatatagcaagacctttcttctcttcgtttgctgggaggatgcctggcaaagctattaagtctgtgatgggaatgacagttaactgcgggcctgtcagtcccactttggaagtcagcacatccttatacccattaggagcatatcataggaacttcagaaataacctgctgcaagataccatcaggttgttgcgctgcctgcaaacataccacccaacgagctttgcacatcattctgccctgcctctcattaagggtctggtttgttgatatttggtagatatttgatttctgaatttcagattgggacatagtaattacttctggaaggtagcatggctgtccccaggtagttggcaggtggtggttcttcctatttatggtcagtgcttcatggatttgaggacttctgttagttgggtttccaagagaagttgtgtcttggaatccatttccctaattgaccccctaggtttccaaagcagactctaggcagatgtacattttttattgcacttgagtcccaaattctggcctaatcaccaacaccagtgcactgggcaggactgtgagtgagcctcagtttcccctcttgccccaagttcaaggcctacaagagacccatctgagtggcccaccctcctctgcgctccctaagaaggaaaggggtcaaagagagggatccgagtggtccagagcaactgctgcccctgctgagctgtgtttataacttctcattcctcccactgatagtctcacccctccacagtgatcccttgctctgttcttgaagactccattttcattgacccatatcagcacttgcattttggggttgatgttgtggaacctaaacaattagaaggttggacttagagcttttagagtcttgatttgtccatacatacagcttgactttctgctaagacacacgcttccactcctaaccagcaaccgagaatcaacatcttctgtgtaatttccaggaaatgcctttcaaactcactgccattaggtagctctccaaacttcacttagaggaacaatgttttagaaggattccaaaaataggaataagtgcagtcctttttctctagattggcattttctgaaatgtttcctggaatagtcttttcgtaatatattaatagacgccactaggataaaggattttgtttgaaaagtgttggattagatcaaattaagcaaagcagtggagagggcaatattatgctgtgtttaccaaacagctttgaccacagaacacctaggaacatttcatagatcccttggaacacagtttgggaaatgctactccagaggatctggagtaagacaaaccagcagagaaccagagttagcctttctggtattccagtttagaacagcaccatatgctctgcagatagaggctctaataaccctatgacaccaatgccaggacttttgaatgaatgagtagaaaaaaatattatttagtgtgctatgtgttgttttgcttatgtagatccttgggagaaataacactctgattgcagagttacgaataattgagccttttttgaagagttggttttccttttatcttgcaacccccatgaactgtgcaactgcttagcttcccatcatcaccgtggctgctggaagcctagagccagcttcctggcccatctgttataaataagtggttaagtgatgggcagacttcatttccatctccactgtgcatacccacatggtttatttttccttcttttctaccaataattttaaaaatcctcccccctccctgttatcttttaaaggtaccctaaatccttttggtcctttaaggtactttaaatcctttatccttttggtcctttaaggtaacttaaatccttcggtgtagggaatatgtaagtgatacataacattacctgttaccagtcttagctacttaattgataaattgacattggcttgtctgagattattgtcattttgggttgatcaacaaggttgatgagcagttgatgtatagccacagctacggcaacagtttcttagtttcagaacataccatgtgttttgtctggagactctctaatcactgaaacatgaaaacaatttactaagctatgtttttttccccaactgtggcaacatcataaagcatttttgttcatatgtgttttattgggtttttttttaatttttttctttattttttttttattttttgagatggagtcttgctctgtcgcccaggctggagtgcagtggcgtgatctcagctcactgcaagctccgcctcccaggttcacgccattctcctgcctcagcctcctgagtagctgggactacaggcgcccgccaccacgcccggctaattttttgtatttttagtagagacggggtttcaccatgctagctaggatggtctcagtctcctgaacttgtgatctgcccgcctcggcctctcaaagtgctgggattacaggcgtgagccaccgcacctggccttttgtccatatgtgttttgtcctcagtagattcctagtagaatatgaaaataatttgcagaagatatcctagaaagttagagctaaaagggaccttaaagatcatctagtctagagatggcaaataagtttcgattgtcctgctatctatggtttgttagttggctgcctggaggcttgtattgaagattctgggccatgaaggcatcaaaggctaaatcgattagtgatgtctgccatgagcatggcatgaaggcaaggaagtgtgcatgctgcacattttctgtccctagtttctcccttttgaccaatgaaatcacctgagacagaggtggcactagaaatcacgtctttattctaagtccaggactctttgtaaccccatcttgctgaagtaattatttttcttccaactataaacgttagtaaactagagcaccaaaacaatatgcttcttctagatttgccattgagttcactgtaaagtgaaatacaaaaccaagaatcagtccccctcttcattatttttcccaacttctgatatagttgaggaacgaggcctattctatactgggacctacccaaatttttcttgtttatacttagccatattatcatgatttggttttttttaattaagactgttttggtaagacatattctccagcaaattcattttccctgggtccttctttggttaagcatgttgctagctatagccaaaccaacaggtctaagatgcctaagttatattatcttttcttttcttctttcctttctttctttttttttctttctttttttttttttgagaaacagagtctccctcctttgcccaggttggagtggtgcagtggtgcgatcatggctcactgcagcctcaacctccccagggttcaggtgatcctcccacctcagcctctcgaatagttgggattacaggcacatgccaccacacctggctaatttttgtttttttagtagaaacagggtttcaccatgttggccaggctggtctcaaactcctgagctaaagcaatccacccatctcggcctccacaagtgttgaggttgcaggcatgagccatcatgcccagccttatattctcttttctaaaaaaaaaaaaaaaaaagatgaagggaggaacattttagaaaaatcaagttaggcagctttgctatctcagtatgcaatgctgagaagtgtcactttaacagacttaatcctttcaaataataattcaaatgaaattgagatgaacagtttggctcttaaggactttttttcttgagacaatgggattcttttttctaagcaattaatttgctaataaaaaaaatggtgctgccctgttccttatttgctttatttcatgagaaatcaggttggcaatcttgttcacatatttacccatggaacattccattccatctccttcaatgctgaagacatgggtttcaagcctaccctgcccagggataagacagagcaggtgcaattaataaaccatcttttcaagctttccttccagtggtttgtagactgctttctcctgacatgagtcaagctatttaatgtgatggaattcatcttgtaaggctctctccattcaggctaagtgattgaattcacaattcctctgatttagtgcctcgtttgtcactttcttgaggagaggtttttggacccatttagttgggagattggctggagcaggaagtcggggagaatctgcccctaagccaccatttccttccacttcaaacatgattcataatcagtctggaagaagcaggaagatagaggatgaccaactgctctgagaagcaggctgctgtgaagttgattacgtttgcaggacagcctctaagatgtcttcgaggccaggacacagaccctctagaagccagccattttagccacttggggctccacaacacagtgccttcgaacgtaaccagcactgactcggtggtgtgcactgggcctcaaagcacattcccgtctcttatcattcagtagcccagtgccaattagagtggacgtactagacggtttcactcttgcaaccctgaaacagtggagtttcagggctgaaagccagtctgacttcatcctgaccttcagctatgcacatgtgccctgcgctgtagcgtggctgcctgctgaatgggaatggggtaggtgtgcttgtcccagcatcattgacattccaggaggctgcttcctgccggtcctccccctcaccaggtaccatgtttcctattagttcttcaggaaggaaggcaggtcaaaagggtggatgaagtaggtcagaaagagggcagtctctagtaggaggggacacagacttatttactggtaggaattctctcctgtggaaaaacagttccgaattcagcctcaggatacaagccccacctctggaggtgctcaggccatgagggctgcagctgcaggtcttctgttcgtcaacctttttctcttgagctgaacacaccagactccctgcagaattgcttgggtgtgcagggagagtcaggttattttttaattgaaaaagacattttttcttgagaacatgggaacactacaaaccttcaaggcaaatggaagaacaaatagatgttccagtgtctaggcccagaacaggaagttttacgttgtgtttaacagatacgacaggatttgcagaggaactttaaaggagcccaggagtccgctgaaaatgtatttaaagttttgtttgtgtgcttgtgcatttgcctcagaagatggttcttggctttcatcagattttcaaatagaatctgtaaccaaaaaaatagttgaggctgggtgtggtggcccatacctgtaatcccagcactttgggaggccaagacaggaggatcacttgaggccaggagtttgaagctagcctggacaacccagtgagactcctttgcttcaaaaaaaattttaaaataaggccgggcgtagtggctcacgcttgtaataccagtactttgggaggccgaggcgggcagatcacctgaggtcgggagttcgagaccagcctgaccaacgtggtgaaacccccatctctactaaaaatacaaaaaaatttgccgggcatggtggctcatgcctgtaatcccagctactcgggaggctgaggcaggaaaattgcttgaaactgggaggcggaggttgtggtgagccgagattgcgccattgcattccagcctgggcaagaagagcgaaactccgtctcaataaataaataaataaataaattagccgggtgcgatggcatgtgcctatagtcccggctactcaggaggctgaggtgggaggatcgcttaagccagtgagttctaggctatgattgcaccactgcattccaacctgagcaacctccaacctgtttcaaagaaaaaaaaatgttgagattcattgggctcttaaccagagactaactatgcacacgccactttggaaatgtatgctgtttgttacccaccacagtactctcacccacctgaccccttctccctatccaaccttagccttaaccaagaacagacctggttcctagtaagccatgtttccattcaccaaggtttggggagccttccctgactataaaagagactctgctatcacttttatttcatcttaattcaggcatttttttaatgtggtgtagttgacttgtttctaaattcctttacattttgtattgttcacacagtaaaaatgtctattttaccattccccattctaatttttcatcatttagtcaaaggtggggccaaaattgagctttagtctatgtatagtaaggttttgtttcattttgttttgttttctttcaaccagaagaataaaatcagaattttagagcttgtcttacccaacccacttttttttttttttttttaaccagagatgttaagtcgtttttcaaggtcaaacatctagttggtagtagaggtaatgagttgttttattctttgctcttatcgaagaaaggaaattatagaattaatggaattttatgaagttgggggttttctttatcgttatcattaaaagaacgcagtgtggttttatgaaagcctcacacaggctgtcttctcagcccttttcagacccgcactctttcctccatccacatcctctcccttctccccagccccaacccttccttccacgtcaagctgagtatacaaagcatcccatatttcaggctgaggcctacggagtgggttcccactggaccctctagcagcctgcattctccgacttgaatggctgcatgtggagagtatgtatatttgttcagagctcttgctttaagttaccccttcccaccacgttgcccaaagaaataggaatgtgaggggaaaaggaaaggaaaaataccacaggtattttcccctctggggaagcttgggactcaccacttcacagaattcaaggtacagaagcatcttttcatttagcagaaggctgcaaagtgtgggtagaatgctgagttttgttaatgaattgctgttcatttccctcttcatcgttcttagtagcttttagaaaatgtgtctgcttttgacttgagccttctacaaggccagagatgtttctacagagagcccttttcttgcaaataagaactcctttcacttttgttcatattgtcccaccatgttgctgcctttaaaaaaaatgtgttgtatatataacctagattatgtccctataaagtgagtttgtaacgactccctcatgagcttagcaaaagtatgtctagacaattttttttggcttttccccccaaacttctttgggttaaaaatagggaaggacttgttttaatacagtgtagtactgtatctttaaccttttgtccaaacgcatattgcctgtttaagttttatttagagaaagtgtgtaacttataaaccagctcgctcagaccttggggccgcccctggctggtcttcctgctgcccgtggattagcctagtctccagaagtgttttacaggaagcttaggcggagggaagcacttaattattatccaaatttttccctttagttaagtcttacggtaagatatcccagagattatatttttagcaaccactttaaagagactggggagattaatttaaaattgataatcgcatggcagcaccacagcctaacaagctcaaggtctgccttgtggagctggctgctctctggggaccccagttcaattctctttgctgccagttgaaatcagaaatcacaaccgcagtgattagcagtgaattccctgatctccctgctcgaggcagagggagagggggcctgttttctaagtagccagtcgttaactctttcatgggaggggcggaggcagaggtagtgattcatgggtgtgaggtggggcctagtaatctacaccttcacagaaacttcccaggtaatgcttagagtccccagctctgggagcttctgtttttaggggagtggtggacagtgagtgaagaaagagccttttgggcccatccaaggctgccctccaggcaccatgaccgctgaaacccgcaccgcacggctcaggcctctgccgagcaactctgtccttctgggcgagcctttctttgtggaagaaagcaaaaaaaactgccttctgtccctcttccagcattcttcttttaaaaatggcctctggctaccaagtggacaattatggatagctctgtagagcagcggtaagcagtgttaattagctgcaggatatcagaaacaaaaatgaaaatattttccctgtgggccaaacaaaattaattttaaaaattaatgtaaaccactaatgctgcaagtgcctccattaaattacaggactgtgacatgtacaatgctatatttttgccgttgaatttgttatctaagaggtgttcattgtttgttacggtgtgaaaagctgttttcctccagataagcttgttcattaggaaactggatctctgccaccaccctgtttcttcgcactgaagtaatgccctgtagcataaatgtagacagccgcactgcatttaatatcagaaatgtaaatcaaaagcgtccagtctggttttaaatggcttcagtctttcccagggtgaaatctggggaaaaatttcttctctgtgcagcttctgacaccactgctttagcagacaggccctgaaagcaggctgataattattaaacaaagtatcttgtttcccactgaggtctccggatcgctctgtcattagactggatttatttctagggtttcattcacgctgtgacagcttgggatttataagttctgtgttttaatttcaggcagaaatgaaactggtcaattgcaatttgggagggggaagaacccttgataaaagggctgtgcatcctaatgcctaaatacagagccagaataaagaaggcatcttgggtggcatgctgcgacttcagccacagctgccagcgaacttgagccagccctgggggcagtacagagacaggccgagaacgccatgcttagtgcagccccagagcaccccttcacaccacaggcccctgttccagggaggcgagtgctggccttgctctgaagaaggaagggggagcaaccaggaggaatccctcgtcctgccagccacgaagggcgtgtgctggggcagtgactgaaaacttcagtgtttctctggctctgtcttcattccagaagctctggcacacaggtggaagcctggcctcacccagccaggagcatgtaggttctccttgaacctctgcaccctgcttttcaaggtgttgagtaagctcagtgtctgatttctttttttcaaagggaaaccaaaattattaactcctctgatatcctttctggctcctatttacttacttagcaagcatctaattcagcactatttcaaatctgaggggtgtgttggtaaccagttgggagctgagagaaaacctgattagcagtaagcttatttccatagaaacaggccaattaagatgctgtgtgaaaaagcagtggagagccctgaccagtcaacttttgggggtcctgcagggggcaaactgtccctgccctgctgtggaaacagctggactgacacacagagaggagactctagtcctctggggggtgctgtggctttctgcggggctgctggtgttttcttgcgctcagagcactttacaacacaggcctgaaacagagcagcatcaggagggtcgctagagctacactcccgcttctcttccagaatcccctatttgactgaccaggaaactgaggttctcattaatgacttttctgccaaaagaggcacaaacaaatgaactccttccgagagccctatcagatgttgcaacgtaagaggcttctagtcggtcatacagatcgcgtatattaacataggaactgatctgccatcaccaaggtgaccataggtcctggtttgcctcaaacagccccaatttatgcctgctgtacttgttaacagtggatatcttcactcttaaaagtatccgagtttgaattctacgggatgatcaccctcgctattacccacaatctagccagttggttcaaggcgaataacccctaatgggaccagtgaattagaatctcttgtttaaaagttgtggaaggctacatgtgggacaaaaccaatgaaataaagatttatttatttatttatttatttatgtatgtatatatgtatgttttgagacagtgtcttgctctgtcgcccagactggagtgcaacggcgcgatctcggctcactgcaacctctacctcccgggttcaagctattctcctgcctcagccccctaagtagctgggattacaagcatgcgccaccatgtctggctgatttttgtatttttagtacagacagagtttcaccttgttggccaggctggtctcgaacttctgacctcaagtgatcctcctgcctcagcctcccaaagtgctgggattacaggcatgagcgatcgcgcccagccgaaataaagttttaaaacactcgaaacaatgctacatggcatttgtatctatgtacaaatatagcaaaagtataaatgccataccgtgcatgataaatatcaaattggtgagtgtgtaccctgcgggaagatatctgaaatatatatttctccagctatatggtggctctacaggttttccttacatgtattcttatgttatcctatacttttcctgtagtccaaaaatatttcataatttaaaaagaagcaagcaggccttcagccaacagagaatggtttcattaaagtaggggagtgtatttgttggggtgcatgtaaggaagggaaggattctatttagggttaaacatctcaagaattgctccaggaaatgatgcgattgggagcatgactgaagcgttgcattgtactctgggatagcactggtagacaggcactccagaaagcacaggatgcctgcccattgcattgatgtttctcgagttctcagcactaaggcttgcatcctaaactctggtgtgggaaagctagctgcatatttacgttctgggtggatttgcctccggagaccctgctgttcaatcccattcagtttgcaggttaacatttactgttcctgtccttgaggtcagcacttgcccacagattttcctaatttctttattttactcttcctccaacaattgcaataacttggatactttctcttcactacttgcaggaaacaggaaggaggcacacagtgtgatacacagtcttgggttgatgtctgttttcaaacatgtttttggaatctccatttgagtagtttaggtctaattccagtcataccaactggcttataaaagccaccaggaatgggtaaaattgctccagaatgggaagggagcagcattccatatggcaagggatttttcttttttcttttttgagacagagtctcactctgttaccaggctggagtgcagtgatgccatcacggctcactgcagcatcaacccccctggacttgagcaaccctcccacctctgcctcctgagtagctggaacaagaggaacataccaccatgcgggctaattttttaactttttgtagagatagggtctcactctgctgctcaggctgttcctgaatccttgggctcaggagattctcccatcccagcctcccggagtattgggattacaggcatgagccaccacacctgcccaggaagggatttttcaagaggaaatgagacagaaagagtttggactgagtgcacatctttctctaccctcaatgatgtttgttagcactgcatcacctggcctagatggtccttggcaactaggtgactgatctgagtattttacattgcagcatctgtacacaggtgatctgtatacagcaagtgattcctgtaagctccttgacaataacagcaataataacctttactcagcacatgctgcatcccaggcactttggtgcagcactttacatgactttctgtcttccatcctcacagtcaccctttgaggtgggtattaggatgaaccatgtgaaactgccatttttgtaggtcaaaaacagtcaaatattggcaattgtatgtggtccaatctaataatctttttgtaatcaaaaacagtcaaatattagcagtcctatgtggttcaatctgatcatcttactgtatttgctttgcaaatagagaaattcagacattgaaacttgctcaaagtccacccatctaccaggtgccagaactggaatttgaacaaggtactcccctccacaccctcacactgaactgccgccgcacagtgctgtctccttgggtggaagaaaaaggcatatttttgtggcctaggtgttaaataggttcttcaacaacacctcggccaactttgagatcaaagatggttggtcagatgaatcaaatgtttcctggagtcttgggttacactcgtaatgctctgtttaaaaggaatgatatgtagtgagcacatcagaaatctggaagatggaaaatctctctttaggatctctgctcctctctcgagcaaagaaagaaatcggtgtggtgccagcagaggtgttctcagcaggacctggcccattaaatgaaagacttccatgctgagccaatcaagagagacctggacaaaaatcagactctttcctgccctggaaacccatgccttgaatctgtaattcatctgttaaatcaagtgtgcagccggtggtttagcacagagggggacgacggggaagagagaggggcaggagctgcagcacttgaatttccagcatcagagtccagttagggaaaagaaacagagctgtgatagcttcttggaccttatgtttccagcaaagagaaagcagcaggaaagatttttgaaaacagatgagctggtggaaggtattagaacaatggcggaagaggcagggaccccaggggctgaacaaaacacagttccgctgttgcctttcaacaagactgaataaagtttaggattttttttttatgggacttgtagccgtttttaaactttcatttttcataatgtcacagataatctttttatctattatccactggctcttttctgagaggcatttgcatcaaatagtgctgtacagatcatgactgtctctagtggggaaagcagcttgaaatgaaaggttattcactccctctgctttcgctggctttgttcttgattctcacacatttttttacatctgaattcgggtatttctggagtttttctttagaaacccttccattctgagatctaagcatattcagactccgatctatatatcaggggttacaaagcttatgcctactgaaagtgaagcatgtactttgaaacatttgttggataccccatggtttccaaaatcccttcagagcatttcctacagaggcagcaaccgtaaaaagcggccagtcacacagtgggggccctttccctagcactggcctcctggtggcagtggagcagtggccttccaagcatgcactgcgagacatgagtggggcaatccgctccttccaactgcagggagaacgggtctgcagaatgaattctctttctccactcctcccatgtggggaacaaacgagagccctcccagggggcgaagtggagctgcaggagagcatggtggaaaacccaggagccacctgggctaacagggaatcaaaaatgacctttttgtgcacaaaaccccctgggaaaaaaaatgacctagaaagaagtggggttatggccaggtgcggtggcttacgcctataatcctagcattttgggaggctgaggtgggcagatcacttgaggtcaggagtttgagaccagcctagccaacatggcgaaaccccatctctactaaatattcaaaaattagcgggatgcggtggcagacgcctgtaatcccagctactcagaaggctgaggcaggagaatagcttgaacctgggaggcggaggttgcagtgagccgagattatgccactgcactctagcctgggtgatagaatgaaactctgtctcaaaaaaagaaaagaaaagaaagaaagtcgtggggatatgactgatagtttctgttcagcttctattatagtttcttaactcatcaccccaagctccagggggactctgggggaaggttgagaccaggtttgttctcaggcctgcctgacagagcccctcaggaaagcatcatccactccagctttctcctctgctgttccccactcaaacactcctgccattccctctcagaaagcccagaaacctttcttcccctccccaggaggagggagagcagtctgcagaggcaaggcctgagtggccacaatgacttaggtattccagctgtgcccagaacttggtctcagacaagtgcacccaggttagtagtgacctcagagaacagtggccaggaacttgtttttgcatttgtgtgtgtgtgtgtgtgtgtgtgtgtgtatgtatgtatatatatatatatatgtataaaataagggggcactggcccccagagaagtactgacaacaacctctggttagagggcagttctttgcagcttttgatgacaacctgcgaggagagaatgttgctctcaattgttcaagaaactgaaagcttagagaggttgaagcgatttgccaagttcacgggctggtgacggagtgggcctcagaactcagatctttctgactcaaactgccttgttcttaccatcccctatctccctagaggttgttagaacttttgggggcatactgttcctttattttagaaactctttggatatagggtagtggttgaagcagctctgaggatctgttttgaagagaagggtagcattgttagactagtagggtaatttccttttcccaagctcgtccctccagacctttgagccggtcatcatagttttatattttatgaccgaaaagaaacttctgttaaatcgtaaatacactaaaagccctggtgcctaaacacatgaacgtattatctccttgagcctggaaatctcccagcaatgtggcaggaatgtagaaacagtctgagttgtcaacaaaacataacagatttcccagttgtaacaaacatacgtgtagttgtgaatggaaaactctcccaataagcaaaataatggcctttttcgtgttgttttcctcatttaccatagctgtcctttcagagtgccatcggtttcaaatgtttcattgtattgatatttataacacttctagtaagcagagtgcccactacattatttttatttaactctctccagagttaaaggaacttgtagttaaggtgtcatctttcagatttacaattttacctagattggcaacatgggtggcaaagtgcttggaactaagacagaaaagttggttccagtcctggcctgcctttgtgtgtgacttgagtaaggctcaggaagagaggctgctgatacccaccccacctgtccccaccccacctgcccccaccccagatgggtcccaaggcaaatgtgaaagattaggtgctcctgaatgtgacaccagacgtggtgtgacagagcccatttgtgggtgtctgtttcaaagcttttggttcataggccatgctgcccgctttgctggaggaaagttccaagacccacaccaggctactccttgacaggaagcttttgttcctagcaacgggtttacccagtctttgtttgtttgtttgtttgtttgtttgttttgagacagggtctcactctgtcccccaggctggagtgcagtggtgctatctcagctcaccgcaacctccacctccaggttcaagcggttcttctgcctcagccacccaggtagctgggattacaggcactggccatcacgcctgactaactttatatatttttagtagagacagggtttcaccatgttggctaggctggtctcaaactcctgacctcaagtgattctcccgcctcagcctccgaaagtgctggggttacaggcatgagccaccccgcctgccccgactctcttcttaatatgctccatgcgtttgtttatgctccccccacctgcaacatactttgtagtctacgcatgtgtcagggctatttgctggtctcttttctctcaccctgatctggctgtgagcagataatcccccattcctcaatttggctggtactgcagttggcacggctctccaaactctgcagccaccagacatgtagaaacaaacctctaggcttcccaggaggctcacggactgcctcatggctgagccttcaatagagatgatcatctatgaaaataataacaaaaaatgttgctggttataaatgcaatatatgctcaatagaaatagtagtctataaaattagaaagttatgctgttataaatagaatatatgctcattgtaaaaatgtagaaaatgtaatacatattaagaaaaaatattcatatttgccatcgatatatattttacatatttgtatgttttttcagtatgacacatcaaagaaagggcagaatcttctttcttctcttaactttttgtcgtgagcaatacagtgttaagttcagggaaggaattgagttcggagccaaactgcccaggtttgaattcagctctgccacttgctagttgtgtaatactgcttttttgtttggtttggtgtattttattttatttattttatttttttttgagatggagtcttgccctgttgacaggctggagtacagttgcacaatctcagctcactgcaacctccgcctctgggttcaaacagctctcctgcctcagcctcccgagtagctggattacaagtgtgtgccaccatacccagttaatttttgtatttttagtagatatgaggtatcaccatgttggccaagctggtctcgaactcctgacctcaaatgatcccacccgccctgtcctcccgaagtgctgggattacaggcatgagctaccacgtccactgcctgcctgtcttttactgaagttgtagatgtcctctttgcctattctctgaattctacccctaccctacccatggtgacccacagagtgctttgtatacaataggggtgtcattaatgtttgttgaacataaatgaattaaaatataacatcctaaaagtgatttcaaactttggaatttaggttttgttgtttttgttttttattagagacggtcttgctctgttgcccaggctgcagtgcggtgccaccatcttgactcactgcaacctcaaacttctgggcccaagtgatcctctcacctcagtctcctgagtagctgggactacgggcacaatccaccatgctagctactttttttttttttcttgtagagatggtgtttcactatgttgcacaggctggtcttgaactcctggcctcaagcgattctcctgcctctgcctcctaaagtgctgggattaacaggcatgaaccaccatgcctgacctgactttggacaagttatttggcatttataattccactttctcatctacaaaatagagacaataatagtacctacctcatggggctgttttgaggaattaacacaaataaagcacttagaataatgcttcgtgctgtgcagtaagcactcaataatctaagttggtaatattcctgtttttatatcgtgttttaataaatgagaacataacattttaaaatcaaggagctgtgatttcatgctctgcacactgcctcagtgacataaagactgggactgaagctggggcatcactccctttggtttcccctctcctaggcccttagtcacatacaccttggagaacaggcacaaccgagaggacctgcatttcagtgatgtccgaggccaagggacaaggccagattctagtcaggtgataatggaatgagagtgttcactgcacatgtcttaatgaatggagatgataaggggtcaccaagccctatatatttatagtgctttatttttcatccaaaaacacaaagtgctgtttagtccccacaacaatcaggaaagcgaggaactattcttcccactgaggggatgggaaagctgagtccccttggtgggaccgggctgcaggcgcagggacttgctcccctcaaactgttgtggtctcaccacagtcaggaccagtcacttgaacagctcccatttccccagaatgattctatagagaggcaggagaaccctggaccctgagcaggagacttcagtccaggggccagcagcgcaagcacagcgtcatagaacatcatagaacatagaacattattctgctcagggcaaaataatgtgggctgcacagtctggcccaggcagccctcagtgttgtgccctcaagtgttgagatgacaggaggatggggtcaggccagtgatcctcaaagtcagaagaagaatactatgcctcaatcctactcatttcctttccaaactctccctagagggcctctaactgtggctgaggggaggggcggcactttttgatacacggtgcaacttgcccactttgaccctgacctttgctctgtccccttcaggtgaccctggcaagtagctttttagagcagtggttctcaaacttgagtgtgtgcagaatcccctggggttggggggcagggctttgaaaatacagattgctgggccccacccctagagtttctgatacagtggctcagggatgggcccaataatttacatttctgacatctgggttcctggatgctgctagtggagagaaccggtgatttgatagcattggtgagctggctcaactctctgctcaggaaagtgacaggatgcctcaaatgctgagtgctgcgtattcaaattccaaacacaaggcaactaggatgggagcccttctagactctgtgtattcaaggaccagggagaggcttagcagctctcagctctcctggcacagagagagttctctgaagcttgctgtttttctctctcctactttgatagtttcctccatttgtatgggcggaggttgcaaaggccagaatagactcagcgagagtgggagatgggggtgagtgagtgtgttcacttttgatgaggagcagatgtgacaagcactaaaatggagtgggcaataagaattattactagctgaggccgggcacagtcgctcacacctgtaatcccagcactttggaaggccgaggcgggtggatcacctgaggtcaggagttcaagaccagcctgaccaacatggagaaaccctgcctctactaaaaatacaaaattagtcgggcgtggtggcacatgcctgtaatcgcagctacttgggaagctaaggcagaagaattgcttgaacctgggaggcggaggctgcagtgagccgagattgcaccattgcactccagcctgaacaagagtgaaactgtctcaagaaaaaaaaaaaagaattattaccagctgctttgtggtcaggatgtcccaagctggcactgcagcaaccgctgttagggggcttggtgccatttgcaaggatgtcatcctcagccactggtttctaggcagcccctccaggaattcctcttccatgcacctccttgggcagagcgttgaggtgtggtggctgaaattcaggaattattgtggaagcttgagtttgcatgcccactccgtttcctactaactagctcaggggcgggggagtttctgaactatgttggcatagttcagaaacttaatgtttaagtgtcttaatgtatacgatggagataatgctctctgatttactgacctctcgggttgtgggctagacaccagagtttcagagttctcggtgcactgctgtgtattcctgggaatgcccctgagggtggagctctctgtaaggaaggcagccccaagggcagggctggtctctttagaaagactaggaatgaggacacccggcgtccaggcctagcttttccacccactcaccttcacagctccttcatcctttctgcttcagttccctcctctgtaacatgaagttggagtagatacttcattcagagcatcttccggctgtaaatggcttgagcccattgtcaactggaagacagagtgtgacgtctaaaaacccaaacagcaaagagcatctcttccaaaccacccaatctggagaggtggggcagttttgtggttccggcaccgacaccgtccctttcacacggtactgagccgcgggctgcttcggggcggccctccccgccccgtgccttgccgggatggcagagcggatcagaagctgcgcgcgctctgcctgcgcgctttgcctgcgcgctttgccgccgcaacccgcgcagcagccaatccgctggtgcactgcaggtgacctcccccgggcccgggaataaattgtcaagtttccccaccgtgggtgtctttgctagccggcgagttgcagtcttctgagctaattaggagacggtcatgaggagcgaggcgggccggggcgctccgcgggccggggcggggctggggcgggcggcgcgcagctcctgggccgaggcatccgcgagccgcgggtagatcgctcgcgtctgatcgccgcccgggagctcccgcggagccggctgccaggactcgttccagctccagtgcggggctgcccgggcgtccagaggcggcggacggcgtgccggcaagtttccccggcacctgccagtgcccgcgaacccacctcggaagccagacccggggaggcagaggcagaggccggctggctccagccgtggtaccgcacggctgccaccctcggacttccgtcttgagtctcctgaggctgagaagcagcagatgccgaacctgccccctgacgtggacgtacacctcaagacctaaaatgcgccctgcctggagactttgaacttagtcttctggaaatgcggagaccgcttcgggtggttttgtttttgcatcctcttcggctaggtttggctttgggattctctggctacctggatacgcctttcctttgtgggcaagtctcccgcggatcgcagcaccagcagccaaccctggggcacaccagcctttaaaacccccgagcctggagacgcatggagctagagaagaggacccaactcctgaccacgtaaggactctgattccacctttcccgtgatggagagaaatataatttcatggcagaattttctttaagcacattgtctgataggattggcaattactaaccaggaaaatgagtagcaattaggagttcagtaataaatggaagtctattgtcctaattgagtggaattactgactggtaatggcaacactgaattcttcagtttaattaagagtttatataattatagtgcactttttatttcttgggggagccatggggtaggaattaaataaccagtgtgatggttaagaaacccatttaatgggtaagtaaccaatgagttgaaatgaatgtgagtgccttgctcaagcaatgcaaacttagatgaattcctgataaagagatgtaacagcttgggccaagcaagactttcagctgctaattcctgtctgataaaaatctgaacggcttagaaatgattgggtaatctctaaaactggcacactgaaactgttttagagataccagagctccctctctcctgccggggtattaaccccgatttgtgctctctgtcgctgtgttttccacattcttcaagagtgaaacgagtgggtcatttgagagtgcttttgcagcctggggtttctgtatggaaaatcttgtgattgagctgttgagctgtaaatgttgatagctgaaggggatagacaagcttcatcgaagttactcaaattcaaagcagagtgagtatgtaggtgtgcaatttgggaactaatctgtaattataaagatgttattttcctctttggtggtgtattgtttcctttactattatgttctcaagaaattgttccccttgtgggaagcagtgaaattggagagaaatccctgctcagaggataattacttatatttttggtgtaggtttctgggaatccttttaaccctacattgggatgcacatatttatttccataagaagctccagcaggtttggaaatcactaggttttgaatacactggtagataattagcacttcaagtaacaatatttatgccactctgtaccttgacttctttttcttgcttacacgaggtctagattttcaacaggatgatcagggactaccttctctagagagcttgcatattgcaagtgggttcagggagcaccattatagttgcatttcactccagaagagacagtgagtggcatggaaggggcattgcatcttgaatactgcatgcgttttaaagtttgcagagcttattcataaatccgcttggttaatgagaaaaaagcaggtatcgaaagacgtttgctgtatgtgtgcctcccagtctcagcccttccaggtgctttgcaggtccctaagtacagagtgtcactgtccagaattttaagggcttacctaccctggtttttcccctctcccctagtcctgttttgtcattgctaccatgaaaatctagcaaaagtgtagaaagttgtgtccttccagaaccacggtttctcagtgcaggtttactgtattgagcgcccactccttttctgtttgtattctgcccaaggcacagcagacattcactccttttatttcccatgaaattgtacaacaggcagaagcttgaagatacaacacggatggaaatttgagccttgtaacgttcaaaaatgacacaattgccaagtttcctaacttttcctaagagttgattaaagatcacaacttcatatcgctcctttttccctatgcatttgccgtccatcacacacctgactgtgagctgttgtaatagctagatgaggtttaaaaaaagagggagtaggggctcaaggattgctgtcctctcagaaatgttgcccaaggctaccctaaggctcagcctacccccagattctctttctgacaagtgggtgtttggtaggatggtgtgaaagtttccttctatgataacatctttaagatttgtttccaaattcccttttttttctttttgtaacctgctgagaatatgagtctgtaacctatgtatttatctgaagtcagcctgaacagatagaaaaactgagttacaaggtatgggactcccagtaaattaggaacagatgtgggtcaaaaacagatttccaaactctttatcaaatgatcccacttggaaacaagacatgaacaggcctaactactcttaaaatgcaaggtttgtctgagggcaaacatgctggaaaagatggtggccaccaccctgcctctacttttcttttcctttcatctttcttcccaccgtctttggttccctgcataggctgtgtagtgggtatcagtcagcacttgtctgctggttgcacaatgcagattactcacttctgcccaagtaactccctgaagccgtactgtaacaatagagcatataaaaaagaaactcaggttgatcttggcccctgtccaaggggattagctagggagcacctgaaaggcctgtgttgaacacactcacctgtaacccagttccatggcctggatctcaaggacagggtaatctcagtaccttttaatgacctagtaaatgtggtatctttctgtctttacactcgacctgatggctcatagagtctcctcattatggagctggaggagtactttgaggtcatctaggccctcactactcaaagtgtggaccatgggtcagcagcattggtatcaccaaggagcctgttagaaatgctgaacctcaggtccatccctggatttatagaatcagaatctgcgacaggttccccagatttctcatatgcattatgacaggtggggttgtcccatgatccaactctgagatggagtttagccagtggcgtatttattaaggagtgccctttggatcaatacctatgggaaggaggaggaaggaacaggaataggtaggtagagcaagaagtcaagcagcaatacaggcccagtgacagtcatcactcacaacacgggaagctacacagctaggtcagccttctaagttgtctgtggtgggcagggatggccaggcctttcaactcactgcagacagcactcccagcagtcagcagcaagtctgtcattagacagggatctgggtagctcatcacagtgtccaccacatgcactgaagttgggagaagctctattctgggtcactggttctcaaaatgtggctgcataccaacaggaccttcagcaccccggggactcattagagatgcacattcctgagccccacccacagctactgaatcagaaactagggtggggctcagcaacctgtgttttcacacgttctccaagtgagtgctgcatgcccaagtttcagaaccactgctccaaggcagccttttttctgtttgttttgttttctaattgttattgaaatgattcacagtccatcttaataataaaattcaccactttaaagtgtacaattcagtaattttgtggggtttttaggttttttgttttgttttgttttgttttgtttttgagacgaagtcttgctctgttgcccaggctggagtgcggtggtgccatcttggcttactgcaacctcttatctcctgggtcaagggattctctcgcctcagcctcccgagtagctgggactacaggcgcccgccaccactcctggctaatttttgtatttttagtagagacggggttttgccatgttggccagactggtctcaaactcctgacctgaagtgatctgcccacctcagcctcccaaagtgctgggattacaggcacgggccaccgcgcccggcccaattcagtaatttttagtatatttataacctgtttagtatatttgcaaccctcgcctttacttccagaacattttcattatccccaaaagagatcccacacccattagcaatcactctctgcaccccctcccaaagtctggcagccactcatctgctttctgtcactgtgaatttgcctgttcttgatactttatttaacttgagtaatgcagtatgtggcttttgtcttgtttcttaacgttttgagagtcagccaagctgtaacatgtatcagtactccatttccttcatgggacaaatcatattccattatttagacagtaccacattttgtttctttattcatccattgatggtcatgggttctttctactgtttggttattgtgaataatgctgctgtgaacattggtgtacaagtttctgtatggacatatttcttcaattctcttgggtcaatacctaggagttgctcagtcatatgttaactctatgtttcactttttgaggaactcccagactgttttccaaagtgactgtaccatttgacattcttacaagcagtttatgagagttccagtttctccgtattatctccaacacttgttaatatctgtcctttttattatagccattctagtgaatgtgaagtggtatctcagtgtagttttagtttgcatttccctaatgactaatgatgttgaacatagttttcatgttttcattggctatttgtacatctgctatggagaaatgtctattcagatccttcttagggcagctctttttgttccttaaggaatccctcagtatgtcagctttgtgtccagtcctgtgcaggtgttttaggatttatgaaacaaagcctacaacctgtggccattacccactggaaagttctaatcagatgtgaaactgtctaaaaaggggaaaggaggacaggagagcccactgtcgagggttagcatgaagagattcacattctattacaattcgtgcttcagaaagacacggtgtgacttgctaggatagagtggtgtgtgtcagggatgtggcggctgcagactgctggagaagactgggaatgttgagaggaagaggaacaagtagagaagcggggacaggaagttgtgggcagaccttctagtattcttttatgggttacacacacctgtaagaggggatctcaggagcccaagatttctttcaagatcatgaccttcaccagcctcagcaaggtgaagcagttcacctttttcttcatttgggcaaaaatgacctgcctccaccatttctcagagtgtttgtaaagactgattataatactctaaacaagtgcttgaagagtgtgatttattctacattacaggtgagaaaaaagtttgtaggtgtccttaaatagtctctgattccctattagcagatcctcatggtggcagtgccatgtccatcccaaccccccagggcaggtgcctctctcaagatacctgagactaccaggcacatcctcagggctcccaggcagcttctctttatggttgcaacacaccttgaaaatgacatattggggcaaaagaatttcaaaacagcaaaacctttgccatcatcctctcacatagctagggcctctgcacgtatgataacaagacagctaccttagacttatgtcatgccatctaacttacaaagtgctctctcaaccttgcaccagaggaaaccaaagctccaggaagtgacttggctaatgtcaccggttggactgtagcatgatcaggacctgacccctggtacattgacacctgacccagtgttttcatcgggcacttttaccttacaggttgctaaggattaatgatgggatgttttgattcttagtctataagtggatcctctcccaggaggctccaggtctccggatgccaggcactcatgttttatttggtgttgcagctgtgtttcattgtagtaacatattccaaatgctatgagatcaccctgagtctcattgaagaaaagtgtttcaaaagtatgcagagaggtcaaagtattaggaaagttctagaatgtacttaaattctcagtttcttccaggagcccctctgtaacaggctgggtcgtaattagagtatttggatcactgtttcttgaacacattcaacacaaaactgtggcaatgcagaattcaaagagtggatcaggacatttgtgtactaagtagccctgtacatactggataatgattttctttcgtctgttcgccctgagttctctagcgtataccctgtcttgggtaagaatatatcctgaaaagtcatgtgtcaggttgatgtcctttgagtcctattttaaattcacaagtggtatgtgctgagaaaaagcagatcctctgataaagcaaagaactgtgttgtgaaaaaagttattctatccctactcattcatttcttctgtaaatcaggattttaggtatttttttccttaaagctagttatatctacgtagaagatttctgcatacttctcttttttgtttgttttgtttttgaagaacaaagtatataaatgccctctagagtcatagacacagattgaaggtggcaaggtgagcaaaattggcattttgtcccattaccccattttccttttcttttcttttttttatcctaagcaggagagaagtgatctgcaagtttctcaggatgcttttgggtaagagtttcaccataaaaatgtcttcacccacactcctcccagtgtcagtgtgccaggtaccctgtcacctttggttgatgtcctgatggattaagctctggacagagccacacctttgaagaggcttcttggccagattaacacaccaaggaaagtgcttcagtctagaacatgccccgtcgctggggtctggcaccctggcctctgtgctgtgccctcctgcagcctgtgctgtgctctcctactccagtgcttagaaatgccaagtcaaggatgtgggggcaggtgcttgagagagggtcaaagtgctgtcattgtaagaaattattcatcaacctcagatagtatcttccagtaacaaaccatacaagaccctggccctcgaggaggagcctgcaaatgttagctcccctgccagccaaagaaaatcaggaaaagagcaacagggaaaatactttatttttaaggagatattttgccaataatttaaattgcagctttcttctcttaatgaagaaatatgcatttcgtgatacccagcctcccccagttcctctgaagcagagataataataactactatttattgaggactagcagccaggtgcttcagcactttagtattttctgccactcaaaaaatcaatgggattggcatataatgatgccaaagcttggcaaggtgattttgtctgggtttaaacccgggtccctctagcacagtgctttaaaacgtgcctggcccacaatacaaacacaccgtgacccggtgtaaggtgttttgtggaactcaccaaaccactcaataaatatcgactgcatgaaatgaatggctgaacttcttaggacaattttattctttttgatggtcatttcaggtgtcattcctctccacagaatggtagttatcacttacctttttatatccgcacagattaaaagctttggtgactgtcgcttggttccattttgtgctctcctccaggctggtgatgggctggggtgggccgagagcaaagtgtcagtgcccacagcatgcatgagctactgctttcaggcctggagatgcagaaggtgggccttacctagctgctcttttacttgctgtgattgtgtaaggcagaagttcacccttgctctgcagcaaccatcacagagagttgcaccagccagatttgcgttcagcatgcccaatgatcaacatgctgttgaaaatggaagtttgaaaggaattgaaagtagaaatattcaccttacaggacaggtaacacttgcccctaggccctactttaaggatttggctgttccccagtatagaattagagaacgtcagagcttgaagggaattagagagcatctagcccactccactatccctgctcacctctgcctctgctgacagagaagctatggacaagaaaggagaaccgaaccactcagaccaccacagtccttggtggcaggccttacactggaggccacagctctgccttctggtaccttccaccatgtggcatctagctgcaagggaggctgggaatttaggttctgtccttacagtggggaaagagacttaacccaggagtttccccaaatatgggaaatctgatataaatgggcttgcttaataattattgccattcttacaggctaaaataaaaatcagatttcttcactgtgggaatagattttcctgagatgttaagggagctcctgctttgtatgcccttaatcttttcttgtggtaatgttttagggcggttccattaagcacgcaaatggtcatgatatcttttaagggttcctcctgctctatgagtcttcattttcaacacgtgaagaattcagtataacattttccatttttcactaaggctaaacttatacacactgacatatccactttaaagcatcataaaacagcatttgcccttgctctgtgctcaatttttctttccttggaaatgctgagaagtcgttgcctgttcctggtttttgacgttggctaaccacctactgctaaatgagacgaattgaaataatggtctgaaaactgaatcgtatggcattcatgttcacaggctgaccaagccaggagggactggaattgatatcttccatggaaaagatgtctaacaacacaaccgtttgaatcaactcacgtttactaccaggtactcctggtactaaatactataagtagcagttcatttgtttttgtctttcttttttttttctttctttctttccttctttctcttttttttttttttttttttggtcttttctttctcttgtgtaaatataaagctcccactgaaatctacttaagtatcatatctggaacttttctagtaagtagtggaaaatcagtttgtctgaggtcatctttcccataaaaggtgttgaagtcaaaatacaacatagcgatgaatttctcaattaaacattgtattagcgaatcacagaattacaatttgaggaatacacacagaccagagtagtctttggtatgttcaaaggacaaagagaagattggggattttattagaaagagaaatgttatgtattgttttgaaagaaggctcattggcactacagaagcttttgggagctggcaaggtctgatgagtgaggcagcaggtaaaactctagacaagaagcaagacaactcacagcaggtcatttcagcagctctgtgtaaaacaaccttagggtcatagcaagccttttcagcagctgggcttgcagaaaattcacttcttggagctggtgctatatgtccagagtgccccagcacctcgactctgatttagttgaatatttcaagaatgactcaattcgtataatcaactttcacacacgctttttgggcgctggataagattatcagaggagataattacgctacctccagacctttaaaagtgagcctcgtctagatctgatagttatgaggaattctacttgaagcctatgagattaactagacgatttaggacttaggactgagtccctaacactctagtaatctatgattcttaaaagttaatatttgtatttatatttatatttgcagcccatcaataattacattaatgatgaacttggttcttagttttgaagcatcattcatgcatttggtcaatagcatttactgtgcaggcactttgttagcagccggggatacagtggtgaaaaaagtagacatgaagcttcatgaagcttatattatagtgcagcgcccataagcttttcaaaatcttcaattactgtaatagtgtttcttggggccagacgtggtggctcacgcctgtaatctcagcactttgggaggctgaggcaggcagatcgcctgaggtcggaagttcgagaccagcctcatcaaaagtggtgaaaccccatctctactgaaaattccaaaattcgccaggcgtggtgatgcacacttgtaatcccagatactagggagactgaggcaggagaatcgcttgtacctgggaggtggaggttgcagtgagtcgagattgtgccactgtactccagcctgggcgacaagcgagactctgtctcaagaaaaaaaaaaaaaaaaaagtctttcatggaggacttctcatacacgtgcgcacacacacaacacattgaacactttattgtttctgtagtgatggggagacagctaggtgtggagacctgtaataagtcctagtgatagcgagccccagttcccacctgggcagagttagatttatcctgtgtaactgaccaattcggagtgatttggagtgtttctcttcttgatgaggcccaggggccccactgcacttggcctacttctgaaaggagggaaatgctgctctcagtaatcctctgctggggggcgaaggtgggagtgattggattacagttcctttagtagctgcgtggagcttgccatgtgtcagaaaaccttagagtgtagtcatggaatcctcagtgctgacaggaatgcactctttttaaaataagtatgcctctctgtgttgggatatatgatcaattgaagcctctgggcagaatccattgatggaaagcctatatttaaaaacgaacctagtggaggtgtatgatacagaggatatggtacagagaagaagaaagcagtgaggtctcaggtgttggaaaagtcaagtctagacaagaagcaagacaactcacgatgcagacgagatgactggaagagtctggggaactttgggagattaaaggatagagatggtggatgctgggtgatttctacctgtgagcacgattaccagatgtccttgatagtgtgcaatgcccatgccatttccttcaggcgacgctgcagttcagcgtgcaagatactgccacacagttgagatgcagatgaatttggcacatgttcatgttgatgttgcccatgtgattaagcttatatgaagtggtacacacaaaaaaagaaccatttccttccacagatatttatatttagggaaaaatgagaatatttaaagaaaagctgttatgcattgtagaagtaaaattgtagaaggtcttctactatctgcatttacttaaagttaaaagttaatcacttccagcaaggaactgcacatgtggaatgttggtggtcaatgtgttatgttaagaaacttaaaaccctcatttctacaaatagtcatatgatacgactcttcctgaaaactagagttgggacactggtaccctaagcacagcacagagtaccaggatgcctatctgactggacctttgccagctctgggcatttgctcttttgttagtctttggcatttattttattttatttttagaggtagggtctcattctgttgcccaggatggacagcaatggcacagtcatagttcacggcagcctcaacctcccaggctcaagagatcctcctccctcagcctcccaagtagctgagactacaggcatacaccaccatacccagctaatttttaattttttttgtatagatggggtctcactatgttgcccagcctgtcctcaaactcctgggctcaagcaatcctcccaccctggactcccaaagtgctgggattacaggtgtgagtcactgcatccagcccaatctttgacggtttgacagacaaaaaactggcatcctgtggttttgtccgggaggtttttaaatgcctctgcccatagtgtagcagtgactatttgagactaaaatgctttttttaggggaacagtttatttgctattttcttattgggataactttttcagagcagcctccccccatagtaagaaaattaaaggtattcacgatgaaccaccctgatgaaaggaagaagtgcttagagcttccgtgtcccacattctgtgtgggattgggaacctctggcatgggtcccagtgatgatattggacaatcccctggtgtactgctcagtgggaaagtagatatggcagagaatgttacttgacttctaataatcattttccccatcttccttgttaatagaaccactgcatttttaatttggtgacttgcccgattaaatgcaataaagactacatgtcttagccaccattgcagcaaggtgctgtcatatcactaagttctggccaatggttatttttaaaatttaaatacattcatttatttattttaattgatgtataaaaatggcatatgtttattgtgtacaacatgatgttctaaaatgtgcatacattgtgggatgatgaaattgagctaattaacatacgtatgaccttacatacttgttttttgtgatgagaacacttaaaatccagtgatttctaagaatacaatgttattatctatagtcaccatgttgtacaatagatcttctaaacacattccttctgtctagctgaaattttacatcctttgaccaacacttcccaacccctccgcccagcccctggtaaccaccattcgactttttgcttctatagctcaacttttttagattctgcatataaatgagatcatgtagtatttatctttctgtgcctggcttatttcacttggtataatgttctccaagttcatccatgttgtcccagaggacaggattgtcttttttttttttttttttccgagacagagtctcactctgtctcccaggctggagtgcagtggtgtgatctcggcttactgcaaactctgcctcccaggttcgtgctattctcctgcctcagcctcccaagtagctgggactacaggcgcccaccaccacgccaagctaattttgttttttttgttttgttttttttttttgttgttttgtttttttagtagagacagggtttcaccatgttagccaggatggtctccatctcctgacctcatgatctgcccacctctgcctcccaaagtgctgggattacaggcgtgagccaccacgcccggccaggattgtcctcttttttaagactgaataggatccattgtgtatgtgtctttaccacattttctttatctattcatctgtcagcggacacttaggtgaattccatgtcttggctaatatgaataatgctacagtgaatatgagagtacaggtatctcttcaacatattgatcttatttcctttggatacataccctaaagtggaattgctgaatcatatggaagttctgttttttgttgttgttgttgttgttgttgttgttgttgttgttgttgttttgagacagaatctcactctgtcgcttacttaagttggagtgcagtggtgcgatcttggcatcttggctcactgcaatctccacctcctgggttaaagcgatgctcttgccttagcctctgagtagctaggattacaggcatgtgccactgtgcccaggtaatttttgtattttaagtagagacagggttttgccatgtaggctgggctggtctcgaactcctggcatcaagtgatccaactgccttgacctctcaaagttctgggattataagcatgagccaccacacccaacccatatttttaatgttttgaggaacctccctgttgttttccataatggctgtaccaagttaaattcccaccaacagcatgtaagctttctttttctccacattctcaccaaaacttagcgctcatctttttttttttttttttttttttttttttcctgacagagtctcattctgttgcccaggctagaaggcagtggtgtggtcatggctcactgcagcctcaacctcctgggctcaggctttccccccacttcagccacccaagtagctgggatgaccacaggtgcacgccactacacctggctaatttttaatttttatatagagaccaggtctcactatgttgcccaggttggtctctcatctttttgatagtggccgtcctaacaagtatgaggtgatattcattgtagttttaatttgaatttccctgattattagtgccgttgagcagtttttaaatatatctgttggccatttgtagttcttcttttgaaaaatgcctattcaggtcatttgtccattttttatttgcatgattttcttgctgtagagttgtttgaattcctaatctattttggatattaaccccttatcagatacatgatttgcaaatattttcagccatttcataagttctcttcactctgttgattgtttcctttgccatgccaaagattttttagtttgatgcaatcctatttgtctatttttgcctttaggatcatatacgaaacatctttgtgaatgtcatggggtatttcccctatgttttcttccaggagttttacagcttcaggtcttgtattacatgtaagtctttaatccattttgagttgattctttcacacggtgtgagataagggtctcatttcattcctctgcacgtaggtatgcagttttcccaatactatgtattgaggagactgtcccttccccattagccagtgggtattaacgaaagagtgaagtgttacttgtagagtgtacccttaaagagtcaagggcatgcccccttcacccttgctccttctgcggtctagaatgtggacataatggttggggctgcagttatcatcttgcaccatgatgtagctttgggaatgaaaggcagtaaggcagaaacagcaacatatctagagaaaccctatgtccctgacattatagagtgccatgccagccctaggctgcctaccgtggggctttgatgtgagaaagagaactcttacttgagccactgttattttaggttgcctgtcacttgcagtcaaacataatcctaactaatccagtggggaaatggctctaaaaggagctatcatccaccttcctaaatttctaacatttggaagccgcttcttatagcaagtctttttgttacaattacgcagtcacaatggataactatctgcactttactgtggactgtggaaaggtatgaagcacagaggaatgaaaatctcacactcactcactagaatgtacttatactcacatttaccaaaatgccacttacagccttgtgcataataaaataaagtaattactaattagtccgtcacgtgggcatccaaaccatacttgaatagtgacttcagtgatgtgctgagagtcgtactcattagagtagtcatagtttctacaaagggggccttagaaatgggcttacttgaagcatttctctaaatatacaaataataaattggaaaccttctggagtgtgtataatgtatacacaaatgtgtgcattggttgttatactcgaagtagcagaaaacatctgctcctgactttaacacgggaacaaatgaccccagattattagctgctaatagatttttgtagttttagggaaaggagaaaagtaccatagccttctttgttctataaagaatacgtattttatgtattctgtgtttgaaccatctcagcatcagaattgactgtttaatagttgcagttgtttaataatttttttttagttaatgcaaaatattggaagtcatctccaggcttctggcttacagagagtccctgtagagatagcagatcactgcatctgacatcgtcagctgtggttgctcaaacctctggtccaggaagaggcagagtcaaccttttttcccagcagaatgggattctagacatgcagatcagctctcctaaatagtcttagagtcagagtattttaccaccggatgtgaaccctggagatgatctagtattgtccttcaagttgaggaaactgaggtccagtaagtccaacaagacctacccaaggtcacagtggcctgggtggcacagggctggaacccagacctcattgttcttgtcatacagcatgaccttccatttcaaggagactaacaaataccaagtttggcaatgtatccaccctcacttttatttgagaggttacaaagcaaacaaaatgagatcatgtcataagcagttctgtcctaagtgggttaggatttatttcttcttttctacattttttttttaaatcagaaggtatatccccaagaacaggaactaaaggaacagattgcttagacccttgtgactctgccctggtggtggatcattaatggtgtagaaaatgagggcagtgctgggcaggcagtccagggtggggtgcatgcctctttaagagatttatgtggaggtctgagctagggagacagcgcggtggtacatcatcatgcaggcgacatcagagactttcttcttcgcttgggtgcattatcataaaaagtgatttagactggagctgattgatgcaaatggccctatgttctttcctatcattagcggcctctttcagtggccagaggcagtgattaaagctgtcatttggagctgctcattaaagacaagccccagaatagcaagaggaaaaaaggttggagaggcatatatatacatatatgtgtgtgtgtctgtgtgtgtgtgtgtgtgtgtgtgtgtattttttgccttaaaagtgcatcattcttttctagattgagccactgaaatcaaggctgtagagacatttccactgagaatatagaatgctgttttgcaagtaatattagattttcggagtgtcatagtagattctgatgacagcttgcctacatattatgaaaggagatgaggagggtattgtgttaggtgtgttttgttagggattgaccctggtgagaactcattaagtctccctcctcccaggctggggacttcagaggcaggccacaggagagcagaggggagggttgccgagagtggatggcctcagtaagtcccactgtgacagtgttgaccccagggatggacagaagaaggagagcagggaggaggctttttgctgagcccagatgatatagatgcctggatgtcactcagagagaggggttggtgagaggaggcccctaaataggaggggaatggaacaaagcaagatccatagatgcgagaagagaaattaatcagaacatgatccctggctccttggagtcttccagacagggcgacatgactagttaatcactcttgtggtcaaattgggcttcagtgtgcacctgcctaccttttcatcaacatgcattcacatccacttacgcactgatttttagtttagtgtcccagtagtacctaaaagtgacaaaaatcccaagctccaaatgaattacagcatgccccaaatgaaggctagggtagttagtgggtggcggctaaacagggagccagggctgtgaagccagggagggagccatctttgtttcttggaagaaaccagtttgaagtcagagatgagactggctggctaatcctgcacatcctcactggccagttgatgtcttactgcccaaatcccaccaaactttcatacaagctagtctacagctctcctcagaaattcctctgggaaaggaaaaaaataagaaattatcaatttaatttctcagtctaatgaactggtcttatacataaaaatttaaattacttttttttttatgaaagtggggaccaacatcatttatgcaaccaccactgtctccatgacaacgccttggatgtggcagctcatgtgacttcacagtcacaggcccttgaaatgaagcaaaggaaagttttagtttctcttctgtaatttattggactctagggatgctcacgatggtgctaagtggaggtgtgggggtttctttttgctgtggacagtaaatagtgagaaagtggtgaaattattccttcctgcggcagggattggaacttgctgcagagagtgcttccttgtcagcctcagagccagttgacagcttcagaggcgtggcttttgtcctcctctctgctgcacccccacccccacgctggccttcttagcctgggtctggcgcatcagggcctattagtactgatgctgggctgtgatgttcctctcctcggggagcacggcagcagaactgaacaaagtcactggtaatctgtgcttacagcctcccccctggggagaaagcctagccagctggcactctcacgctgagcacattcacttcccctggctggtcggcagcctggcaggggcccagaggctggccggctgcagggctaacctgcaccagcaccccaggcagcccagctcaggatcacacacgcattgttctctgccttccagactggacactggctgaactcacagcttggacggtgtggctcatctgcttaggccttcccagggtagctctctagaaataaaaattacgaacgctggatgaagaacaattggctggctacattgaggttaatacaggaccatttcccctgtcgtctttttcctttcccaggctctaggtcggtgacatcaggaagatttatcatgagttccgtcttctgtagttggaaaggagatggcacatctgccttgggtgatggggtggaagagtgggtggcagggatgagggtggagcaggaaacaccagtagtcctggatgtgtgtgtacttgttagaaatacctgcagggaaaaaagaagcggctggtctttggatccttgctcaggtggaccttccagcacacccattgccagatacaacttctgtcgaactaagacttccctcccatgtaccagaatcttgcataaagggagcagaggcttgagaggcccctctggggaagcaatgtctttagtcactgctctgctcacaaggtgcaggaaaagtctagatttttctcagttgactttcaggcttagaaaaaaaaaacctctagaagatttatggcttgttgttgttgttgttgttgttgttgttgttgttgttggaaaagcatttattctctttaggagccatcacacaccaacatgtatgtggcccttagttggcgtaggtagaggtcaactgtgctgctttcaccaggtatacaggtgtcctaataagagtttggggacagtgcaaaacggcagtgtgttctgttcaaattttttttttgtcttgctctgttgcccaggatagagtgctatggtgcgatcttggctcactgcaaccttcacctcccagaatcaagcgattctccacctcagcctcccgagtagctgagattacaggtgctggccaccttgccgagctcatttttatatttttcagagaggtagggttttgccatgttgcccaggctggtctcgaactccagacctcaagtgatctgcccaccctggcctcccaaattgctgggattacaggcgtgagccaccacatgcagcccagaaacttttcttttagcagagataaaggagggatttctccaaaaagacaacaaaaaaggtgcaaatgaattagcttctgtacatcttcttcagattttccctattctgttagtgagttcactgagaagtggagggaacaagaggaagaatcattgctaacatgaagccagtgctaggccttatgctaaaactcttacacaggggtcttatctccttctgacagtgcagttgggaagcatgctcaccagccccatgtggcaggtgaagcccctggctcagagcctctcagcagctaatagctaccacgtggaggctccaggatctaagcccaagtgccagcctaaagaccccacgctcttctccctggctgagtgctgaggtaccattcggctttaacagctgacggggctgatgcagctgcccggtgacaccatgtgccctgctgtgtactgcagttgccattttgcatttatagtgggattatctgatgctccaagctccacaagggcaaggtcttagtttttacatactgttgagtccccagtgcctgacactgtgctctgcacaccatatgtggtcaatacatacttggcaaatgaaaaagggaatgaacgagtggtcagggttaaaaatcaacgtatctttaaagtaagccaatgtgcttcccaaacccaaagaaattcttctcaaaatagagtgtcgaatagttttttttttttttttttgattggagaaacttgagcatgtttttaggccaagcagtaggaattattagagagggaatgatggcactattgatggaacacggtcccagaggagatctgaagtgacaagattaagagcagagaagaattttcattagcagaaacagggcacttcctccttagagaccagaggtgaagagagaaaaaaaggatccggtagtcatgggctatgtatcacttaggagtgctttcagctgcaagtaatagcttgactagcagtgcctgaaacaattaaggatttatttttttcatgtgatggtaagacagctacagctgggtgaccactgtgttgcttcagtggctcagtggggtaagggccattgtcttcaagactttcttggcctttccctcatgagatgcaccttctagcatcacatttgcattcaagtaaaagtccgtgctatccttgcagacacttacttcgcatgctgcctgctctgctgattgaggaaatggtcaagactaaatgaccactagtccctccttcaggtatgacagtggagtccaacggttagtgggatctgacctccagcgagcttatttctcctatgatgaatataagaagtttgtggccgggctcagtggctcatgcctgtaatcccagcactttgggaggccgaggtgggcggatcatgaggtcaggagatcaagaccatcctggctaacatggtgaaaccccgtttctaccaaaaatacaaaaaaattagctgggcgtggtggcgggcgcctgtagtcccagctactcaggaggctgaggcaggagaatggcatgaaccagggaggcagagcttgcagtgagctgagatcacaccactgcacaccaacctgggcgacagagcgagacactgtctcagagaaaaaaaaaagaagtttgtgagggattcctaagaaagtgaccgagggagaggaggaaggggagagttggaaaagttaaatgattcacttgtaagctactagaactttgttaagtttggggacatcatggttttgtgaaatctactttcgctgaaatttatgtccatttctttgcctccttctctctgcacaccgcctctactcagaaatttaaccatttacacacaacagaaagaattttcctcaagatcgctacttttgcccagtatttctgattgtctttctgcttcacatctccagaaaatgtattccctttaacaacttaacttggagaaggaggaaagaaacctaagcagatatgactccacctaagttttatgaggaaccttcgaaggaaactctgagaaaaatgagtctgtatctttttctccctcttagaccaggcttttgacatctaccagtgtgcacacttaccaattaacagttacgttcttattggttgagagaacaaggcattaacacgtctggtgactgctgcgctggtcccgtgagacctgtagagaggccaagtggttgccgtgggcttttgctacctctttgggcagtcactttgcctgtatgagacgaggaggccggaccctctcagctcctgacatcctctctaacctcctgtgatctggtcaccctgtgggaaagccaaggcagccctggcccctctccagcagtctctccctggagggctcggcctgttgggttttacttagctcgcagtttatgccttcattctcctctgaccctcattaaccaagaggaaaaactaattctagaaaggactccatttccccccatattgtatatttcatatccacagagcatgctgtgccctattgagaattaaactgcgatcactaacctcatctcatttgtgccaggggtcttgttcaaaagctgtttccccagcaaagcagtgccgtgggttaggaccccctcaccccacacacacatgcttggtggagtggttcccatctctttttaatgcctttggcaggggacagacagagagagagaaagagagagagagaaggaaacacagggagagagagagcaagagaaaaaaaagagaaacacaaaagaagaacaagagggaaagaaaagctctcgaacagcagccctgtgttttgttagaacattggcactgcatttatcaggattactggagggagagcagggtttgatcctcttctccactgggagagggaaaagctttattgtaccttttttaacatctcacagttagatcagaacaatacactgtgtatgtacatacacaccatacgtatgtgcctaaggatgatattctacttgggacacaccctgttttcaaagcatggctgaattttttataaaggccagatacagaaagccaccaggctctccctgggtctccctttccagcagaccttccccccctccccatccccttgccggacttggatcagcaggattcactcctgtcaaacaaattagagcatctatgaaatggggctatcgacatgtgtgacttgatctgttttaataggggcccggtgggagtttcctccctgccccactgagctttgtatccttcacggaaaggcagacggggcgcgggaggatgctgtggactttaaccctttgctgccagcaggttgcctgcctcctgcgtgcagccgcttcctttttgtgcctggccattgtctggggagtgcgtgcggcctgccatgctcttcatgcttgttatctcacaggagacaagctcaccccaggagaggaagagagagctgcgttctgaagcagatcttttgatttcctttcttccctctcctctctcaaataattagaagtgctggtcaaggtattaaaaaaaaaaaacagccaaaggggagaaaatatattgtatattttataaccctggcattttgtttttcaagaggtgttgtcgggctgccatttgacccttatgtaataattagcatttgagctgtggcagctagcaagtaggtaagggagaattgcctgtttggaggaaggatccgaccccttttaagtagaagagaagagggaatttgcctctgtcagcatttcagatgcacccccatgctatcactgtctccctggccctctgttcctgactcagttgctaatgacacaatctcccagcgcctgcctccgcccatggctcacccccacacccattcactgttcaggtacttgagtcccagccacagagctggaaggctggacagcagctaagacaagaggcagaggccttgtgcacagtcctgttgccgagaagcgcttagcaccctgccaccctccctgtaccgctctgtaggggtgcagattcccaccgagcccatggccttacctgcacctctcccttaacctgggagtgctgcgggcagaagtcaggacccgctttcttttcttgctcttctttactccttagcacatagcactggtacacctcaatttatagaacagacaccttcctgaaaaactgcatgtaaatgcaatttttgacaggtggaattttgtagctcatagatttacattgtttagagtcagtcgaaatgaagctgaaaacacaatcatattccctgtacttactggtgtaggaacctgagcacacagctcctttcgtaaagtgagaaattctccagcggagcgtgtagccgtaccctggtttacctgttcaaggagtcctatgctgaagaccacatcttatgggcatcggtgtgcagtaggcgctcagtcacaccacgctcatcactgagatgtggaaggaaaggggttggtcgggccctttgctctcctgtgctggtggccaagcccagggcttgggttgtaaaaccacaggcctgactgcttctccttgaattgtcctgaaccttgacccttagcgccctcaggtcgttgtgttgtttggattggtgatttcattaggatttctcacccttttcatttatttcatttaggcccgaggcagaacttctgggagctagctgatcatctgtcttttaattttcctttagggagaagaactccactgggctccatttctccctctcattgcttgctggcactggctccatggcctctttgttgtgtttttgttttgtgttttgttaccgtcccctctggcaccagatcaaggggcagggagggaaactgggacgttttggaggagggttgccaaagagttgttgcaggaaagaggcatggtcagaagaccagttcagcagctgagcagcgacaggagcacttccagttcctccagggcctgagctcagagcggggaggaccatgaggggccgcggtatggcggcggtggggtagggaaagagccaggagaatgaaggaagagcagcagcttatttaatttggaaaaacaagggaaaagctccagtccacatacatctcttctttcttccccttccctgatgctcatgaatagcacgtggaagggttgagtgtttctgccccacagtgtggcttctgccgggagtgggggcacacattccaggcttctgtgctgcctgggtagctccttctcctggcctttcaggtccaggattacagactcaaactgtattcactgtgggggcagggtggggggttctcccctttttttctcccatgtcctagtcatttggtcgctgcaaaatgattacaacatgcaggagatctcttgccacctgaaccatttttaaatcctctcctgagtactaagcccagttctttccaaattatttccagcaactttcgcctcatgtgtaggtttctctggattaatccccagtacaatcttttccatcctcaaaagtcacagacattttagtttttctgatttcatgtcccaccttaggtcagatctttgaggggtgggagggtaggaggtaaggaaccactcctcatgcaggatattagattgagaaacagaaacctacaaaaattcagctccacttatttttaaactgatgatcatgtctgaattagatcagagcaaaagcaaagattaaggaaaaaggcctagtacaaactatagcaaacacagtggaccagtgctgaactttgctagctgttctgggacgctacagctaggcaggcttacgttagtgcatagtcattctctttttttttttttttttttttttttttggagaaatggagtctctgtcgcccaagctggagtgcagtggtgcaatctcagctcactgcaacttccacctcctgggtttaagcagttctcctgcctcagcctcgcgagtaactgggactacaggtgtgcgtcacgacacccggctaattggtgtattttttagtagagaccctgttgggcacggtgctctcaaactcctgacttcaggtgatctgcccgcctcgtcctcccaaagtgctgggattacaggtgtgagccattgcgcctggctagcatagtcattcttaagggcatgttcagaccaagttcctctggctattcttggagcggagatgtcctggcaacttcatttctctgtcgtctcttacaaaaccccctttctccaagttctcttaaaaatgcatctttgacttatattctctcctgcctgaggggcctgccgttgtcctctgttcctggactttcacctcatcctgccgtctagacctggcatctgttttggtcagtgctctggatgttctttaagcagcacattcttgctgagcagaacacggtgttcagccaggttccatagctcccgtcatccccaccgttgctacccaggcccttggttgtcctgcactcccgctaacccccagactttcttagaatcaaaacttcctccagttggatcactgggcttctattccataactccttcatttcctcttgccaagaatgttctttagcaatccgaagttatatttgttattaaatataagacttaaaaaaggcttgtatttttcccctgaaatcagctttaatgaattatgacaaaacttaactcatattgctaaacattatatgtaatgggtgtgctctttcaacttagggaaaaatggatccagaactgttggcagcctttacacgtctttcatcggcctttttctttgtggaccaaaagaaagggccaaacttagccaaaaccattggccgctgatactcttgtgaagactgtgttttattaccactgcaagagttgggggttggccaaaatgatacccagacatttcagatcttaatcacaggtgctgaaaacagagatgtgtttgattctagaccattacaagtgggagttaattaccacatttcaatgaactctccgtgtgccctcctgccatagcaattagcaagagagtggccgcttgtgtgcttgatggtgttttatgaccatggattatataggaattaggaatggcttcgggaagcatttggtcctcacagttatccaataccagcatggcccaaccccagatatgtcaaagccacaactgttgcgtttggcaggcattctacaaaatgtacttggtcaatactaaatagtttcatttagcagaccagtttattcaagtgcctgacaggagtttcctggattctcacctctcctgagaggccttcaagagcatcgctgaaggtttatctacagctagggtaggttatgagtaatgtcttttatgaaactttgcaaaccaactgtcgttctgttcaattcccagaggcagatttttagggttgctgtgtccaatacagtagccactagccacctgtggctatttcagcttaatttagttaccatcaaataaaatttaaacatcagttcctcagtgacacactagccagtttcaagagtacagtggtcactcttgtcacagtggttattgtatcagacgatacagaacatgttaatcatcatagaaagttctggacagtggtgctctagagtctcaacatgtcacgtgttcaggggatcactggatctaaagccattccttatgggaaatgttggctttcttgaaaatacaccagagaccagagaaggtcaccatgtggagaagaggcagccttcactctgccaagaatgctggccaggcttctctgttttatatctcatcacaatgagggccattctggccctccaaaatatggataccaacctttacgcactgtcagaaatgggccacaattcaaagtgttctctgctgtttctgatgaactgccgttctccagctcttccctgaaatggcaaggaaaagtgatgttccctcaagatctgccaagggagatactccctctctctggtaatcgtcgctgtctccttccatcaggttagactaccagggaagtacctacctgaatagcattagcgtatcttcctcactagaattatctttgatagatcatactttaatgtttataccttgggcttattgataattttaaaaaatcaatatgaagataaacttgcatgtgctgtgaaagtcattcattactaaagatgtagaccattcaggtaaagcactgcataatactcaggatgtgctggtctctctggaagaaccgtgggacctccttccaatggagaatgcaaatgatgtgacccactgttttacattttgccccatctgcccagaactccagagttcaactcagcactcatttatattgacttgattagccatggtggttagaaattggctttctctcccttaaccaggtgtttgattttctgttttagttttaataaccttattgtgtatatcttttaatttaattctccttaaattgttttctgaaagaggcgaagtataaacaaatgaatacaaattttattttcaggtccccacatttgatattttctgttttgaggtagtctctatgcaagccccaaccccaggccctggcataaatgacaggagggcccagggacctcctggcagtctcatttttctttcataccctcctgagtatctagcacactgctaaacatatgctgcttagagtgatgtaaggtagagaaacactgtgccccgcgtgggaaggcattacagaataaacttaggaaagagggtcacctctcagatttagtcagatgacaaaggcagcactggcttccctggggtgtagagataggaaagaatttgaataattatcatcattatcatcaccacattcattaaaccccatctgcacatggcactgtgtaagtccccataggtttttttctctgccagtgagagagaattttgtccagcagggaggcgaatcctgagctctccccagctcaccagtttcctcctcgggctgttccactccacagccagcagcctggctcatcactgaggttgagtccattgcctcctatgttcttgggagatctctgtggtccttggcttataatcatctttcacgttctaggactctggactttccctttacagcactcaccacagtagcaattaagaacattgatgcataatgaattagagattctcttgtagtacattttatccaactagggggtcatctctgttctctgcacccccatatctctagaaccccccattatgtgtggtatgtagccaagtgcttgatgcatattcttagcagtaaatagcaggaatgaatgaatgagtgtgtatccaatttgactttagagttatttcccgacttacagccgttgaagttgctgtttcctccacgtgttcaacctttgggattcacacaatacttgacagtcacagctctgccatgggggacatcattacacaaagcactcctcaccagtagtcagatggcacttgatagctacaggcatgtgaatattcttttactgtcaacttttgttgtgatttcacctaaaatgtgataagctccttgaggataaaggctaagtcttacttcttcgtatttctggtaaccgcttgtaccaaacacctgccaagcattgttgattgcacctatgaggaggtgagaaagtgccaggccgtcatgcccctctatacaaacatgtaacagtagactctggttcatcaggagtaaatgacatgatatgtgatagaccacgtacattcgtggctatagataggtgagtaactgtaaccatatccaattgtgagcaaaagtgttttaattggtggttttaaactaatataaaattggctaaatcatcatttttcagctttcgaatcatctgaagacctttttttattttttaatatttagtcttgttttatttatttatttttgagatggaatcttgctctgtcacctaggctggagtgcagtgatgcaatctcagctcactgcaaccttcacctcccaggttcaagcgattctcttgtctcagcctcctgagtagctgggactataggcacacactaccacacccagctaatttttgtatttttagtagagatggggtttcaccatattggtcaggctggtctcgaactcctgacatcaggtgatccacctgcctcggcctcccaaagtgctgggattacaggcgtgagccaccatgcctgctctgaagatcttttttaaagaactgatagatgtccaggtatggtggctcacacctgtgatcccagcaactcgggaggccaaggtgggaggattgcttgagcctaaaagtttgcatccagcctgggcaacatagcaagaccttgtttctaaaaaaaaaaaaaaaaaaaaaaaaaattatgtaaaaacttttttttttcttttaagtactggtaggactggatcctaccacaggaaaaaaataataatctctagggctaggtaccagacaatgaaatatattttttaaataactcactttttaaaaaatttccacttttattttagatttaggggctacatgtgcaggtttgttacatgggtatattttgtgatgctgaggtttggagtatgaatgatctcatcagccaggtactgagcgcagtacccaatagtttttcaacccttcccctcatccttccctctcgcctctcatagaccccaatgtctattgttgccatttttatgtccatgtctacccagtggttagcccccacttacaaatgacagcattcagtatttggttttctcttcctgcgttaattcacttaagataatggcctccagctgcactcgtgttgctgcaaaggacgtgattttgttgctttttctggctgcatagtattccatcgtgtatatgtattacactgtctttatccagtccaccgttgatgggcacctaggttgattctgtgtcttcactcttgtgaatagtgctgtgatgaacagctgagtgcaggtgtcctttatggtagaccatttattttcttttggatatatacccagtaatgggatttctgggtcaaatggtaattctgttttaagttctttgaaaaacctgcaaactgctttccataggcactgaactaatttaccttcccaccagcagtgtataagcattcccttttctctacagccttgccagcatctgttgtttttacttttaataatagccattctgactggtgtgagatgatagcgtattgtgattttgatttgaatttctctgttgactagtgatgttgagcattttttcatgtgttgtatgtcttcttttgaaaagtgtctgtgtgttttacccatttttaatggggttatttgttttgtgcttgttcagttgtttgagttccttatagattctggatattagacctttatcagatgcataatttgcaaatgttttctcccattctgtggattgcctcttttctctgttgatagcttcttttgctgtggagctcagatgtttttaatgtgcaaacatagttgagaactactaacccagtcttcgggtattaatcagcaccagctcattattccatctctgccaacactcaatcacaatttgctctagtttggtaactgccctcgttcagatggagcagagttggaattttacagtgtagggctggcgccagttcctgtcattctccatccaattccgagccaagtgtccagccttagcagggatcccacatgcaatggaaaaagggatgctttgttctcagaatggcttattcatttactagatgtgcatttagcatctgttatgtacacggtggaggaaaagacagttaatttctgtgctgtgcagtcaaggttgggataaacgtggtcaggatgtcatgggagcttcaaagaaaggaaacaggcccctgtgtagagtcatcaaaagagactttctgaaggtgatattaaaaccaagccctgaaagttgcatggaagcttgccgggatactctttccccgtctttcacctggctgatggaagagcatgggcacaggtatggaggtgtgcacgaaggtggctcattgatctataagtagaaatttctataaatagaaattgtggttgaagcacagggcacaagtgtggcaaagcaatgccttggaagccatgcgggcaatgttgagagacagcccaaagaggtaagcagaggccagatcaaaaaaacatgtttatttgccatggtgggacagatttaccatgaagctcttgaagcttaagctgcagggcccctggggaggggccacatgttgggctttgttccttttttaatttgcaaaactatatatatatatacatatatatatagtatatatatatatgtatatatatatatatgtatatgtatatataaattatataagcttcaggctctacaaaaacctggatctgaagcttaaggacctttactttttcctgaaggtaataggagttaatgaagaagggaagagatgtgagttttagctaggattataatttatcattgaaactgagatactttgagagtaaaagaccatgctattaatagtatacctacatccctccccctcccccccaaaaaatccagtaatcagaactttccttggcaaaaagcagtgtatgaagactttgattttagcccacttggttggtaatcttaagatgcagttacaggaggttgagactggagcagggagaccagttaggatgctgttacattcaaaggagatgatcagggccagaattaagacagcattaaagaaactgaagacaagcagttgggatcctcaggatgggaaagcacgggtaaacgggcaggagacctctgggcgccatttctgaaccgggcagctgggtagatagatggcggtgtcttcccttggcctgatggaacagggagggggtggcagacattggggggaagtggggattccagctgaatgtaaggatgtcgggaagtgcctgtggaagagccaagagaggacgagtttagtaagtactgaggttctggtggcaggttcatatccatcgcggggcagtcgggtttgctgtactgccacagatgccaaccgtctgcagatgccacttggagatggaaaccacctaatgcaagaagaggtcaggtagcagcatggatggctcagtgcaaaccaacccttctatttaaaacacagctaggccaggcatggtggctcacgcctgtaagcctagcattttgggaaaccaaggtgggaggatcacctgagctcaagagtttgagaccagcttggccaacagggtgaaacctcgtctctactaaaaatacaaaaaattagccaggcgtggtggcaggcatctgtaatctcagctactcaggaggctaaggcatgagaatctgctgaaccggggaggccaaggctgccgtgagctgagatcgtgccactgcactccagcctgggcgacaaagcgagactccatctcaaaaaaagggaagaaaaaaaaaaagcccacagctaaaagccagcccttctgtggtcatagcagccaacatacatggtagggcctgaatccatccccttgccacctcccttagcagcctgaatagaggcaggcgcgtctcagatcatggcagctggtgactgacggagcccctgattctctgagctgaccatataagctgaccctggatttacttaaagttaattttcatcatcatcagcctcgctgtctcaccagccccacctaattctaaatttacctaaggttctttttttttttcttttttaaaagctttaggtctatattttggacagaagatggtcttttagctcctgatctcatacttaaataaaaatgctctcatattctccttgatatatttgcctattggatttgtttaatgaaatatggatttataccataaatattggagtcgtgtagtccatatttcaattaatggatcatttatatgtcatgctaactttgtaattactgaaatgtaggaatagagtggattgaaatgaatttctgttcatctttccattcctgcccccatccaggcatgtctgagcagcttggatcgcaaaagggcaagatttacacatggggtttgcagaggaaaggggtagggggctcggaaaggcggcctcctctgcgtgtgccaggagagctctatattgcagtgtgctttctgggttcacctaggcagcgttacacagctgtcctcagaggagcggaaagctgggctctggctggagggcccggtcatcaatatgctgacaggccttcatcatcattttcatctcggttgtaaagcacagcctattttccctctttgccaaatctctgctccaaatgtacataactatagatttctgactgagccctgctgccaggaatcaaccagaaagcttcaccagacctctaagacagaggacaagtaaattgtgttctcggctcccgtgaacggggcctgtcactttaactggtttcttctcaggcagtgggtacagcccaggacacccttagtgaacttgccactgcccctggttttctttctctctctttcctgctcttcctctcctgcctgctgtttgctgaccagaaaaatctggctggagaggcccatgcagtgagtgaacatcacatacataattctatcagaatatatccaagggtggggaatcattgttctcggaactagctgagctgaagcccgagcagaaatactaaagtcagtcgtgcctttgagctgcctctaacagcgccctttagagacccatttcatacaaaatttgaagcctgtgtttattgcccattaaagcaacctttattttatggcaaatgttgcagtaattgccttttacgaagagcactttgtaacacacatgcacagttgaaagaaaaccactctggtattgtctatcgggacttaatggcgcaattaattttactccatctgttcctgagactttaaaggaaaatggattttttttttgagcgtactttaatgaagaagataaagcggcccggctggtgtcccacaggctcggcgcagtaagttcagattattgctcagtctgtcagaatgggctgcttccctcagcagcagccacagccagcaacccgctctggcccctcgccgcgccattcctgatgacaaactgccagccagctcccacaaaagcacgattaaaatgtcagcacaggatgacgaaggggccaagagggtcctcagagacaaactgtgttcagtgtgagttaatactttacagcagggctggggcccggcttgctgcgggctggccgggctgctggctcgccttgaagagaacaccagggcaggggctggcgactggcggcggggaagcatgtgcacatgcgtgtctgcactgctgtgtgcgtgtcgggcatgctgctctgtgcgggaagaggctcgtttcagaggaagcgtccaatgggccgttcaggttagggagttccgagactctccatgatttctgaaccgtgggggacggggtggtcgcaacctagaatgtgggctggagagcgctgtcccagtggtggccccgaggccacaggttctgtcccagatgttctcagcaccattttagcgacaagggcagctatgaaaatggcccagctgcagaaagtcattcctcacgaagaaatgggtgtgcagagaatacagtcagcaccatttatagccccatgtccccaaccttagcctttgcacggttggctgggccacagcaaggggctcagcagcaaaatatccttgaatcaatactgctgcttgacagcatctccagccccgcgcccgtgtgtgctaacttgctagggggcagggcgcactctgccgctttggcttagttctcccatgtcccttgattcagtggtgtgaccagaggggagactgcctgtggtgaaaaggacaaggagatttgcatctctggcctcctgtggagacccgatctgccgtcctggtgggcagcaggtgtgagcgcctgccattgtccctaatggttattacaagtgataagcaggacaaatgtgaagtcatctctcctgctggcaggtcagagggggctggatttagagcccctaggagactaggaaattagatggtcagtacccaccgtggaggttgtagcaactccaggctccagagatcctggacaggggtgattccagatgtagactcatacttgaaaggcatcaagagcatccattgttaggacggaggtacagcagtaattagtgcagagtgctaatagaggaacagaaggtaggaaggaggccccagcgaaaggcagccgggggattcggtttcctctaggtccagaaccgtgggctgagatttcacaaaggagaagtgagggaagccctgctggtttctcattaagccccttggcctttgctcattcttcgtgggctccaatggagggtggaccctgtggcttcttcactttgctctctgacctcttcagccccttctctgctctcttctctgcttgtcctaggactgctgtctgcaggcacagatgccccccgttgagccacgcaggtttctgtgaatctgaggttctaactccctgctgccactctctggctcccacgtcttccctgcctgacactcccctcccttccatccatcaccctcctctctcctaagagtgctctctgaatcttattgcctttttatgtctctcttgggttcttcctcctgccctctccctgagcatggttttccttttttggagcatcccacagctcatgccattaatggagtcataatagccacggttggcttttcccgagcaaacagacttctgtgggctgcagaggacacagacccccactggtggctcgaaacacccctcctgcaggcagttcacaggctggacctttaaggttcccaccagccaggccacacattggttcctccatatttgtacaaaaagatgtgagccaggagcagtaggcaaagccctctaccttggggggaaaaaaaaaagttggtctggaggataatggaaattcgcatggggcgagggctctgagagcagcatccatgccccatggggtagagggcaagacagtgactgtccgggggccttttcagggtcgcttggtgaaacacaccctatatgaatgtgttgggagaacctaaagcagaagggagagacatagagcaaaatcagagcgagggtccccccacctcttcactctggctctgggaagagactgctggaggattctccacagcacagctcactcacccatccatttgctcaccaagtacttactaagcttctctccaggtagctaaagacacagaacatgggccaggtgcagtggctcacgcctgtaagcccagcactttgggaagccgaggtaggtggtgaagtcaggagttcgagaccagcctggccaacatggtgaaacctgtctctactaaaaatacaaaaattatccgggtgtggtggtggtcatctgtaatcccagctgctcgggaggctgaggcaggagaatcacttgaaccctggaggcggaggttgcagtgagctgagatcccaccactgcactctagcctgggccacagagcaagactccgtctcaaaaaaaaaaaaaaaaaaaggacagaacacatggaatgcctgatccttgattgggccgtaggtctagattttttaaaagcttgtatataggatatttgaggggacagctggggaaatttgaatgtgaaccgtctattaaataatgcctcaattgaaatttctgggtgtggtaatgttcttactctaggaaataatacactttcctaaattttaagatggtttaggaaaaagaaatacacaaagaaacacacattcacagataaatgtggagaaatgttcatcattgtcggatgctggtgaagggtgatggctgtgtcaggattattctaggtactagatccatatcatcagcattgattctgggtactagatgtatatcatcagtgctgattctaggtactagatccatatcatcagtgctgattctaggtactagatccatatcatcagtgctgattctaggtacgagaaacatcagtgaacaaaaccagcaaaaggtccctgcccttgtggtgctcaccttctagtggtgagaagagacaaggagaattaatgagtaaaatgggatctgttggaagggggttgggagtgctggagtgggaaggcgccatttgaaataggaggacaggaggcatctccctgtgaaaggggcgtgtgagccaagacttaaagggaacaggaggctgtgcgctgcagagcactccaggcagagggagaagccagcacaaagaacctgggtatagtgtgcctggggcttttatccagaatgtcgagtgtcctgtgaattccactttccagcgatccacctttcatcccccatttgctgttcggcgggcctagccttggaaatgaccttgcatgcttgaggacaccctttggatttaagctgcacgggctggacctgtggcagccctctagagtgcatgcattcagagctgttggcctggctccgtcacctttgtgattcggtacatcattctctccacacacaagatctttcctgccccagtgtcaagggcgataaccacgatgaggagaaagcacgaggctaggaataagaccatgtgcatatggacccacatcctccatcccatctgattcagcggggtgacctcagccaaccacttggcttttcttagcctcagcgttcctcctctgtaaaatgggagtaggtgcaacttcctcccagaaaggttaagaagatgagatgaaagtgagcaaaggcagattgtgagctgcacattgcggaaactgttagctctctagacattcttggtctctgagcagcttagtgttgggggctggggttagcagacatggtccttggttgctggtctcctgctgagtaaccggagccttgaagtgagtcacagagccttataccccttcaccatctgtaaagagggagtcaccacttagtgacgtctgctgtgtcatccacctctgagagtgggattccaagaaccagagtaccgagtgccttatgaattccactctgcgaaaaaattaatagtaccttggggtctttcatgccacgttagaggttggcttctgctgcaggctagccaggcattgctcgacagggcatcttgtttgagctcctcttcatgtctgaaccacaaaggcacaagccctttcaaggacatgacattcagatgtgcctctcctgtgtgtcctctcaactttgtgacttacccccttggctgccagtgaggccttctgaacattgtgaaggcagagagggctttatagcaatcaggctactctttggaaattgtgctgccttttagtggagataggttagctcctgcaaatcctcgaggccatggtgagcagccagcccctccccacagcccgtcccaggccttgaagggcttcatctgaggacccgaaggcctgggttcctaagctctccctgagcaccatttgggcaagtcatacacagagagggagaggaaacgagttttaggagttcttagctgggttgttcccatctctaggtggcctggcagtgggaaggagagaggtgagaagagcattgtttatcaggtactgtcagaggactattcctggaaaacactgctgaatcttctagaaggggtgatttgtgttctttccatattggcaggttttcatttccctgcttaacatgactaaggactgcaggacctgtgcatgctgttaggtaactctggccccaagatggaccctaggagagactttgacacacaattgatgatgtgccaggtggatagaagtggaagtgcagagcacccaggcactttcagccaattagtctggaaatgacatccaagaggcagagaggtactggctgtgctgcctccattcgtgtgtttgcctctggagcaaaatcaggctgggctgctctctgtagggatcatgccaaggatttggcagctctctggaagaaggagtgatttggccaagtagatgtgggcctcttatgtctccggcaggtcttcagactcaaattcttaagagaccaaatgacatcttgcctaggctatcaggcagcaccattgcagagaggcatggatgaagctgtgtcacgaggagtggcccgggcaaggtgtgagatggtggcttcacttcctttcacaaactctaaggcagcatgttctccaggtgtggtccctcaccagcagcatcgccacctgggaactaaatcagaaactctgggagtggggcccagagagctgtgttgcagccagtcctctaggtgatgttggtgtgctttcagaaccactactctaagcaataccttcatattgaccactattaagacagatcacttccactgacagagtagttgcttatggcagccatggcaaggtggaaaccgtaggtatcaggagacctgcgttcaagtccccctcttatggatacattttgtgggaccttagaaaaaacacggaacttttttgagccagtttattaatttataaagtgggaataatcatacatcatctccgtggattttgtgaggattaagttaaattgatggcctacaaaaatacatttttttttttttttgagacagagtctcactctgtctcccaggctggagtgcagttgtgtgatcatagcttactgcagcctcaaactcctgggctcaagggatcctcccacctcagcctccccaagatctgagactacaggcatgcactaccatgcccaagtaattttttttttaagagatgggggtcttgctatgttgcccaggctagtcttgaactcgtggcctcaagtgatcctcccaccttagccttccaaagtgctgggattataggcgtgagccaccacacctgtccagaaagtgctttttaacttccagtattttgcatgtaagatggcattgttatgtttatcgaacacctgccagtttccaggcaaacgtgatccttatgtgttatgtcaggtaggttgtctttttatccccaattttacacaagataaaactgaggctcaggctttaaacttggtagagcaggacatttagcctggttcagcctgattccatgttggccttggagtttcactgggagtccatgttcttaaccattatgctttttaaaagttctcatcctggcttaaccatcatctgtgacactttcaaaaatactgagattgaggccactggtttgatgtggggctcggccactgagtttctttaaaaccttcctggatgtttggaatatgtagatagggttgaaaccatagtacgttgcgtatataccaccacccttccatctcagaacagatgctgcaaatccagagttacataaattcaaagtaagggacacagagctttagcaaaccatgggcagtcaataagtgcttattagatttgtgaattaagaagttttaaaatagcattcactgcaattttaataaatcagataacaggtgttcattttgggcaagtcgaagagtccaggaaactggaggaatataatgttacccacaatttgagaacccctttttgtgaggcctcaggaggtaggaagaggtaggcgttgttcttcccacattagagcaagaaaagcagccccaggaaggctcagcgatttccctaagtaggggtattttgggggttggtttttatagatggtgggcaaggggataatagtgtaaattttgtactttgagcttttgggtaaataggcagattctgaaaccattgtgttgtatctactgattactataaaggcacagatccaggctctttgttaactccctggcagactgagtgcttccaagtgcaatttccctcccctcctttctttagaaattacctcgagctgcaaagtgagttgggctcaggttggcatgcaggcattttccattccaagggacaggaagtggctgtgaatcttgtaacctgtattccttctttgagagtctatagagttggaaataaagacacagaagtctcctgagtgccctggcagtgcttccctggatgaagggtttggggagaacttctagagagccagactttcattaccgaaactccccatctttctccccaaacccaaagtagcagtgagacctgctgatcaccttcatgtaaaagaatagtaataatccccccgaatcctgtccaaaccacagaaccctgcaggttttggacgagtcccgccataaaaccactttcccatgacttcccgaacagtaaaccccagcttgggtaccagggaatggcgctttcagtttttaatggactgcagctgaagcaagttcaaaagtgcgaggattgtaaacttgagagcaactctgcagatgccgcacaccgtggcagaatgattcagggggccaaactttgcctcatcaagtcagagaattttctgcaaatgaacttttcaagaattatgccgtcgttggcattacagtattacacacatgcctgttcccgatcactcactggaacttattttgtagttaacctccataaaggactgtgcgagcgagcacaggcctgtcacacacacattatttagaagcccttattattattttattgccagtccttgacagctgaggaaaagccaagcgctttaatctttttttccctttagtttacagtgtaagagctgcatgtaagatggatttgattaatatgtaacagagatgcaattctctgtaaaatgtgctgtactttagcaccctggaaaacaaactgcatcacaatggcttaaatctcggtccattgtattatatagacatcataaataatagagagcaggcagatattgctgcaggcttcatctgcataacacatctgagctctctataatgtgttcaacttgtcacttttagtacagaagagaggtaataaagctaacagctgactaacacacatcagccctacttctacttccaggggggtgaatgctcattaagccatcttagccctgacttttaaaatccataactcttacaaatgtaaaaaagttgccgcaaaagattaagcgcataatatatgtcaaagtataatgttttatgcatctcccccaactaccactccccgctgccgccgccaccaccacaccaaaagtctggtttcttttatagccttctcactagacgaaagaaaataaaaaatctggttctcagataaaaccaaatgaaatattattttcccagcatcactaagggactaggtaattgcttttgagtttgaagcacatgagctgaccccaagaaggttgaagattgaaacctttccccctctcctctaagaccagctcaaaggaaacagggagcttgggcccaggagtttgagaccagcctgggcaacataggaacaccctatctttacccaccaataaataagccaggcaggtgtgtggtgcgtgcctgtggtctcagctactgggggggtggtgaggcaggaggattgcttaacctgggaggttgaggctgcagtgagctatgattacaccaccgcactccagcctgggtgatagagcgagaccctgtctcaaaaaaaaaaaaaaaaaaaatagggaatcagtcatccccactgggaccttgcagacaggccactagatcagtcttagctgccttaagcacgcccttacatttacttgcctcagtttccctattggaaaccagaagggagtaaacccctccattttctttctgaggggactataaggccgagttcagcactgcttgtcatttacttgcctcagtttccctatcagaagtcagaagagaggaaacccctccattccctctctgagaggactacaaggctgagttcagcactgcttgtgcaatcacagttgacagaggtttcagagtctctgttgtgctcttctgattagcagtcttgtgttttagaggaaaatttgaaaacattacggtatgtcattttctgtaatgatggctgagcctttttagggattaaggctgtcaggcagaaaagagaaaaggatgtttatactcttaactcagagcagatttaatcctatgggatgcattttggtgggctaggggagcattgtggtctctttctcggggaggctgtgatgtatacagtacacggatgtgcatgtctcatgacattcatctctttcgaaaatatactttagaacatttctcttggagctcctaagaaaaataaatggttggtggtggcccggatggtaggaagacaggttaggatgaaacaggaaatttttcttagtagttataaatctctcaaggggaaaagttagagccccaacacttgactcatttagaacaagttgaaccaacctctgaaaaataaactcacagggggaaaaaaaaaaaaaaaaaaaaaccataaaaaatcctgcatgaggtcaggggactggcatgctaggctaatagaaactggaagtcagcgcagacatcccaggatgcactagaataacatactgtttacttctgtgattagctcagaactaatggtgtgtgtgtgtgtgtgtgtgtaagtgtgtaagagaccaactgagacacaggggctttcattgataccagtggtgcttgtgggcggggattgaaagacggcttggttcccttggctaggagtgtgggcctagaacagtaacacacttttccactggtcacaatgacagtttgtttttggagaaagccatcattaaactgtgatgtgggccgtagcactgctacctcagaattctgttgctgtccaccaggcaggccctgaaagctcagctttccgttgctagagcccacgccgtcatcccttcttgcccatattcctgcagcagcttccagtctcatctcccagcctcccgggcttctgatctcccccgttccacatggcagccagtgtggccacatcatttctcacctcccaggcctgccattcaaagtcatccacagttgcttctttttctctctcattggtctaatccctcacccagcttccagccacactagtccacccggctccagccatgctggtccattagatgtttctagttatgctcagtactttcccatctgcattcaagctgttcctctggctcagaacactctttatctttgtaaattgaagtcctattcccatctttgaagagtcaccatgaaccctacccttcaggaagactcactagacccctacttgaaataggtctttcgccaggcgcggtggctcatgcctgtaatcccagcactttgggaggccaaggcaggcggatcacaaggtcaggagatcaagaccatcctggctaacacggtgaaaccccatctctactaaaaatacaaaaaaaaaatagccgggcatggcggtcagcacctgtagtcccagctactcgggagactgaggcaggagaatggcgtgaacccgggaggcagagcttgcagtgagcggagatcgcaccactgcactccagcctgggcaacagagcgagactccatctcaaaaaaaagaaaaaagaaataggtctttcataaatctgtgagctcaccagttaactaagttaactaaggtaatcaggttccttagttcagaacacactgtcatcctggatccatgggaggccgcccttagttttccccactatcctggcctgctccccaattctcagacacccagcctcatgtgcctgatatgtaaccttgtcaagtagatagtgttcttctgtgtgggtgttttgtttacataagtgatgatatgctataaatcttagttctgtttcttgtcactccacataacatttttagaatctggccttgctggtggttgcacatgtgtttgttgcttctcaataataccgaatattctatagtgcacattcccctagtatcagatagctaaggttgccctcaacttctcccatgaaattagcaccacaatcaagcacacactgtcaccataaccatccttgtaatgtgtctatttatggaattctgcaatctacctgcggtgcatgtaagttctaatttccagatgtccttgcccacacttgctgttattcacctttctagcttttgccatcttgatagtataaagtattataaggagttgaccatttttctgagtttctgatttcttgttgatttgcatttttggtataatttaactatgggtcattggctattattttggacactcaagtatcttcttcaaatctgttgcccattagctaactgtagtgaccttgatgttaagagatctttacttttgctatagtgaaacaaatacatattttggcctcacttaatgttctgggagtatctggtttaataagtctttttctatccttcgtgcacagatatcatttcacgtgttcttttattagcttcatagttttatttttcacttttaggtctttgtttcaccccataatactttgtaccatttcctagagtttgccttgaatttatttccaattgtgtcctcaaccaggtgtaaagtcttagaagaactatgttgcattctccatccaagcctcagctttgccgagccttaacctgactgacctacttccctgtgtccatactgatgacattccttccctacattctcagtggaagacatatcactcctcttgtctcaggtcaactttttgtgcatctgagtatctccttccattccatcctcctcagtgacttctcttctgtcttctaagctctctcgctgtcagcacataaacatgcgtgtcaactccccttctcgtgcatcttcctctggctccttgtctcttgaccccattcacttgtcattccttcacagcaactggctttgcctctgcccgttgatggcactgacccatcctcatagaagcttcagtcatttccacttgccaggtgaaggagtccctgcattcatcaggcccaccctgaagggcatgtgaaatgttacgaccacccttcttgatttttgattttttaaatgtttttggttttgtgatattcccgtctcctcatcttcattttgtctctctaacaattctcagatcattttcagtgattcctcagcctccacagattccaagattatgtccactctgatggctctcgccacttttgcatgacaatgatactggactatgtctccatcccaggtcttgcccttagcttcggacccatattttccatagccaacaagatggccaggtgtcttgtggacacggaacattaaaaatgtgcctaatctaggccaggcgtggtggctcacgcccgtaatcccagcactctgggaggccgaggtgggcagatcatgaagtcaagagatcgagaccatcctggccaacagggtgaaaccccgtctctactaaaaatacaaaaattagctgggcatggtggtgcgtgcctgtaatcccagctacccaggaggctgcaggaggagaatcgcttgaacctaggaggctgaggttgcagtgagctgggattacgccactgcactccagtctggcaacagagcgagactccgtctaaaaaaaataaaataaagtaaaagtgtgacaaacctaagttatctttcctcaacctctgtgtcctctgctgattttctgatttttaagtggatcctaagacaggtctctgggaatttttctagactgccttttaaatcaaagaaacaaactttattatcatgtactaattgaatgtatcatctctgatctctctctttccccaaccctgtccaaacctgttcctgtattcccatacccacaattcagccagttaccaaagccccacatcagcaagtctccccagactcttcctttgctgagtgctatgtattttacctctcaaaagactggctcagtccatccctccctttccaccaagacagcctctgctatgacgtcctggctcgccccacctaccatatctgtgctgcagtagacctggggtacggcctgagaatttgctttcctgaccagttccttggtgatgctgaggctgctggtctagacgacactttgggaactactgcttccgttgatttttcccatccatcaattggctcattcaacaagtagttattgagtaccagtgtcaagttctggaattcaacaatgaagaaaacaaggtcatctattgaaaaggttgtggagggaacaaacaaagaataaattcatctataatgtgatgtgtaagtgatacatgctaacaatggttagcatttataaatggttgaagggacggaggagtggtgatggagagggagtcgtcagggaagacttgctatttaggaaaattttgagcagatacctagagggaagagcattccaaacagagggaactgcacgttcttgtgctttaaccatcctaaaacacagtcccgactctatcacttccctcgcggggtcaacagcagccacgtttgactgccattctgcgctctccacgaactgtctcccacacccttttccacacatcgtctcgcacccagactgacctgacttctcccaggtctctctgctgacatttcacttgcctcccctggggcacttatttgtgctattcacccccacccctcctaccttccagcaaatgcccttcttgtgtgtttgcctcatgccagatcctgtaattcattcaacgtttgcttccatttccacctcctccatgaagccttccagaatcatcccctttgaaagtgccctcttcctcctcattccagaaacatttatccccagaagtgctgcataacccttgtggcatctcacccttgtatattcctcacctggcccaactctgtagtccagcaaatgcgtagtagaccttgggtgaaggatggcccagaagtgtttctcctgctccttgacctctccaagaggcgggcctctggtatttcctaaacgctggtggctttactgttgaatcagagcaaaaggagaaaggaaaggccatggcctaaaatggagtattggaatgatctctgggtttctctgtttatcccagctttctttctgtgctattaccaagataattgagttggaaatactagtagcatttccttcatcttccttcaggctcacaagcgttcttcacccaaagggagggagattaattgacttcttttatcttccattcaaatgaggctttcatgtgaatcgctcccaccctcccgccccctcagccctcccaacctcccctcattcattaggagctggacatgaaaaggagagcatctaaaactctgcagagtccctggatctccccagacccctctcttccctcattccccgccaaacatttctgacctggcatcacaacagttcacgtgagaagtgtcacggtggggcagagcagatccaaccggaagctgcaccagccactgaactctctccacaccaccagatggtctggtgctgcagcagcctttcagaattaataactctccctccagaggggcagcttcattcaggaaccgtttcacattttccagctaagtgtggttttttcccatagagttttctggccgctctgttctgggcagaccatggggcctgctcacgaaggcaagagatgtatcttgccttccctccacctttctttgcctttggcttctgacagcgcagcttttaatctggaaattatggtaacttgtatgtgcattttgagagtatatcattgctgcatttaattaacggttattagtgttagcgtactgtgctgtattctatgtcacaaatcatcaagtctcccagagcagttacagcaattaagaactccatcacaccttctgtatagtcatttggtacttttccaggtcttttcaaaactggaaattactaatcaaatcatttctgctgtgtgcctcagtatcgtttattccattcctaatgatgtgcgacttttttttctttggccgttaacagaggcatccgtgcgtctaacccatttcacaccaccgtcatgctttagcgaggcgataatgaacttgcagaaggaaatgcaggctttggttctcttttcagagcagtgtctttcctctcctgctgttgggtgattgaattttgaaactgtaaaatgcatcgacagacctacaaacctgacttgccagagccacagccatcacagttgagcttcaattcagagctcagtgcgactcctgcctgatcaatttgtcatccctctaaatggaaactaattacttcccagggaaagattgcaggcaaatatcagcctttgcatcagcagccctctgcagtgaggttaaggcagagtccatggggtttcaccagaggggccatttccctctctgcctccgtcatgtcaggaagaatttttattatttagagcagcagtgagcttgccgtcacatccactaaggtcagccgtcaagcgtgcatctcacttaataggtcacctggacggtcccaagtcaaatgtcagaggccattcaactgccaggttgcaacaaaaacaccctggcaggcttttgatggtgtttagatggggatgagccagcccgctggaggggagcccaccgcctctggccccccaaggggattctctttttctttatgcccaagaacactgccctggaagcatccccggaatgactgaatcattgccatttgtgcggcatcgaacagactgtgccgctgacagctgtaggcaagattgactccgatgcagtgccaggagatctaggccatgcaaggcggctgctcaaggcccgctctagtgcgagggccctggctcagggcagcagggctggcccagaagctggggccaggaccgggccagccagctcagaggctgttgaacaatctgatcagaggagggccttgccagttccctacctttgcccattttggatgctgttctgctctggccttgctgctcatcattccaggctggctgagcagtttcaaactcagggctgatcctgccacctctgtgtctgggctgagctgcaaggtctttagcccagcattgctcagtcttggacattctcccagcagaagtcagacaagacccaggagagaagtttgttttgttcagcagctgattggatccgctcactgttgacttgtgttccatgttggagaatgcgttctggtccccctgagctgatataaaggagcccaaactcaaatctgtgcccattccacgtttcccctctactccaggatggagagtttttcctctcattcttatccacacagcgaaaaacactagacacagtgagaaacgctggacggctctgggggccgtgggagctgggatgagcactgaacttctctaggcctcagcccacttcgctctgcaagccctgaatgtgcctggacaagatgaccggtaaaggccattccagctctctgtgctttgtagcctgagtccctgtgaggagtggtttgctttgaaacacaatataatccagaaaaaacagctatcttaacttggccagctctgcttttaagcaagaaataaagtgatggtttcttgaaaatgatgctggcctttataatgccttctcccttaatctccccacaaactgagacaaggcatcctgggtcacaccctggctcgtctcctgtgtgatgtgttttctgggacttgcactttggtaaccagaggagactgccaactgggtatcatacctgtctctcaacccctcttctgcccaccaccctctctcagcctccctattccctgaagctagcatgccagggaggcaggtggcatacgtggtacaaggactgcatgcgcacattttggaatgaaacagtggcctttctttggaactcagaccatccagtgtgctctggctaaagacaggattgtagatctaagaagtccattgtactgattagtttcatctcagtttaagccactgacctaccaagagtatccattcaggaaatgtcaccccatggcctgatgtagtggtaggagactggaaatagctgagtgatgacggcatgtacactcagcattgcttagccttgggcaggtaccgaacctttctttgcctcggtttctcatttataacatgggaataatgatagtacttacctcttcagggttctggtgagggttccatgaactaaaacacatgaagagtctagaattgttcctgtgctgtcctaggcccaggatgaatgtgagctgctgtggttacagctagtgtcatagtactccgcccccctccaccaccagactaccacagtttcctgcattctgtgatgccgtcagctcactgagtcaccttcaccaacacctttcacgcctctggacttcagctttctcatctgcagcacgagggagaggaatgggctgaggcttgccatggtgctttcagggacaggcgtgggagcatctgtggtgagtttgcagttctgtgttgtatatgtctgcaccaatgagagtttcatgatcttgaatttatacattcatatcatgaagcacaacctagtagcatgtttagatgtagaaacacgatataaaaacaaaacagaatttgttttggtttttggttttttgttttgtttcgttttgttttttgagacagtctcactttgtcacccaggctggagtgcagtggcgtaatcttggctcactgcgacctccgcctccccctttcaagcaattctcctgtctcagcctcccaagtagctgggattgcaggcatgcactaccacgctcagctaatttttttttaaatttttggtagagacagggcttcaccatgttggccaagctggtctcgaactccttacctcaaatgatctgcctgccttggcctcctaaaatgctgagattacagatatgagccaccgcgcccagccctggaaggaacctttgttaagagttcatagtaacagggtgctaaaatgagtttattaaaataatcccagtagatgaaagattaggagatctcttttgaggaaattagagagtttagatctgttttgaaattagggaatgccttttcctattgacctaagtctctgattatatatgtcaacctcagcttacggaaagaagctgacatgtcaaaataagaagaataggctggatatggtggctcatgcctgtaatcccagcactttggaggctgaggcaggtggattgctttagctcagaagtttgagacctttagattagaagtttgagacctttagattagaagtttgagaccagcctgggcaacatcacgaaaccccatggagcatgtctgtggtctcagctacttgggtgtttgaggtggaaggattactggaccgcaggaggtggaggtggcaatgagccaagatcatgcccctgcactctggcctggcagagtgagaccctgtctcaaaaaaaataaaaaagtaagatgaataaacaatggttaatagaaacataagtggtgggacatgggggtcaggatttaatctcagagtgtcccagtggtgatttattttatttatttatttatttatttatttatttatttatttattttttgagacggagtctcgcactgtcacccgggctggagtgcagtagtgcgatcttggcttgctgcagcctctgcctcctgggttcaaacgattttcttgcctcagcctcccaagcagccaggattacaggtgcccaccaccatgcccagctaattttttgtatttttagtagagatgggccttcaccatgttggccaggctggtcttgaattctggacctcgtgattcacccgcctcggtgtccaaagtgctgggattataggcgtgagccaccgcacccggccccagtggtgattttgtaggtcagcagagatgatctgtgtgccacatttccttgtagcttaacaatgggcctcaatcatgtggtgcttgggttcttagaatgtggacagccaagacattccagccacaagtaacagaacaaaatggcttcaaccatggcaggggggcgggtgtgagtagtgtttctaaatgggactggttaagtattttggggcacggattggcttctctgccattctcttagctttctcctcatgatttcaagatggccgccatagttatcagacactatttcctcaggaagccacactcacagacaggaaggaaaggtgttcttcctcacgtacctctttttatcaggaggaaattcttttctagagaccccatagcaaacttcccctcaggtttcactggccagaactgggttacataccgtctcctaaaacagtcaccgtccaagaataatgggattgccaagggtggcctgagcctcctgtaacaggggaagaccacctgcccacagcatggcgccatgcagtacctgaacaaaacctgggttcagtgaacttgagggctcttgcctgggcaaccaacagggtctgtctgggaccttaaagtcactgattctgacttagcacttaggaatcaggcatgtggtttaatctctctgaatgtcaaagaatgtgagctggtcaagagcagatctagaactagaatctcttttctcttactgtgactctcatccccactcagctttcttcctggaattatttttactttcaaatgtgtgaagtcagacatacaacaattgtgcatttcacttgaaactagtatctcgttgattgctaccaagaatgttgtttaaaattgagaagtacatacatttacctctacatatctccagtgaacttctgtgaccattaactgtcaattttatcagattcattttacacgcaaagcaaacacatctacacccttgtctcaagaagtttccaggctagatgaaaaaactgttcctgtacccatgacagttagacataaattaatagtgccaactaattgattgatgaccagagttcaaatcaggggaagaaaggatcacgttgagggcatggctgaggcccaagagaatgatttcaatggacagagaggaaggaggaggaagtccgaatgggatgaagataatgttgatagtaatgatcaacattacagttatgagcacttgctgatatgagtaatgatcaactacagttattgagcacttgctgtttgagataaagttctaagcactttacatgtcttaacttatttcatcctcacaaaagctattatgagatgggattattgtcttctcattatttccgctatatagataaggatcatgacatacaaagaagttaaataaggtacccagtgccctagagttagtaaatggtaaagctggacccaggtaatgtggcttcatagcctgccccctctctggtgctcagcctcatttactgtagcaaactcacgaaactgggaaacccagggttttgtgaggcgacttctgtacaggtgttccttaacttacattggggttacatcccgataaacccttcatacgtggaaaatattttaagtcaaaaatgcatttaatacacttaacctactgagcattgtagcttagcccagccccccttaaacacgctcaaaacacttacattagcctaccatcgggcagaatcaactaacataagcctgtttcataataaagtgttgaggatctcatgtaatttattgaatactgtactgaaagtgaaaaacaagatggttgtatgggtacctgaagtgcagtttctactgagtgcatattgctttcataccagcataaagtcgaaaaatcgtaagctgagccatcggaagttagggaccatctgtatgttgatttagctgaagggaggatttataggcaaaatagtgagataaaaggtagggaaagttttcactgaattcagaagtatttggaactggggctggtcatctggatcccagaaaacactggcaaacacacgcacagaaatgcacagaaaaagaataccccaacattgaacaccaaaggccctcagactttggcgcctccattttgaaggtgagggatgtttctatgtgtctgtaagcagtgaagacatcaccggattatgatcacatcatacattgcacacgccgtcacggttgcacgttgctctaatcccatgtatattactgtgtctatttggaaagctgcaagagccatttatttatgagtgactaagtggtagttgactgccttcaactcctcatgttttacaaagtaggaatccacagagaatagcagtaaccaatacaccaaaccaccttcattttgagatgaatactgagaagtctttcattactctgcagtataaagtgtttactaaacagaattaagccacagcataataccctgccttccttcttctctatttgattcgtcctacttaacaccagcaaaagtacttctgccattttttttttagggttagacaatttatgccatttaaagtgtaaaaatggaatttacttggcagttagagggaaaagaattgacattatctagacacaaggagttcatgggtataaagtctcagatcatcatttctgctaaagatcaagtacctaagtaaatgtaaaagactacactgagagagacatccccagttggaaaatgtgccaagtcatagaaaattgtggtagccctgaattttcaagaatggttttggccagatgtggtggcgtgcgcctgtagtctcagctactcgagaggctgaggcaggaggatcatttgaacccaggagtttgagttcagcctgggcaacatagcaagaccctgtgtcttacttttttaaaaaaagaatggttttattggtgtattttgattattgtaaactaattgtagactctaatttactcttggatattgagatctgttttgactcttggcaatggtggtgttttttggtgattggttgatgttttatctggcctgatatccagattcttttttgtaatgtacatactctttcctgatatcgtttatatgacaatcctcccctccccttatttaaatagaggtttaaaagtttaacaagcccaggtgtggtggctcatgcctataatcccagcactttgggaggtcaagagaggaggatcacttgagcccaggaattcaagaccagcctgggcaacataggaagactctatctctacaaaaaaataaaaaatcaaccaggcatggtggtacacacctgcagtcctacctactcaggaggctgagacaggaggattgctttcgaggctgcatgagctatgatcatgccactgcactccagcttgggcaatagagtgagaccttgtctcaaaaaaaaattaataaccctatctctcatacttttatattttctctttggaaacctaaccctcaatatatttcaaatgccttgtaaatggcttttgaagaatgcttcacactggatacctgggttctaatcctaattctaatacttaactgtgaacacggatgaagtatgtcagtctctgtgatccttacgccctagacttcccttccccaagtggtttgccaccattaccaattaaaatcctatacctctctgagatccagttcaaatgctacttcttgaagctctttttgatactgctttctcactttcctcaagaggccattatgtcctgtccttttgaagggcatgtttctcaaaagccaaggttgtacctttagtttcttgagagccaaggttgcatctttagtatcttcagtcatctttgcaccccagaatgtttagcacagagcttgcccatgatggctactcaaatgctgaaaggatgaatgactaaataaatcttgagatcagttgtatttttttctttaaaataactggctacagtcactggctctcaaccctggtgttgggctcatggggacattgtaatcagttgtaagcgggttgaagtgatttgttatgaatgattgttaggttttggaagtttgcaaactatgtactgtttgtataaattagaatgtttcccttcagtaatattctttaatgataatatcatcatcctgcagtgttaatacttcagtgtgacactctcccttgcattgtgatttgtcttaaatggaagaaaaaaggatggacttagagtcaggacccaggaaattgtatgttaatccacagcctatcttttctgtgccaaagcccataataagccagaaatcactgctaatggttatggaactatggaaatatgatagtcctctactactgtacgagatgtgggggccttgtcaaaatgaacattatctgtcaatttagagaaaagaataaccattactctaaaccaggggtcagcaaacttttacagtaaaggtctagatagtaaatatttgagggcttttgagggccatacagtctctgtagcaactacccaacttcgctattgtaatgcaaaaaagctattgtaatacataaatggatggacatcactatgttccaataaaactttatttacaaaaataagacggaggtcacattgggcttaatgagctgctctaagccatagagtacatgggaatgtaaaccatactgcttattttttttaattgtattaatggcatttattctacttcctttgtaatagctaaggagttcctgcaaagaaagaaaaattaggggttagtaaatttgttacttatttgcaagaatattcagtatatatttcagggttaatattctctagactttctcagcataagaaatgagatgaaattctgttgatgttgtaaataccactattgaggctaattcgtgaaagaaaggtgactacggtatttgatgaagtaccttgtcttccaagaagtttgcttttgtggtattatctgtggcacgttattttctgtcttggtactttctctcagtgggatatttaggctctactttcctgcttggcacttttgttaataatgactttaaaaatcctcacttctctttttaaattgctgcatggagtaatagcctctctccttgacagtcaaaaggccaagaagtgcaactatgtgaaataaacttttaaaacaaggccccaagtgcactgcaagttgacttgaaataattagtccctggagtttggacacccacaaagtatctttcggaactcggattcagaaatgtctcagtgacagcctgtggcgggaagccatcacagcagcagggcccattgctcttgggacatcccacactgtagagttactttggcagtgcctggaagcagcggcccctgcccacatggcttttccactgtctcacagccaagaaccatgacaggcccctcagaacttgggccctctccagtccttgagccagtgttcaccctcacaggaagagtgtttccctgttttatcagcaagtaacagaaaacccagatgactgcagcttacaaagtaaagacatttctctcccattacaagaagcgtggagaaagcatgttgtagaggctcagtgttgtcacagaggacctaggacccttccaccttcctatgctgccatctcagtgttgggggatgacttccctcatggatgcaagaaggttactgaaacgccaagtataatgtcactacctcatgtggcaccgtgctttacggtaagggggtgagcataaacagaggggattccaagtgctgttctgtttgagcaggggacatttttcccagaagcccctggtggttttcttcttgggacctgcttgcttgaacagcatcacctgcctctggcataggggaaagagattgccgttattggcttagaccaatcactaccttccctggcactggacacatgccacatcagggttctactggaagacaagagaaagggatggctactgggggagcagccaacccaggtctgccacacccagctgaaccccctagacagtggtcagagcaccttttgctttgaccgaggaatcccaagccttgccaagaatctatggccagtcctctgggattattgccagcagttttttctgtttgttgatcatctgcagacacctgattccctgtcagtgctttttctgtttgacaggacttcttgatgcccaccaggatcgagcttgccgagtcttttggatgttgtgtgttatccacccagccaagtctttttggggaatatttatggaaatatttatatataaataaataatatttatatttccagaggtgctctgtacctctgtctatcccttttgggggataggtaagccactttggggccctcaatcccttaacaaaaataatttcatttttcttagtaaaatcatataatgtctgcatttttcctttgcagtacagaaatacatgattggtattttttaatagattacttttctggaacagatattattttgaaaatttaaaataaatttgaagagttctcttctaccagtcttaatttcatggaatagtttaaatattatttaattccatggtctaaactattggctcttattgtctttttttttaatattatgtatataaaattaggaactcatttaagaacagcaagaattgatttaatctgtgagatgccaaatggagctaatcctgaaatactttctatctgtagagattgatagtttacaaagcactttcatacatattatttcagtactttccataactattatctgcatttgacggatgaagaaataagggtataagagctgaggtgacttggccaggatcctaccagccttcacagagttggcactggagcctgggccttcacagcctgcctctgagacactgtcctgtttctagcacttaagttccagtgtctatggcagcatgcaataggattacaggaggacatcgtagccacagataacccggccatgttacctgttcatttcaacctctgcgactaggcccagatttctcaggacatttccttccccatgagctgaattttaacatgcaaatgtcactcacatcctacaagctaaggtgtatgggtttatgctgggactaggtcatatctgtattttaaaaatcccagaacaaccccagcagtggttttagagatgaggaagagaggagacagaacaagttctgctggttaccctgctcttggacttctcaggtgcttcattaatatcatctctgatggcattttgatgccatttttctgatggcattttgcagcttgcctcaagtgtcccttctggttttctaatgtaggacaaagcccaaggatgagtggctgcggttgccagtcagcattctctgcagatgtctttggtgtgtgtagctggggttaacccgccgtcttaatgtctgcctactcggttttgcatgcaaggatacattatacaagaaaattccatcgagatcatgtacaagtaaaatcagcttattttttccgaagaggcaggggagctacttcttagcagagtgagctgtagagtctctctggaatgcaaaacacagacctttgtattagaagtgaaatatttagatagggatcattatggagctctttttatagcaaggcaggcctgaaaaacagagagagagctgggaaaggaagcacaaaggaggtaataatatctgattagctaagcagctggataactgaaggagaatttgttaaaaacctatcaagacatcaaagctagatgtgagttgctctgttagcccaggccacttgtggagccatctctggaatattactgagcatctaatttgctgctattttttcccctagcgtcactccttcactaagggatctgagctgtaacctgacctgtagctgtcatcagggctttttttccatccctgtcatggcatgggatcccagtatggagaagcttagttggtattcaagtcatccgcatcgtacttgaccacgtgtgaacaagtaacctcatgtttctggggacaggcagggagaaacttgagaacttgatccccttgggggcccttggaggattgcttccaccaagccctgggttttgcaagtgactcgtttcccaatctatggcacatccaagcctctttggttttctttttccctgttcacacggatatatttgaggcaccatactctatctgcccaagaaaggaagaggggcaaggaaaaccgtgtaagtcatgcttgtttaaatattttggcttctgccaaagcagatatgagaacaattggactataatgagagttttccattggcctcaactatcctggacagttgaacgccaagcctagtttgataggtacctactatggacctggtggagctccttcttaaaattagacagtgtgtactggccagaatgtctcagcttgcagcctgaggatgattatgctgatcctggaggccctggggaactgtctagggcactaggggtgcctgtgctaacagcaaaagaccactcccccccaacaccacacttgcacatgcctcatgcacagaggaagtaggtgccaggtcttttcagagaagagcttcaaagccctgctgccacctacgagagcctttgatccatctctcggctgaatccagcccctcacggggctgatccgctttgaaaccagagccagcagcccctctacaactccctctgagttacctcacacagacaagagcacaggcttctggggggcttctttttatcttccctaaattgcgagaggtacttctttcagcgttgtcctataggattcttaagaactgccggggagatgtcttagggccaacacaaagaattgcaaacaacagcccagtgtcttggaaactttctctacagtttagtacggataaaccacatgcagatagaaaataggaagaaaaggaaattcatggtaagcctgcgtattttcttatttcgggtgcgaggggagtggagaaatccgtcatggataaaatccaactttaatgacagtctgaagccctgaagcacagacatattgcagagctaatgtattattttgtttttgtttattctgcagaaatggggaaatttcattttttagtagaattacaagctccccttttactattcacaagccctaacatgcatggcatcctgagccagagagccttccgtgattttaataccagcttctttgtgaatctaaactggttttccagtccactccctggcgggccacgggggttgttggagtggtgttacacatacttagctttctttgggtgcttgaccaccgcctgttctcaggggggacaaggagccttgctgtgggcattaccagtgggaggtaggcatggacagtgaggttcggcacctgacctctgaattcccgcggcccttgcaggatatcacgcccacgactggcggtcctcagcctgaactgcgcgttggaatcacctgggaagctttaaacatactaaacctgggccctgctaaatgacacccgtattctgatataatgggtctgggtgtggcctggatattaagatttctgactttcccctcccacctaggtgattccatgtgcggtccgggctgagagccactgtcccgcagcctcatcatacagcttgcctaggttccacggctgtgtcacttcctggccatgtgaccccgggcatgttaactgagctcagcttccttgtttgtaacataggggaatcactgcaagattcattacacctatctcctagagattattgcaggggttcaagttatggacattactgggaggataccatggaccagacactgttgtgggacctggaactgttatggctgggaaaaaaagagatcagagtccctgcctttgtggcgcttctttattttctagtcatggatatggtggataaacaaacaaacttgcatatacatagtgtaatgtcaaatcgtgggcagtactgtgaagggaaaatatggccaaggggaagggtggcaagtggcaggagagagtgcatgcacataaagggcacatgcagtcccgggctgtcagaaatgcaggcaactggctgggcatggtggctcatgcctgtaatctcagcacttttgggaggccaaggcaggtggatcatttgaggtctggagttcaagaccagcctggccaacatggtgaaaccccatctctactaaaaatacaaaaattagccaggcatggtgatgcatgcctgtagtcccagctactctggaggctgaggcaggagaatcacttgaaaccaggaggcagaggttgcagtgagccaagactgcaccactgtactccagcctgagcaagagagtgagactctgtctcaaaaaaaaaaagaaaagaaaaaaaggaaagaaagaaagaaatgcaggcaactgtgcatggcatccttggcagggtctacagtgttgcagttcctaccacttcaccctgggtcaatgagatctcagtgtgatgtctttctctaaacagattatagacactccctcaagacagacctcagactctgtgcaagcccagggcccggtcgccatctgtgtgatgaatccaggcacctagctccgtgcacagcttctcaaagtgagcgtagatttggagagaagaagggataatcagatgtttcatttacccaggtacaacagatacgtattgaaggcctgcagatggcaagacctggttcaagcacaatggggcagaatatgaggaaggcccaccccttcctttgtctcttcccccacagccactacagttccttccaccagtgtcaaccaccaccgtggcagagcatttcccgtgagacaggccgcaggctacatacattatgtgcatcctgtcgtcatgtcctcaccaggggaagtagctgttggtttattcaaccccattttacatgggaaggctctggggctttgtcatgctatcgtttgttcatgtcaccccaggccacacagcagctaagttggaaagtgtttgctgttagcctgcattgttgtccttccatgagggacctaacgtgcatactaaaggcctactatgtgccagagcctggcatttcaccattaagtcactgaatccccataacactgtgcagatggaaccttctcagctttcctgaccatcccttatcttgggctagccctcatgacacatgtcacaccctgcaattaccttctttattcatttgttgacttttatttgtctttctcccctactagaacatcagcacagacagtggactgttatcattcactccagagccggcatttgaatggagattagctggcattctagatgccgcctaattacctgacaggagaaagaagaccaggacagaagcagctgaaattccaggcagaacataggttgtttcagaagaaacacaaactctccctggcggcgtctgaggccatcttcttcaggaaggtgtttcttggatgcacttcaaagcgtagggggcttcacaggtagaattaggttgcaggaatgaggggaaggtagtcccctggaaaatgtgaaaatgagggttgagatgcaggcaggaaaattcaggaggactgttgagtgaatagtcgctccctgtggcaggtgaccagggtgggaggagggtggcagtgtgaggacatcctgaaacacacacgctttggactcagatcttgctgttgtagctccgctacctgatcagtctgtgaccttgggcaacttccttagctttatctgtgaaatgggaataatagtgtcttcccttcagtgagaaccaaatgagacagtactttctgtacatcgaatgctggtgtagagcagttagaacaaatctgtagatctgtagatcgatgctggtgtagagcagttagaacaaatctgtagatctgtagatcgatgctggtgtagagcagttagaacaaatgagtctggggaggtggacccaggctgtgttgcacgagcagggcctctgcacaggcccagcactgacctcaggtttaaccttttacttgaggtacgggaatggctttttggatactgttgtttgaagaaaaaaaaaaggtcatgaataaaacttagaatactaacaaccacccagaaagccagtcccatctctgcccagtaacgccttcctttcctgcaggaaggttggaaccttccacagttccaccaggtattggcctggtggaccagattgaaagggtgagcagacaatgggggggcagacacctgaagccagagatgtgggccaggtgggggctgtcggcccttcccacaggcccaggcagctgcgctgacacagctgtccctttgaaagttggccccgagtgggaagctctgcattattctcccagcccactgcagaatgccttctgcccattgcacagtggcagcgtgctttgggcagcttgatgctggggctgcatggagggcctcagaaaagtaggtagactcgtaagacgggctttatcctggaacaggcaccaccaccctgccctttccagagccaagctatggacatgggtcctggagaggcagaaatgtcttaagggaaggaaagggaaatcctaattactacctgggaaacagtcctcatttccaaacccagcaggtgacctgcaggataatgtgtgggcagtgattcattagaagctgtaatccccagtgttcaagcgagagttgtaactgtatctagggcctgagagagagaaacgggcttcatgaattactcctctggcaccgttgcctacatacctaggcctgtagcaatttatcccaaatgaggaaataataatgtcattttcctccagcctttccctgggaggaagttctctaatagagggtaggcaggtgttaagaagaaatctttctgggccacacctcattacaagattgggataagtgagctctttttcagcttctgcctctcctgtccttgccttgtcagcagcagggttgggagttaggcacagggcatggtgggaaagaagtcttgctgggttctcagtcattgcagttggttgttttaggtaaagtaaattgatgttgtgtttcttttccctaaatattgactgttgaacctagttgtggaagaaaagatacctgtattttgctcttattacttgctattcactgctactcttcatctggaggtcactagcaatttttaaacacttatccccattttacagatagaagatagtaagttctatggaggaatgaaaggcctttttacagagtaactgaggttccatatgttgaactagaataaagtttaagctcctgaccaggtgcgatggctcacgcctgtaatcccagcactttgggaggccgaggcaggcggatcacttgaggccaggagtttgagaccagcctggccaacatgatgaaaccccgtctctactaaaaatacaaaaattagccaggcatggtggtacacacctgtaatcccagctacttggaaggctgaggcaggagaattgcttgaattctgccaggaggcagagattgcagcaagctgagatcatgcaactacactccagcctgggcaacagcgggactctgtcttttaaaaaagaaaagaaaagaataaagtgagctcctatagcaagtggagccccacaggaagaaaggcttcaatggaacggacgttgacttctcgtccatccgacagtcttatggatcttgctggttggccctgactccccttacagtgtcttagggaccccgttcttttcatctcgtggctttgccatctcgtaagcctcttactttctatatccacccaatcatggggaggaagactcagaattgacacttagcacctctgccattgccaagaactagtcatgtgaccttaactactagtgaaaggcaggggtggcccggaaatggagtccttcaccagacagttgcttacctgagacaacatgcatgtacctgtgaaatgcgtatactgtagaaggatcatgagtttggcacataattagtggataataatcactaccacgtctcagaatgagtgtcagataattagtggaccataatcactaccacatctcagaatgagtgtatttgctaatagaaatgtggttttggcttaagtcacattgtcagtggtgaatgcagcctaaaattgaactcaaatacccaggccatagttgttttctgactccaccaaggcagaaatgaaattgttgagtttgagagtaagtagatggggccagccaaagcaagatggacagaatgacattcctttactgtccttattgacaatttatggttcatgcaatagaaaagaatcttaaaagtctctctttaatatacaagaagagaaagacccctggaaacttgtcttttcatcattcgaaacctaccttatcccttcagtcaaatgcagtggtacctgtaaagctcacacacagttttgcatcaaatgattatgtggtcagccatgtaataagtggattcaaagaaacgtatatttaaggtggccacttgcccctggggtaaatggcagctgttggactctgtgggattttgtgttgttgttgaacttgtaaagtgatgaaacctcataatttctctcctcttttagttccctctctgtctgagcagctgtactgaagtttgtcaaacatgcccattagctttcacatgtaaagatggcctttttatattcaaattttagtaatatattatttaatcattaggcagtttactaagggtatatttgtggccattgttctttctgaatgcctaatcactaaaggaaaacattttggaaacaagcactttcttccagaaactgtggtttccaggagagagagtcactgggaagattgggaagccatcagtggcatggcacagagacaccatggatgctgctgctagaccagccctgacccagtagtaaggcctagccaaggacacattgaactccttgaaattgctgatatttggtcaggcacggtgccccgcgcctgtaatcccaacaccttgggaggccgagctgggaggtttgcttgaggacaggaggtcaaggccagcctgggcaacatagcaagatccccgtctctaccaaaaatataaaaaattagccaggcgtagtgatgcacacctgtagtcctagctactcaggaggctgaggcagaaggatcgcttgagcccaagaattgaaggttgtgttgagctctgattgcaccactgcactccagcctgagcgacagagagagaccctgtctcaaaagaaagagaaaaaaaaatgcttatattcaacaatttttgtccttccaaacaacaatttcatcatattcaaactaatacaaaactggcttcccaaggaggtgtttgtttataaggctacagggcaccattttcctaccacttctaacattgtcttataggaggttctctgaaatgagaaatgcagatcttttttttcttcttctcctaagacagggtctcgttctgttgcccaggttggagtgcagtggtgtgatcatggctcactatagcctcaacctcctgggcgtaagtgatcctcccgcctcagtctcctgagtagccgagactacaggcacacatcaccatgaccagctgtttatttatttatctatttatctatttatttatttatttatttatttatttttgtagaggtagaatctcactgtgttgatcagccttgtctgaagtcctgggctcaagtgatcttcccgcctcggcctcccaaagtattgggattacaggcatgagccaccacacccaggcagaaacacaaatctttagtgaggtagcattccatttagctacagaagcactcagcatgcagttgacctttaaacaactcgggtttgaaatgcatggattttagatgtggggctttttaaaccaaacttggatcaaaaatatggtattcacaggatacaaaaaccacatatacagagggctgaatttttgtatgcatgtattctgccgggccaactgtgggacttgagtatgcacagattttactatactcaagtgtcctggaaccaattcttcacatataccaagggacaactgtaatgtgaacacaaacccataaacagtgcaacattaccagctttcccaggatgcatgtggctgacagaggagtcagcatcaagaagggctccactggcggctgggggcctctgagctggagcttactgacaagtggaagatgcccagatgataaggtgccgtgacagattgtggtggtagcattgtgagctggttgacaacacagaactctggaatcagatggcctggattcaaatcctggactcaccccttattggctgtgtgagctaaggcaagttacttgccctctctgtgccccaatttcttcatctgcaaaatgggaataatgataatggcattatggtttactgaaaggattaaaagagttaatatgtttaagtacttggaacagcatccagcacgacactaagtgatatggaggtatttgctatttttatacagagcttagtggcatgaagaagttagacaagcaatgaggaattcaaggtggtgtcctggagtagaagagaaatcggttctggaagggagacttagattacaggacagacagagatttgggtgttgtttccacgactggaagaaggcgacagttggcaaatacccacctatgtagtgatgtccagcagaaactgtcctgagacccatctaactttgtcattccactatctctctgtctctgtgctttctcctgcccttcttcctgtctcaaaacctctagtccttttaattataggaaatgttcacgttttcccaccacatttttttttatatatgtctgggtgtaggaaatttctgtgcacccccaaggacacctgcagctcctctctctttgagtttggtgtatgccgggagggtagtcagaaaacagccatagccccctcctttgcaactgtttctgctatagtctttttgatggtgcaaggtgtaccctagggctgattgtgttcctgggagctggaagctgttactgcagggttaaatcagcaacaggagagcatcactcccagcaacctcagaaagaatagagaatgatgttgttgaagggagcagggagctgtgttcctagtgccgtcttcttaaaaaaaaaaaaaaaaaaagtttccttcccccctcttctctctgcctttccacaacacaccttgtactaaatacatttttcagacctgactttgtgcaaacacagtgttgttcggcaagcattaaaaggcaatttagtactcaaaggattaaaagctcatgttaaattgaagactacacttggcataaacattaaaaattgacagaacaccccgcacattaactgcaccagggcttcgtaattagcatttaaaagtaaaacatcatttccttactgtttcctacttactcatttataatgcatttattataatacagatgtgagcaagaggctttctcccatcatcagcagatgaaaaatatacctgtgctgagaaagaaactgggatttattaatccagcccaaaaagcaaaaccaataaagaaatctctcactgggctgatttgagagattcaaactaccccttggaagattgacacaaggcccccaaagaaatcgccttcacacttcttttccttttcttagcctttcactaacaaatactgggaagaaaatccaagtaagcttcagccaggcacacacttgcgtttaaaactgatcaactggcaggttaccaaaggaatgtggaaaagagcttgttggcccattgctgatgcttcttcaaaactttggtaagactgggatccaattttctaactcagggaaattctgctgacttaacacagatggctgaatttgtaaatgaggacacctgttcatgacacctttgggctcctgcttaaaatcagggtttagtttttagcattaccaaatttgtaaaatctgaatgcagtccaaatctgattttatgttcttcctccagagttaatcctaaatgtgccaccattgcggtctttggacctaattctcggccccttcttagtatggtaggtagtaattcccaaactctagcatgcatcacgatcactgggggtctccctaaaatgcacattctgcctgagcaggtccagggtggagcatgagattctgcatttcttttttcacctaggctggatggagtgcagtggcacaatctcagctcactgcagcctccacctcctgcgtccaagtggttgtcctgcctcagcctcccacgtaggtgggactttaggtgtgtgccaccacgcccaactaatttttgtacttttagtagagatgggtttcaccatgttggctaggctggtcttgaactccggacctcagatgatctgcctgcgtcagcctcccaaagtgctgggattacaggcatgagccaccgcgcccagccagattctgcatttctaaaaagctcccaggcagtgccagtgctgctggccccaggaccacatctttgagtggcaacgttgcacagaagactctcatcagttatcagtcagtggattcagctcatcaaatgtgaaagacccccaaattgccagctccctgtggtaaacccatggcaatgactaagacaaccaaacacagtgcttgccctgaatgaacttattctagaaatatctgagaccttgttatctttctcaggcctctcctactggacctcgtttgtcatgtgtgattgcgaacacctttccctgatgttatctagagatcctgacaggcatgttctgctaaaacagacctcccaggctgtccccaagtggcctcaaattccccagctggggcaccttaagtttatcacgttaggcagttaacaggacaaatataatttctgggccacaaggccagtctgggtgaacgcatgacataagggtgttaaaagtggaggggaattccgaaaatagactttactcttgtcagaatggtgccaggggctggcccagcctgtggaatgcctcagcgctagagggcttgggcagtaaggcacgcttccctggggagggtggtggtggctggggagaggagagccaggttcccaagaaagtaatttggcacctgctctatggcaatcccttacaggcgaagagagaaaaaggaggctttgggacagataggggaattttctgatacaagcagtccccttgtattttcttttcattgtcgtaatgatttgtaaaattccagaaatgtattcgtgcccctacatgacttgaaaatgccgctgtctcactaagagccatgggctaaaacacacccgaacagcggtcagaagtgaggctcgctgtctctgaggtgaggacaacagcctggattcccgagtcaggctcacatctaagcctggcagggcctggagggcggcaacgtgtggtttgcaggttcgttcattaccccagtgttttttatgggaagatgcttgggtgtgtttgtgggaacagaaccctgattttaattacatcccttctggttattcagattatagacttctaaggatcttgtttctctggctttcttctgccctacagagggacacaagggttcagcagagaaagtgcctgtgctctgtgttgacacatagaagcagagaattttagagcagaaagggacttcagtgcatttagtccagcaccctcgaattataggtgagggaactgaggctcagagagattgaaatgacctgcctaaggtcacacaagtaggattaaaacccaggtctcgtaaacctctctattttgtacatcatgctgtctgcacataattatttcttttcagatatttaataaaagtcacaatcagagttagtccatttcttgtctctcctttgagagttgaagtcatcgtgtgaatagccataattactgcattttctgtgcgtttcttatttgattcttctttggcacaagggctctgaggatgcttcagcattgtaccaggcagaaaaacgaacacaattagcagattcaaacagatgcacatcgcatctcacacaggttaatagggaatgtgcctttctaaagcgaaggagccagggttaaacagggcatggaagaattcaaagggtaaaatgaatatgattcacatacttgtagagtggccaaggagggccttattttttactcttcaacaaaacagaggtttggcgctaaaaccacaaagtaacgttcactgtaggcgcacctcaggcacaccccgtccctgctacgctacacgctgcctggtctctgtagactgttactgtctgaggacctcctctcacaaacacttatttaacaatggcactttggctttttaatattttatttgatttctgttttatggtatttttaattgaaccctgttttaattgccttttctgcacaccaagagcctaggtggggaaggaaggcttacaaatgaaatgattattgttattacttcctttctttctgcagcgtcttagtcaaattataaattgattccatccacatattagccccgatcctcatatgcatgtgtcagaaaacagaaagtgttgaataaggaggctgaaaattttcatctagctgagaataagatttgtcagcattattacagagtgaggaaaggaaattggggctaagttcttgccgtcgagttgagcagagtacttggttccgggtgacacagcccacaggtgggcaaggtttcataaactgagagctagaagtggcctagaaaagacatttagtcgctccctcgtgtccagtcatagcccagggcagacatagtttatcctgcacagccttggctgacacctccataaataaggggaccttcctttacagcttttcagagtctcaagggcagctacacagttgcccttaggataaaagaataaacaaccctcatccccttaaacttctgcccctctttacccagtgcccccgcatcctgttttttggaatttgacctatttatgcccaggcactgactgcagggttgacagtagccaccctgaaggggccttggtagggagtaacaaaacaggcggggtgcggtggctcacgcatgtagtcccagcattttgggaggccgaggcgggcggatcacttgaggtcaggagttcaagaccagcctggccaacatggtgaaatcccatctctaataaaaatacaaaaattagctaggtgtggtggcgcacgcctgtgatcccagctactcgggaggctgaggcaggataattgcttgaacctggtggggggatggggacacggaggtagcagtgagccaggattgcaccactgcactccagcctgggtgacagagcgagactccgtctcaaaaaacaaacaaacaaaaacaaacaacaaaaacccagatctggcacacacagaaatggcttctggccttattacacccgctgcctccccagctgggtattcagtgggcagccactcatagccttcataaaatgacttagatttgatgcttgaaatgaaagcttgtcaatcctgggtaaccgcttgaagaaaggaacattatcccttaaaaggatagccctagcccctagaatatctttctcaccttgggacttgctaaaatagaattccttatttcaaaggcagtaaaatgttttgagttcctactatgtgtagtatgctaggctaggcactacaggccaagcaaggcaaataaaactagcctctttccctattcccctgcatttcagaaaagacaacacatttcaaggctctgctttgcaagagaccaggcaccacagtttcctcctatcagcctgggcatggcaagtaataaccccccctatgaatgaagaggttgctgtgttcaaagaggttaataaagtgtccaagaccgtacagtgtcagtgaggcagggaagaaatctgaaagctggtccctggctaacctgtctctttgcgttgtcaacctggaaggaagtgtcagatggtttggcgcagagctctgtccttgggcctggcctgtttgcaacctttgcttaggtgaaaagtgagagtggaagacactagattggaagaagacaatcaggataccaaaaaatatcccagcagactgaggaccagaacgaaagccgtggcagtgagagtggaagggaggaaatgagcaagaggcacagggaagacagagcagcctgaggattcggtgaactgggtttggagttagggagggtgatggcctaggtaagaccactgacaatcaggaggaaatcccaatgaggtcatctgtagattgttgatttttaaagtgccaatggacaatcagtgccacactccaccaaatgagttggagatacagaagtgtaaggcaggaggagctggagtcttgggagccccctacttggaaattacagcggaagctggggaactggtgagagagagtcccccacttcctcctttctagacattgaagggatacctgaagaatctcaatattaaaggataagagaatccaaagaaggcaatattacttgagaaacaagagaataataatagtattttgtcacggaagcccagtaacaaagggagagacagtctgccacttctgcagaaagagacagaaagggccactgtgtttgttaattaggaggtcctcggccagagacctgctaagctcataaacgttaaaggccagagttactctctttgggtggaacagctccagggcagctgaatagataatagtcactgcttcctcgaaagggtaggacacatgatttctttttctttttttttctttttttgagacggaatctcactctgtcaccaggctggagtgtaatggcgcaatctcagctcgctgcaacctccacctcccaggttcaagcagttctcctgcctcagcctcccaagtagctggaactacaggtgcccgccaccacacccagctcaattttgtatttttagtagagacggggtttcaccatgttggccaggatggtctcaatctcctgacctcgtgatctgcctgcctcggcctcccaaagtgctgggattagaggtgtgagccaccatgtccggccaggacacgtgattttaaaagcaggggaagctcccatgctagtcaaaacaaccctactacagcattcatagaagaataagatagaaaatgagatgggagcttagctggtgacacagcagggcacttgcttgcttgggtcagcccagcctagaaagtcagaggtgacggcactaatcagacttcagggaaactggctggctggtaacacaaatcttctgtttacagtgaggagtataaccagcaacccaacgcgagtgacctacatgcagtagttggcccatatgccccccagggacaatccctaaggaatccaaattataatcagaaagtcacttgctgaccagggattataggaataagggacctgggcagaactgcccactctctcctgttttagtattggtgaaactctagtactgtgcagggacttttggtactcacttgtaacacttgattgtctttttttttcttttctttttttttttaagacagggtctctctttgtctcccaggctggagtgcagtggcaccatctcagctcactgcaaccttcacctccagggatcaagcgattctcatgcctcagcctcccaagtagctgggactacaggtgtgcaccaccacgcccagctgatttttattttattttattttttagtagagatagggtttcaccatgttgtccaggctggtcttgaactccaggcctcaggtaatccacctgccttggcctctcaaggtgctgggattacagatgagagccaccatgcctggccggattgtactcttttgatcctacctgtttcccagtgctggattgtgagctctctgagagcagagcctgggtcttactcatctttatatcctggtgccaagtattctgtgttggtcacagaatcatctacttctatttggaatcatctactatttctagaagaccttagtagagataatggtattagtaagtgcttctgtgtttggggtgcctactctatgcctgcaggcacattagataaagatatctttagagctaatagatgccatgaggcgtatcctacagataggatcctgagcttcagagatgacagatctcatgtaatcaagccggctttatgaggtaggaggggatctgaacctggtctgcctcactccagagcacatgctcttcccactgggccgcattacctggagtcactaaggcctgtttcacaggccccttgactgggcagctcccggctctgctccgtggatgtgctgtgtgctaaaggggcggtgggggaggggggccctgagaaaggaatgttcaggcattggttaaaataggtgtcctagcctcttgtcatgccttcatattcacaaatgttcatttctttctttctcttttttaaaaaaattcttcctagggatgatgactgacagattaatatatgtctaactacatgtctcagaaatcaaaaggaaggtgctgtcagaatcacttgtcagaaaatgagattaggcgcacttgtcatttgctgaggattgcagtctttcagagataaggtttcatttaatgagggtaaaaagcctccttttaaaaaaagaagagggagcgagggagtgagggtggggtaggcgaggagtgatgattcttttttctggtgtcagccaagtgttttatcacctaacgcgatcccgcggcacctggtagccactgataatggcaacctggccttctccacctcctctgccgctgcaccacttcaaaagcagctgcttgttacctgcttttacctctccttgaagctgaagctccttctcctgtgggaagagggagctaagcatgtactctagatttaaaagcaggctcaagaaagcatgcagtagaaaggaaacgtacagtcacatttcccaacaaactggaaagaatccacaatggatttcagtgagatatggagcctgtctgagtagtgaagggtaactaatgaggaacagagctagatcccattgcaaccaattgtgttttgttatggaaaatatttatcaagttcttttgcatttgttgattctcttacaagtgacatagtaagagctcctggcatgtgacttgatgcacctcctgcaccctgcgattcaggctggcaatttctatccctttattaagcttctctctacctcaggtgtggcctgtgctccagaagtatttcaaattaatcctcccccccctcaactccctacctccaatcgtagaaaactgcctctgaaatgaacaactttattgtggagaatgccggtgataaagcagaaaatccgtatttcagaaatgtttggtgaccaggcgcagtggctcacgcctgtaatcccagcaccttgggaggccaaggtgggtggatggcttgagatcaggagtttgagaccagcctggccaacatggtgaaaccccgtttctgctaaaattataaaaattagccaggtgtggtggtgcatgcctgtaatcccagctactcaggaggctgaggcaggagaattgcttgatgagcccaggaggtggaggttgcagtgagccaagatcgtgccactgcactccagcctgggcgacagagcaagactctgtctaaaagaaagaaaaagaaacgtttgttccagttctctactccaaaacttactggtgtaaagcagtacccttttcttctgttcctggatttggtgggtcagaaattcagacagggccaagcagagaagcagtttgtctctgctccaccatgactggtggtgacatgaatggctggggactggaatcccctggaaaagtcttcactcatgcatgaggcacttggcagggacaaaagcacctctgcaagccttgtccatgtagcatgggcttctcacagaacggcgtctgggttgtgggaggagttgccggaggggttgctaccagaaagcaagtatcccaagagcttgaggcagaagcagcgagacttctgacctggccttggaaagtcacatggagccacttctgccattgagctgaagcactgacaagcccaccaggctgaaggaaagaagatggggaccgctccatggggcagtgtcaaaggatgtgcagctgtgctttaaaatgatcatcatgctgtaaaggtttctttctacctgtgtttcttcacatctcacgaacgaaatggcctaggaatgtaaagtaaatgacatttggatggttactgacttggtataaaaggttattcctcttcattaaaaagaagaagaagaagaataagatataggccagatgtggtggctcatgcctatgatcccaacactttgggaggccaagatgggaggatcacttgaggccaggagttcgagaccagcctgggcaacatggaaaaccccatgtctaccaaaaattagcctggtggggtggtgcgtacctgtagccccaactactgaggaggctgaggtgggaagatggcttgagcccttgaggtcgaggctgcagtgagtcatgatggcatcactgcactccagtctgggcgacagagccagaccctgtctcaaaaaataaagagagagagagagagagaaaagatgtagacagagagagtgagcccaaccacattaatggcccagggagtctgaggggtggagtgtcctgttcctgctctctgttgctaatggtttaaaacagactcagacttcacttaaatgggcacctttctggccgggtgcgctggcttatgcctgtaataccagcactttgggaagccaaggcaggtggatcacttgaggtcaggagtttgagaccagcctgggcaacatggtgaaaccccatctctactaaaaatacaaaaattagccaggcgtggtggcatgcacccataatcctagctactcaggaggctgaggcagaagaatcacttgaacccaggaggtggaggttgcagtgagctgagattatgccattgcactccagcctgggcgacaagagtgagattccatctcaaaaaaaaaagttcacctttctgtttctttccagtccttctctgttacactcttcaaaaatcgtctgtacatacttgcctctatgttcttacaactttgtttagaacttaacatttaatatgtaacctagcttcaaccccattttctaacaattctcctgctattcaccagagacctcctaaatcagcgatccacctgtcttttctcagtccttctcctccagcacctctaacacatctgccatttttgagttctcctcctcctggaaatcccttcttgtcattcaactctgtctgtgactccttccccagcgcagtaaacgtggacactgtccaggtgtagtccttggttgtgttttcttttcacgccacgacattccctcatctctttgcagaagacatttgcaacttatctgcaaatccgagctctctttctgatgttccactcccaaatttctgaccgtggctaggctttcctcacggtcttctaaattcatctcgtcccaagcaaagtctctatattcccctgaaagcctccacatgcttctgtgttcctgatgttaaccagttccccagcctttacatcttagcatcgccctttgtgttgcatcactgccacacactcgtgcgttccttgaggttctgcctcctaagtgtgttttctcaccttagctttgccccgtgtctcctgccattttcctcgagtcacttttccttttttctttttgtagaggcagggtcttgctttgtctcccaggctggtctcgaacttctggcttcaagtgatcctcctgcctcggcctcccaaggttctgggattataggcatgagccactgcagcccacctcgggtgacttttcttaatgcttccctggatacctatcaggttctaccttataaaatttttataattttagtaggttctggccaggcgcggtggctgacgcctataatcccagcactttgggaggccgaggcgggtggatcacaaggtcaggagatcgagaccgtcctggctaacaccatgaaaccccgtctctactaaaaatacaaaaaattagccaggcgtggtggcgggccctgtagtcccagctacttgggaggctgaggcaggagaatggcgtgaacccgggaggcggagcttgcagtgagccgagatggtgccactgcactccagcctgggcgacagagcgagattctgcctcaaaaaaaattaataaataataataataataattttagtaggttctaccttccccacgtgtagttgtcctctctccctcctaaattataagtttcctaagggcagataacatgttttgttcttcttttttttgtacatagttcatacttagtaaaagtatccatactgaatgaatggctcttacttatactgtaaagaaataaggcatacagcggaagtgtgtatgcttaatacacatacaatacacaaactgttggatttaaggaaagattttgatgacatgaagaggctaacactgccgaacgtacttccaaatattgccttgcccctcaactctccttggagtggtactggggggagcaagacacataagcaacaataataacaagaatcataatagatatatttattgagcacttactttgcagttgatgctcttctagctaaggtaatcttcacaaccctggtcttttcaagacacactttgagagacaggtacagtatgttttccattctagagataaagaaactgacagaaaaatcaaatactactttttttattagttgggtgaatgcttagtaccaccaaacaaacctctttttgcaatccgtgctaaagcaagtaagtgccttaggctcaccaccaaagcaggccttcctttttcccttagtctaaattttattgtgggttgaccacgaagctcagagcaacttccaaggggcccctagctgagcttagtcatcaccagtcctgaaggcaacagaaggcagaagagaggcccaagtgtgtgcaggactttttaaattcaaagctgtggtttttcgaagcacagggaccctgtccactggcaaacctggcccaatcagagtcttatatgctaatactcggattggcaaccatgaggaaagctgggagagtttcctttccctcacacaaaccctaaatgagtagatgaataaatagaccctgcatggtatatgtaatcatataccaagcataatgagagacaaaggaaatgtggcaaaatgttatcaatggaggaagtcaagcaaagagtttttgggtgttattctcaccatctatcattattttttcctgttagaaatttttcaaaatacacacttaggcaaaactttaaaagacatctaaaacaaacaaaaatgagtaactgtaaaggtaggagtcaacaataaatacacgggaaaggaatctgaagccaggaacgttgtggcccatccaagggggaagtgcccagagagaagggaagaggtagaactggagacagctggtgcttcttagggagatgctcagcctgcccaagaggctaatttaaaactaaatcttatccctggatcccacagcccttaatgtgacccaaactttccattaccaaattctggggttttaaatcctgatattgtgtgcttgaatctggaatctgtctcatccattaaagatctgacctattgaggccacatgtgtctatgcaataagttcttttcaagccaaactttcatgttaaaaaaaaaaaaaaatcctgagaggaaatacatgtggtccctgtccgcttctagcccacttcaggctatttattgttttatttgattgttgagaagtcagaaatgactaaattggttctcaatgtggcctgcacatttccttggctaggaatggtctgattaaggcaaagcccaacttagaatttagcagtgttctgatctgtgtgggtttgggggaaggcatgtgtattttgttctttcgttctgaagtccttcccttgtggatttcagactaaagtgggtgtgatgacacatttacccttttggttttgtttttaaaacacaaagctgacaaatgtgtttaatggccccgtagtaccaactgacagcggcacggagcccaggaggctcacttgtaccttgactgtctcagtgaggaagctgaattttactcaccacttagaaggattaaatgcagaccatagcatacttctgacatttcattggcttatcaggaaattccatgagagtggggaggagggtggaagcagaagaggtacatacattgaatggtatatcctacttagaaattataaactctaagaaaatattaatagaaggaggaaaatatttatttttcagcacagagactattctctgtttatacattaggtaccagatcataaagaatcacagagagagagagattattcatcccaactggtgtgcattttaatggtgaagaaatagttacctgacttacccaaagtcataactagttgggactggacctgttgtaaaatccagggcttctgacctttctaatccagtacagtattcattcagcacctcatcttccctgtcatggtctacaatagccctgcaaacagtcttctaaaactcatcagagttggctgctcatgtgatccggtccaggtcggttctctaatctgcctacaggtcagttctttgaaatcatttccatgcctcctcatgcacccccaaactcagctggtcattttgcaaatgcaggttgtcagctgtgagtgagcactggtaacagaaagaaaatccatcaccacgagtgctgatggaaaaacaactgggaacgtactgcctagtagaatgttgtttgtggcccgatctttgtataagaaggaaaacatcataaattaaaagaaaagctaccagccaacaactgtatttttaccagcctcctcttcttccagaaaactcattgcgaggaaaataaatagcattctttcccagcagcacaaccgaaagtcttgttagttataggcgagtggctatttgaaagcctggctacaattttcctgttttactaacacttgtaattaaatccatcaactccctctaagattctgtgtaaataccagatgctccctacatttttttctctcctggagaatatgaaaagttgtacattagcagtagaggaacttcaaaggaggcacagacctgagtgaaagtgaagttctgaagatccacactcgcttccctgtgaatttcttagagtgttccagggagggcagcccaccacacttggccagcacaggcccatcccatctctcacccgagtggcggatgttaagttgacatccgtgccccagttcaggagcagatggctctgcgtggggcatggtggtttgggagaatccacccgggcctggcgggaatcctgttgttgagggaggagtagggccctgcctcccgctccccgagggtttgcagcccgcttttcatgtgctattgatgctgcccccacccgctgtcacttggagtcattcagtcaatcacatggagaatcagaggagaggcttgggatggctctggataaatcctccctcgctactgggggtgagaaaatcctcttcagagcacatgcactcctcagagggcatcagtgtacatatatatatatatattttttttttcttctgtatgcaaagaagagtaacttgttcccccaaggtgaaggatttcagcggtaggcaaagcaacaccactaccaccccaacccgcccactttgcttttccagaattaaacgtagttgcctagagctgtcatgacctacagagaaagctgaggaagtgttaagtgaatcatgaaagcaaatcaacagacctgctggtatttaaattttagtgtattccagtgtggatttcttggtatttgtaatgcaaaaactgggaacgggggctccacctcctctcccagcagatccaaccctatgttccaacttagtcccagcatattcgaccccatgttttgtgtgaatttactttaaagtctttcacactcccgaggccgtcagcaaagcactcatatcttatgggcaacccccagccctcttcgcttataaactaactgtccgtggctttggggttgttccctaccagttttattgggcaggttgttagctaagggattcattctagaaccagaggtttgaggcagacctctaagatcctcttgactctgagtgtgtggaggagagtgagggaaaggacagaacccatggcccgcgccacctcagcttctttcagtttctatttgaaactgaaatcacagaagagctgtcagatggcagctgtgcatttggtggaaatgagaattccagattttatgctaattcagtttcaggttcctttgaacctgcagtttatggggccgtgctgaaaactgcaatctgttttggataaaagaagggattactaaagactttttagttgtacaaacattcccagcctccaaaaggaaaggggggagaccagatttattctttcattaaaattgtcatgttaagttttcttctgctttatcaaatagaaaacttttccttattttggcaatgatttttcttatttcaagtttttttgttgttgccgtgatttattttcatttcagtagcactctttctcgaacttcaaagtccttgtcacttcctcccagaggcaggaacacaaaggtggtgcccatggatgtatctcatcctggcatgtgctcaccttcttccattctcgcagtgttgattgaggctgacccagatggttgtttcacttacctattattgctttgtaacaaaccacgaatttggagcctggaaatacaatgctgccattagggcagggctctgcagagaagcttcctctctgttccacatggcatctgctaaggcaagttcagctggagctggcggagccacacccaagatggcttcttcacgtggctggcaagttgtcaggggctgttggctgggaactcagctagccctgtggtcccaaggcctcagcttacttccatgtggtactgcttgggcatccttactatatggtaactgtgttacaagcttaaataaccagaagctgctgggcccaaactctgaatctccagcatatcacttcctcctcattctattcatcaaaacagtcacacgtcagtcacaaggacataagtttcaccttctaatgggaggcatgacatgcacatacagaattatttgggagccatatttggagatgagcaaccacaatggttaatgatatattttttagaattttgattttcaggagaatgtacccacgctctgttgttagccatatgggtttctatattctgtgaaatcccaaactgttggcaattcgtggaaaggactttgcagtttagttttatgtttgagataatgtcttcattctcttctgttttagttggcagagatctggtcatttatttatttactcattgatctgaccactgcgtatcaacccatctcttacatgtgatgcatgagaatactgtactagatgttaagggcaatggtggtgtgtaagagtacatcacagtcctggtccttgagtgattgaatctacagactgctctccaaagcagtatcttgttcccagtgaggatacgtgtgcccctaaaggaatggcagtgtccagaggtgagccgagaaacaactacatgttatatattgtcttagatctatgtttccattaggaagcattcaagaaaagctgtagtttggagcagaagaagaaatttctggtgtaattcatttgcaatacagatctgtaaatggaaattacataggaccagagaggagctggcgggtctttgtaggcacacaggcttgccctgaccctatgtaacagcggcatatgatcataataactggcatttctgtaacagttaaccatctacaaactgtgctaatttgattgataaagccccagagatggaggctattggaatggccatagtagggtttcccattccattctgatagcatggaagagacagagagaaaaactaaggccagagcaagagggaaaatcagaaaccttgctcaataagaatgctttcaggaaatcgaaactaagggaattctacgacattctagctcctcagctactaccccagcaagtgtatgattccccaaaccagtagaagcaaatattttgtcctcagccaacaagaattcctgcaagtcaatatttggaccatcaggatgcttaataataaggctagggaaaaaaaaaaaaagctttgttagatcattgtatattagcatagatgcaggagtcaaattttcagtaccctaaagattattaatactttcaggtaacgtttccaggaggagatagcaaagcctttgagtagaaggatggactaacatgcggttggccaccattctcaggatgtcagtaatctttcaaaccacaaaacctgggaaggtaaactacttgtatatcccaggaatagtcacgtgacttatagacagccttaccatgacccttcagatcttaaaacctctctagagtttagacagcagaatgattttgtcttagacatctggccagtggagggagaaactgagatttacccagcagtggggataggatggtgtggtgtggtatggtgtggcgtgatgtggtgtggtgtggcgtggcgtggcgtgttgtggcgtggtatggtgtggcgtggcatgttgtggtatggtgtgtgtggtgtggtatggtgtggcgtggtatggtgtggggtggtgtggcgtggcgtgtggtgtggtatggtgtgttgtggtatggtggggatggacagtgggagcatggtattagggaaggaatgtgacatgcctgctggcaccatgctataatcctcattccttcactgcagaggacctccttacactcctgtatccatttccttatctaaaataaggaagaaactctccgttactctctttgcctcacaagattgatgtaagagcaaacgacattataattgtagcattctggaaaaatatgtgttactctagggcatttttggcagcgtcctttggagaggctgaatcttagaaccagtaaatggcaccgtcacatataatttatggctcatgctcttttttcagtctagggttcacttcttggttggttgatttctccctcccttccatttcaaggcactgaaatgaagactagaatcatattttgagcttgactcagtcctagaatagcagcagtctttccctgggactaaccaaagctagaaatgagggtcctcagatcagatacagaaaagtagttcttggctgggtacagtggctcacacctgtaaccccagcactttgggaggctgaggtaggtggatcacttgaggtcgggagttcgagaccagcctggccaacacggtgaaatcccgcctctactaaaaatacaaaaattagccaggcatggtgatgcacccctgtagacccagcttctcaggaggctgaggcaggagaatagcctgaaccagggaggcggaggttgcagtgagcagaaatcgcaccaccacaccccagcctgagtgacagagcaagactctgtctcaaaaaaaaaaaaaaaaaaaaagaagaagaaaaaagagaaatagttctccctcagtagtcctccctcaaactgagctgaaatgataataacatatgtggtatgacttgttgaatggtaaacatggtcggagaactcccaaaaaggtagtatttctttcaatattcatattagtcattccagcatccaactgaggaacatctaaggtggtttcagggccctcttttaccctgaattgttttttaaaaaaagaaaaaactgcggagagctcagcctaaaatggctaaaatgcctcttacctagagaactggaaaacgcgatcagttcaccagcagttccccgtttcccacagtggttgtttctaacattgccacttagtgcatctgctgaaacacagatggtcgcatccctaccagcaattgcagagactcccttcccaccctcccagaagctgcacccatgcccgggagcccatggctacagctcttaatttatacatgggtgcaatgacagccactgtttgctgagcaagcccccgccccagcaccatctcccccagctcagtccttcttctttcatagtaagctcctgtctgggatcctcacctgtcaacagaccttacagcaaggctgcctttgtcaggctaccatatgtcctgtccccttaggggactgggtgcttgacaaccttcatttataaaactaagaggggctgctagaagtcagctttcctgaaactataagaatgtctactcctaggtgacttgtcactaatgatgaaggtaagttgctgttccaagtgctttacatacatgaattcatttaaccctaacaacagttgcagcaaagtaggtgatgttatggccatactttctagatgtggaaactgaggtacagagatgcaaagtcctctctccaccatcacacagtaagtgggagtggaggataagctaggatttgaacccattggttctttcatgagtggctaagcttttaaccactagaccaactacctcttagttgtccccaaacatagaaatggctggcacctgtttaaaggccctttttgttttgtttttgtttttggagacagagtcttgctgtatccccctggctggagtgcagtggcgcaatctcagcttactgcaacctcccgggttcaagcgattctcctgcctcagcctcccccgagaagctgggattataggcacctgccactatgcccggttaatttttgtacttttagtagagatggggttttaccatgttggccaggctggtctcaaactcctgacctcaggtgatctgcccacctcggtctcccaaagtgctaggaccacgcacacgtgagccactgcgccagacccgaaagcatcttttcattcattcatttatttgtttttaaatccaatcgaatttagcagtggggagttgtcttaagtgtcttcttttccgctgaacacattattttcctcaatctgtcatctctgatgactgacttacacattgtgttctacgccgatccgtcctttcagctcatgcagacattttgtatacattttcattttaattaccaccccccaactctgccccatgttcatatggaaatagaggagccaggtgttggatacatgagccggtaactaaggcaggatgcgtacctggacttagtagggtcccccagggagcatggactcaatatgaaatgcaggtcgctagaccccaagtttcaaacacccatcaatatgacatgatgtgagaaagagcaaaccaagtccagacggaaacgagacagccatgaccaggggaggcagagaggcctcacagttctcatcacatgcactgctgtaaaaagtaagatgagatacctacagccaattgggtgacacgagcagggattggatttatttgtatttttcattgcctttctttgcagggttgtcagattctgaatattaataccttaatgtagatttggtggttaagtaagatatattttatggattttttaatactttttcccctttgtagtttatagtacattgtgaagtttgaaagtaaaattcctttccttgacttctacactcggaaaatatttattcccccctgtgtctcaatggtatgcatcataaactaatccagttcagtttatttacttccctcttgttgcagatccatgatcaattgtagcaacacgggcatataatggcagaggtttttactttacagcagtacgagcatgagctattgcactctcctttcagggtgataaggaaggaagcttccattttcagaatcacccattcagaaggggttggggggcactgagcagaggaactgggggccacctgacgttgattagccctgaatcgctaaggaagacatcccaatccatagtttcaaatgaatcagcctacacagaagaaatccctgggaaccagaaagagttttaatctcctgggctgaacagtgtggaaggcagaatattaggaattagcagaggtgacaagtaggacaacctcggcctgcctcccagtggcgggcaacctgttgactccagttctccatcctaggacccttgcttgactgccatgagtaagagcagtgggcaccgaagtcaaaatgcagatccctccaggcttctcagtagctgttgtctgccctgagcattctcccaaccttatcagttacccagacacttgttgggagccctcagactaactagcatgctgggacaatttccaccgtgtcttcattcctctcatcatgggtatgttgagcaaggcctcctaactctgtgctgggtacaaattccaagatgtggacaaattctaagatgtgaattctatccacaagaaaccaggtgagttcagaaggcatggctcggggcatacaggaggatttatcatcacaaacagataataaagtgttgtctccagacacacatctgttatttatactgctgctgtggcatggacaaagacaagcaagacacagtccttggatagtcacatttaaagccaaattgaggtggtgggtcctccatacagagaaaataaacaaaaaaaacaaatcatggccgggtgcagtgactcatgcctctaatcccagcactttggaaggccaaggtgggaggatcgcttgaggccaggagtcagagatcagcatgagcaagataaagagaccctgtctctacaaaattaaaaattagcccagcgtggtggcgcatgcccatagtcccagtactcaggaggctgctgcaagatgaccccgtgagcctagtagttggaggctgcagtgagctctgattgtgccactgcactctagcctgggcaacacagcaagacgccatctcaacaaaacaaaacatgcttctgcaccagtaagacatcatttttatagtcgtaggcaaaacggtagtcctcttaaaactggaaattacaatttaacatgtctaaatgacataattgggatgctgctattttatgttttaagaaattgaagccctcactattaagagtttcatcacatcttaaggctggcaggcttttataacattttgctggattcagggtcgactttataatctaccaagaatatccatgtggctgggtgcagtggctcatgcccataatcccagcactttgggaggcagaggcaggaggatcacttgaggccacgagttcaagaccagcctgggaaacatggcaaaacaccatctctagaaaaaaatttttaaaaaattagccagatgtgttggtgcacacctgtggtcccagctactcccagctactcccaactactcaagaggctgaggtaggaggatcacttgagcccagcaggtcgaggctgtagtgagctgtgatggcaccactgcactccagcctgggtgatagagcaagaccctatctcagaaaaaagaaaaagaaacacccttattaggagacccaagctatccactgtccaggttctgaccctgtctggagggattctttgcagtaggtcctctataaagatgtcgttcccagccaggcacggtggctcatgcctgtaatcccagcactttgggaggctgaggcgggcagatcacgaggtcaggagatcaagaccatcctggctaacacagtgaaaccccgtctctactaaaaatacaaaaaattagctgggcatggtggcgggtgcctgtagtcccagctactcgggaggctgaggcaggagaatggtgtgaacccgggaggcggggcttgcagtgagccaagatcacaccactgcactccagcctaggcgacagagcaagactccgtctcaaaaaaaaaaaaaaaaaaaaaaagatgtcgttccctagtagagatggtacaaaccactgtacccactttatgggactggtgtcattttgatgttcatgtggttattttcattattgtggtgatccccactgggagaacccagtagaaggcaaggctatggccattgtggccctaataaaatagacttttattttgttggtctccacggtaatcaaaagaagtgtgtcatctgtaatcataatagacaacaaatatatcctccttactaagtgccaggcactgttactgatgaaggccccaagaggtgtggctcctgttatctcactttctagataaggaaactgaggcagggagagtgaagagatttacccaagctgtcctggctcagaaatggcagagccacaattattaacctgatgctggctccagggcccagctccaaacctctaccctgaagaacaagtagaaacttggattttcagagcttgcagaacctttagaacttgaaaagaatggagacttccatagtttcagaaataaaccaggcatggtgacatccttgccgaggctagttggagttatcaccctccttcaatcacctagtgatcttttaaaactacatcatccataacgaaaggttcgaggaaattctggtgaagacttcctcttcctttaaaccacctcaagaagcacacagcacatgcgctgttagagtgcctgaacttcattatatttaggagggggagcacaatgaaattaatgaactttctctgtataaaacgcttaacagaagactataatttgtaagaaatattttgctaaaatatatttagcttaaatctggtaatttgtgatataaattgaatcccatctcagattataatttttaagaatttgcaagtataggccagacagagtggttcatgcctgtaatcccagtactttgggaggtcaaggtgggagaatcacttgaggccaggagtttaggaccagcctggtcagtataggaagaccttgtctgtacaaaaaataaaaattagttgggcgtggtggtacacacctgtagtcccaggtacttggaaggctgaggcgggaggattgctttagcccaggagttccaggttatagtgagctatgattgtgccactgcactccagcttgggtgacaaagtgagaccttgtctcttaaataagttaataaattcataagaatttgaaagtatagattgacttacaagaatttccctttgtttttaaacctagtttaaatctttagatgtatttttgagatttgaggaagaaggctccatattttaacgtagctttacattttttttaaactgattaatcataaacttggctaagatctttgggcatatattaaaaattatttctgaaatcattaatctaacaccagagtggaaattgagtccacattcttgctctctgctttctattagaaagggttgccgctttctaagacttgttctccttagattgggttcagaggctaaaggtgatgttaagaagccattagtgtttagtatgttaatccacctccatgtaacagaaaagatagcttccagcctttgacttggcatctttatattaaaactccaataaaaggaaattaaatttctcaaggaaaaaaaaaaaaaacaatcttcctgattattgaaagccctctgacctggattcagtccctaatatatggattatcaaatttagtcttctttcttccttcttcctacttctgatgctgttgtgtacctggtcccctccaattttgacattcattcccatccccgcttccagaaagcatagggaatagagcagtttggaaaccagtcagaaatgggctcatttgtgagtctggagagaggatgagaaatggagcaggtcacagtgggtggtgttctgcaaccgggccagccaggggaccctggggagcagcactggaggtggccacagtggtcagaggcttggcttttggcgttcccaggttcctcttgatgagagatcatcaaaagatctggacacatgcagatctggctgaggccgtcatctgaggcctaatccctggtaaccattgatgacaatttttttttttttttttttgagataaagtcttactctgttgtttaggctgtagtacagtggcatggcgtgatctcggctcactgcaacctccacctcccaggttcaagcgattctcctgcctcagcctcccaagtagctggggttacaggtgtgcacctctacacattttattagtagagacggggtttcgccatgttagccaggctggtctcaaactcctgacctcaagtgatccacctgcctcggcctcccaaagtgctgggattacagacgtgagcaactgcgcccagactgatgacaatctaatgcaaggcatgataaatgtcagaagtgccacctaatgaaagcaccctggagggccaagtggtttcagctggtcagctaagctgccatgccatcgtgctctcagtttaccctgtaggggatggtgcaggagctcaggcagtttcttccctgtaacaccgattttgctagaacaacaagataagaaaactgttccattttgattgttccaaaagaaacaaccttttaatgtcttctctagaacatttcatgtccacctttgagctatcctggtattgtctaaacagcttcagaatgaatgccgcctccctggaggaccacagctgggtattgtgacatcttgtaagcaactggaaaatccatctccaaacctataccttctgagatgccttttcttttgacttctcaggaggcagtggtagagaaaaatcactgttacctatatttttaaaaagacttgtataacaccacattgtgctaccagtttgggggagggggtgatgaagctagagagagaaggcttcttatttccaaacttagaggctagaggagggggaagtatgccatacagcaagcacccccaccttttttttttttttttaacttgagaggtttttcaagagtgccatgaaatcaaatagtgatagacatgcaacttcaaagaggcaaggagtggccatcattactttaaaccagtctgcatgtcattcatatgtggtgtgcatctctcccaacccctgttctcttcctctcttcctccagccacactccaggtaacggtggcactgggaggggacttagaactgaagttttcctctcaccccaccttggtgtgcccactgtactccacaaccctaccggttgcaacctagggcttgcttgctctttttcttgtactaggaaaattgcagcagcttttcctctgcaccaaggagggaccttgtcaagctgcaggtgtggaattaaaactccagatgttttcagagggtttcctcgcccggggtgcgttctggtgggagtgggttgctcaggggaatctgctgagtgcctcatttctggccattcagtcccccacaccctctgggggcactgcactgtgctctaggggatacagacacgatacatgttaggatgatagacgtaactgctgcccatgtagcgaggctttgccattgctttcattctttccctacattcggtgaatgccaggggaagcaacaggctccacttttgtggatgcagggtgtgcacgtgtcagagggtgtgaggagctgggaggagaggatttctaagtggccagttcatgctcttaagttattcatcaaaccgagcacactgcggtcagtcggctgtggtggggaaggaggttaggtgaagacctttgtgtctgagacccagaccgtgatccccgtctccattttccacaatgcaatgattattttgtattgagcgcctactatgtgccaggccttttacatacatgactttaccactgagccctcacaaccgcccagagagcctgctctttgcagatgtgactggcttggtggcaattcaaccccaggctgcgggcctagtggcctttccctgccatggcgcaatcttggaagcggcaactgcggggagggcgaggagcggtgcagtttccgccgcgcccgcccgcaaggaaggcagccggggggagccgagggctcgagccgcggggggagcaacagctgtcgatgtcgcgcctggggaccgcgcctccgctgggccgacccggcgccggggacgagaggaggggcggcgaggggcggggcgcgcggggcgggacggaggaggggcggtggcaccggcggctcgggctcggcgcgccgaggaagtcccgctccgagagctgcgagcgtctggaggaggcgcgctcggcgcagtcggggagcgaagtccggagcaaggggcccccgcgtagccgccgccccctcctgctaccgtccagccagggagcccgcggcggccgccgatggagttcacttgagctgtgaaccggcgggagaggcaggcgcccgcaagccgagcgcgggccggagcccagccagccccgggcgctcacccgccagcccgcaagctccggccagaggcgccgccgccccgcgccccgccgttgcagcgcctcctgggccgcgcgccggcgagatccgcacaaaatccagactcccggagcggctccctccagcaccgcggcgggcccaggaccaggcagcccgcggcgcggctggagaggcgggaccggctgtcggggagccccgggcggccgccggggagaagccgccgcgcgccctcctcctcctcctccctctccctcctccctccctccgcacatggtctcctttgtcctgtcgccgccgccgccgcctcgctcttagctccgcgcgccgcggcggcggctcaggccgctcttctccgcctcgccctcccgccggccggcccgggacgcgccttgttagcccccgccgcgccagcgcggccccgcgcgccgcaggagcggcggggagacagtggcgagcgcgggccgggcgatctcggcgggcgcgctcctcccgccgcccggggcctcggccgcgctggatgtgtgcgcgcggcgccggctctcggtcgccccgaagctgttgcccggttcggatctggttcggcgcctccgctctcggactttggcgaggaaggagcccagagactcttgtggacagagccgggtcgagagttgggcgttttctcttcgtgtgttttggtggtttcccccctggtctttgacgatcgcccttcgggagccctgctaaagaaccaaaccatgaacttggggctgaccggaccgtttaaccctttgcaaccaggtaatgaagcccccggggcgcggctcgcttgcctacctctcgcggtcggaagggaggcggccggatcgggggtcttttgttgcggcggccgggccggcgggcaggggtggcaggggcgggcttctcccgtctggcgcgcccaagcgccccttcgctacccctcctcccttctttcctcccccctctgcggccctgtcgcccgcctttgtactttcctccctcggccggccgggctcggccggagctgcgcggtcgtgcccgggagggcctggcgttcgccgccaagctccgatgtgaggagggggccggggcctgcgtccgcttgagctgggggccctagcgtggcgctgcccgctcctggggtcgcgcttccccagcgcggaggtcgggatcccggcccgcacccggtgccaagggaggcgaaaggagatctgggctcgggttcggcagcgggagaaagaactcgcgcttaagtttccaggaggtttctgttttgttgttcgaaagccccccttctcgcctgtgcgggtgcggagggcggcccccggggtctgcgtccgaagggagtgagggtgggcctgaagcaggaatcgctgggtcccaccccgtctgcacgcacggctttttataagttttccttattctccgcgttcccgcctccaatctgtttcacttacttaactttcctttaaacgccaactacggcttctagcaatattttttttacatccaaaaaaacaaaaaaacatattcccccttcccttaaataaaaagcagccaaaagagagctttggttttctgtcagttttagattcaaccacttcatgcccctaccctccaaaaccgagcgaggggatgaaaggaagtgagtaaaatcttcaagtctgtagcgggtagaggtgcccccgtgttcgagagaaggaagagctcaattcgtcggctcattctgggctcgccgcttttccatttgaataataattttttttaaaaagccaggaaaatggtccaggtaatagaaggaaatgcagactattttctgaaagcaacgaaaatgataaacatccccaagattcagacccaaggaacaaatcatttgtacaaatgccctaaaaccctaagtagaaggaaagttcgttgaggaaaagcaaagggtactcgtgtcgtttcccctgaagattttggcaaagaatctctcttctgacttgttaggacagtggccggccacagttgtaaccacctggataggagagagaagggatccagaatgttttcacggtcagccagagccccattgcagtcgtcatcttttgggtgtttttctggggaggcctttctgagacaccccctttcccagttgcaagaggcatggtgtccagccctgtgacttgtatcagccaagtaagggcttagaaagcttttagtcgaagatacactcctaagcctctctgaatatccggtcagacttacttccttaataacttactgatcggcatcataataatggcatcctcaagtttggttcagacatgaggatcacgtaagtgtctgtctgagaatcccatgtggagctgacaaaggtggcagaagcaaaaggcctgttcacccacagcttctgtccttttcactcgaacacacacacacacacacacactaagtgcaaataaaaacttggtcaggaaccatttactttccctgtttatgctttttgcattcagagacagtaatttgtttttacatttcttggggccaattagagtcactttaataggtaatcccagaattttcaaaggttatgtcagtttggtaaaacactttaataaacaggcttttttttccccttctatcagttcattaattttgtaagccatgaatttaacatgaatttacattcaaaaagaattccaacccgttctaagaaacactttttcatgaaaggatggtaaaatacacatatctcgagtttttagctgggaaactcacagtcctagaaatctcacttaatatttcagtgtagcatcatcatgcaatttttggctttataactcactattcttgatctaggtatgacttgtttctctcccattaacatttttttttggcagtttgtttttatgtaaaggtactgttatatatagtttaagatgtcaggaaggccctctgtatttttcattattcctgcaaaataggaaaaaatctatctagggtttatgttaaactgcatgtataaatgtatgcacttcaatgttcgttttgcacatacattcattgtttctggattggttaatcatatggacacccccataaaagtaatgttagaattaaaataaagcaaaaaacagtcttaatacaaatattttgtctttctatatcacttgcattgagaactagaacatgtcccccagatgtacacaggaatatttcatctttgtcagtattacatggaaagactaaattgaatatcctctttgtccctaaaagctagccccagagtcaaaatatgctgcacttcagaattccccccccccatttcctatatttcctttttccatatttattcaacattctaggcttttgctttctcagaatatgcatctctgtgtatcaagtgtgaaagatgagtgatttctcatgagggttatgtagtgaaaacagcacaaatatagcttggccattataactttaaatgcagatatatcctcacgttatgtagtggagatgcttaatttttattttttcaagttctagaaatattcagtgctgaaacattacagcattttccttcaaaccgacttccatgtttattttccagaacattagtgtataatttaaattggctttagttttactgtttaaacaggcttatttcaccttcctcaagccactgtaataattagcagacatgttctctagaaaatggaaaggaaataatgctggtggcatgcatagtggtcggattttggggcaggccggcttgcatctttttgaacaccaaggtcgtttggttactgcaagggacagggatcttggagtcatcagatgaatcttaaaaaaaaattaatttctggcagtgttggcttacactttttagtgaggaaaagcttagcattaaataataggcatttctgatttgtgaaagaaaattgaaaaattggcatgtctgcaaataccacgaaaaacataacatttccaaaataatgatctgtcaacgaaattgcaaaatcattatgtgaatgagctgaattgctttgtgtatcatctcatagaaatatgttttgcacagataatgtgtctaataaggacacatttttaaaatcagatttttttccccccagcaaatagctgcactgcaggtctctctcaagcagtcaactagcaccaccttatggatgatttggggacattgctgcttccctgctaggctttcgtaaaatgtagtcaactgatttaaaataatgggaatgttgatggtgatgacaatattaatgacaataataatgcttttttcccccttcttgtttttcaggcatcagatgccagctctgaaaaactcttcaacactgttattgtaaacaaaggtaagacccattcattctcctgagtaatggcttatttttatgttagtttcattgtcattgcctaggaagaaagaagagctagagtgatctttctcttataattctgaagctactgttgatgtttcatgtttttgcttgagatggaagtctgcatactttgtgatgcattaacattaacaaccagtttattttaaaagaatacattgagtccctatttaaactgatttgactaatcactactactatgtgactttaatatagaaagctgtactcgagaagaatagttctcaaaatgcctgaactttattgttacttatcaactacccagcaataggagaaatataaatagctgatgtgcattgcagactccagtaatcaatggatgtttagaattcacagtattatggtcataaaccaagccttactctgctgtgggctttctgtaaagttaataaacgagcgagagggcagaatttaaatatgcactatcccattaatttcttccaaaccacgatctagagtaagagaggctaatgatatagcagtacattaagggaaaactaaccttaaatcattgccagtaggtttctgcgcagctttcatttgttagcagtatcgttggaaataaggaaatttaggggagtctgtaatcactggctctgaaaggtgtgtaatttgaaagggacaaaccatataaactatttaatcttcccctttccactgtcgagcctgatttaggggctggcatgataattgctaagtaaagatgtgctttctgtgataatctctttctgggttacatgggcgacacttggtagcacttgaacagacttgggccttcacaaagtgaaatttgagaccatttcagccttctgtagttgccttggctagcatttttgctagctggttagtaagacatttccaagtgcagttattttgagctcccagattattttagaatttgaaccaattgcaattttaaatagtacattatgtttagagttcccttgaggtgtatgtgattgccgttactcccagaattactgtcatattgaattttatctttttttattgcataatggagtattccagttttatatttcatcatattttctgatggactgaaagtttgtataaatgtgttatccataatgctaaaagcccaataaaagaagatgtgtgccattcatagcatacagtactcgtgtgtaaaaatgcacaattgtctaccacttggcgtttccttgtgagaaaggagggtgatgggagagggagactggggtagagggcaggtcaccaaaggcagggcttcttcgtttctgcagccccccaggacctctgccacatgtgactgtgtctgtcttctgctgatttgctactgaaagctttggaatgtatttcccctttctgggatcaggccctagaataagagttggctccaagacctgcactctggccgccactgccctgaaagattgtcttcagggcggatgaacagctcgcctctgcctcttccctctggttctttccccccctttttttccttttccaatcaaacgtttcccacattcttatttttgtttacttacagagtgtgatttgtggcatctatttggttgtgaatagccctccccctgacagggtgcctttcttctgagctgcttttctaggggtgatttagttgccttgaaaggattaaggtttctttgtgtacactaaaatcaacataggctttttctaagctttgcttgggaaaccatacacaaataagcattttagttgatggcagattattcctttgccccttatttccatcaaaatggcctttcttttctcctccagagtttccccttaatgccttatgctaattcctgttggtaacatgaatgacaagagacggaatcagtgcgaatccaggtggtgcaaagtagactgactggtatcccgcaccccctttcctccctggggagaaagagattaaggggggtgtggagggggaaagcatcggggacagttttgttaaggggattagtattcaaactgctaaatatcaggaaaacaacttcaaaaagggattcattgtgtagcgataatgtcaataattgcttcaggacaggtgcagagtctccttataggcttgtggttttgggtctgtttttactccgggtagtggcagtgtttacaggatgaatggctgacaaggccttcaaggaactgtcagcttcatgcacatcaagttcaagttttcctgcaaggcggcctgcctgcctgaaagtcaggtctcctatctttgtccagtatctttagccaagagcaataaaaagcatcataagaaagggcaaatttacaccaggtaacaaacacaactggggaaatcttcaaagccccagcttatgggacaatctaaccagagtgcaggggagctgacacgtgtatccctccacctccagatgtttaagttacacatcacttctccctctcaagagactggtagtattctggccttagaggagtgtggctttaagctgctggtgagattatgctgctgagcctggtggcaggcagatttggtccataaaatttcaccgtgggagggcagtgctaatctcacaagctgattgtggtgggggttgggggggcgcagccctgatgttgggctgcacagtgcggagatgaagctcaggcagaggcagcaggggccgtggctcgaggcccatcagtcagcttgtgagcttgaataagtcatttaccctctttaggtcaagattttcaatcataacaaaacctattccagggccaacatctctggtggggataaaacaattaattgggaaggggcaggggttgaaacagagtggatacagtgagtatattttatatcacgtttgttcatcgattttattttgactttccctgtgttatagatgccatccagtttcatagagatttttgtgtttaggtgttccgaatggtcgttttcttctcctgccttttatttcctgctttaaaacaagttaatcaaacagcacatgcttgcatgtacacacaacatgcctaatgaggactgagcatttcgaaaggggtgtggcattgagcagggcttagcgttgtagacacaaaaaaacagtttaactttaatcaaggtcatagttgccatatttaatctttatgtgtttaaatgtttacaggatgttcatgtgaattttatgaatccttctgtctttgtgattcaaccatctgccaaagaaaaaattaattttcccactgagacagaggcacagagagagacttagtaaccctatttagttgattgaaatgctataggagcaacaggacctgtaccccaaattctggggtatttattctataaaggaactttcagtctattcaacatggctagtatttattatcctctcttgcctactgtagatccttgctggtgtcaccagtttggtctgtagacaaaagtgcagaaaatgagttctttgctgcacacaattatcctgccaagataatgaatctttcctaaaactcttggattgctccagagcagagctgcttgaggaggaaagaaaagaagggaagcctgtctgggaggaaggacaacactagtcaggcgtcaggagttctgtggagccctctgtttataggatgccagtcctggcatgtggctgtggtctaggttaggggaagagaaaaatccctgaattgctctcccttcttggttcagagccctccttcccaggatttagcccgtaaccaagacaagtcacagatagacgatgacaagtcaagacaactcatagatagacggtgagaggggcacagtggtgtattttaccccgtgactttctcaccccttctctttccttcaactttgtctcaaattgcagaactgggtactcctggggaaaagcctcctgagtgagccatcggggagctgtgcccagctaaatgggcatttctgaatggtttcctccagcagggaatgaggcccctcattctgcttctttctactgtgggcacccagtgtctcctgaaatgtgaacagcaacagagcagctgctcaccctcgtaggcaggaccccacctcacctccatcagcctgggaggttctagtggatagtcactcaccaagaagagcaccagacgcaacgctctggccacctggagccctctctgaccaggactgcttttcctctcccgggccctaccaggcctattagtggaacacacccggcctcttcttggggttggttttgcactgagaatttccggtggaacacagatgaggttggagcctttaggttagtgaagcctttggatatttttggcagtatggttctatcagcattgtagaaagaagacctagcttaaaaattgcctgaaatctgaggagatgaggtaagaaacaagttacccagcgatactgctggcttagtaaccaggtacctaataaattcttccatggcgaccatatgaccttattctttaggtttagacacaagggatttccttggtttggtgacagaaaggtaagagttatattaccatcaaggtcaccatttgacttttaagaaaaacccattcccgccgagcatggtcactcatgcctgtaatcccagaacttttgggaggctgaggcaggaggattgcttgagctcaggagctcaaaaccagcctgggcaatatagcaagacctcatctctactaaaattccaaaaacctagctggggttggtagcgtgtatttgtagtctcagctacttgggagggtgaggtgagaggatcacttgggcccacaaggtcgaggctgcagtgagccctgattgtgccactatagcctgggcgacagagtgagacaccatttcaaaaaaaaaaaaaaaaaaaaaaggcctttccataaaataattctatgcatgaaaataatgcagttgactgtggaatagctctcttaagaaaaaaatttggtttacagtttaaaatccctttataatgaacatatggagaccattttacaattcctcctagggtcttgggtttagtcgcagggaggacatgatgtaaagtgcatttccgatgtgcacaagagcaaactgcccgtttcagtctctgtaaattagtttggtttttgtcatgccttaaattccacataagggagagttagaacatcactcatttatttttctccctctggaccttctttgtactatttcagagcattttcttgagtttttaggagatagagatgtctggagagttaagtagtatttaagggtaattggtacttgatgcaagagacaaaggagttatgagtagttcagtccctcctcctactccatactgcaaatagcatgcaatcagctccttttgttatggaaattgaccttcctatagaagccgactcttggagaatttgttgtatagaatcatcctttgagcgttcttggaaacagatgccttgtactgttagtgtgaaaccaccagtaacagtcaaaaaatattccatgttgcatgaaagtgtctcccgaaaattttccaatagttgctttggccgaactgatcttttgccgaacttgtgaatgcgtgtggtggtgaatcctgggatactggatcccatcactggaattgtgaaccgggtggaagattccaggcattcgaagtgatcttgatgatgccttttgggtagaacttttgacagctgccacttttccatcctgagtgcccctgtgatggaggaggcgtagattacagtgtaacccattccattcttttagtcagatgttcaaacatcactctggttacttttgagctcagtggaaagcccttgacttatactgggcgattactgctgtcctttgaaagagttttctctatccttggcaatattgaccaaaaagcttgaatgttcatcagcctctcttcaatccattcatatttagcgttttgtgtagttaatgatgtagttagtatttggttgtctcagaaagtaatatgcattcatgatagacaattggaattgaaaaatatcagatcagttctctagagtctaatgagaacagttgagtgacaaagggctcaatcacgcgggccaaccccagacaggagggttcctaaatggaggaagcccgtggctagcccgtggcctctggattatttctagtttctgacaactgcagaaaaatgttgttttctctgaatatgtatgtttatttaactaggtttctttttgcttcacaatctggattccattcagtcagttaccactccaattaactaacaattatttaacattaacagtaattacagacgccagttaagcgcctacagatgtcaactgttagctttgtacctaatcactcaatgaaatggagaaagttcaacaaacatcaattagctaagcaattagtatgagttaggaaagagcatgttatcatgtgtgagctgattcaatttattttattttggcagtaaaatacacacaggcaagcagcaataagttcctcagataagataaaactctattgttttgcggcttatataagaattccttcctttcctgtgcataagtcaaatacactctcgtctggaatttatttaacagaatttgtctcaattactcagaaagcgcagtctcaggaagcacctttggtgaattatgaatccagtgactgtactgtataaggaaatgccagaaaacttcagtggagaaaatgattgattcccactcgagtaatccgctccgtgcatttcggatttttaccagtttattcctgaacctctggtggaacgagtgcaacagtgattttattaatttcatagtgcctgaacttttactcagctgtcttttatttagcccggagctaacatcaaagtattttacctacttgcccagtctgtgcttttaaaaagtagaaacagctgtctattgaagagccatttcatgaattcaccaaggagattccagactctcctgaactcagaggtgctgttccactctcttttttcccccttcgcctcctccaccccacagacttgactcttgtcattagctgagcttgcctggacttactgggagagtgcactctgaggcctgattgtatgaagtggcccagaaagtggagattcattttacctccaagaggaaagctgggcataggagctgggcctctgggtctcctcctacaaatgacttctcatcaacccttaaagcccttggataggagtggaagaagtcaatccctcgtggggtgctctgataggtctgtgtgcatcctatgtgcagaattttccatccgaacaagcctctcagcatgaactgaatgtgggagtagggaaaaagtattctgccactggtatggcttggggtgaagggccaccttgtcccatgtgcagtttctattataaagcatttcctcgtatacaccacgaccccagtacatgctggatcttgacagatgtctgctcttctgcatcaagtcactgggtctctgtgagtctgctttgtcaaattttgctgcagtaacaaaatagctcagagtcctacaacaacaaaagtcttatgttaggtgtcatctgccaatcagccgcaggtttctttgtttttattctgggatccaggccaaaggaggagtccccatcgtggttattcggctggtaaaggggaaaagagcagagacagaaacagagaatgcctccacttggaggtgggtgtggcgtttccaaaaatctcattggccagacaaagtcacatgaccaagcctgccatcaatggagtaggaagtaaactcctacagggaggagcagaagagaagagggatccacagggatccacagggccttggaaggaagggaaagcaaaccctgcatgggtaatgctatctgccacaggcccatcccagaaacctaacaaatcaggagctgttgcctcttactgtgttaatgcaaatgggatggagggtggcttgcatagctttgatgatctccgtaggcttttctgttagagacctggttccctaatagccatttggttggagtttatattaagttagatctgataagttgtcaagaaattaaatgcttttttattgtttatctggattaacttattgctggcttggaaggacttatggaaaagttgccccagagtgcagaaatgacttcagtgatttgcaaagaataattgttggactggccagatgtttagactctgcataattaacctgaggaagcatgattgctgtaaaactttactgcaaagtagtatgcgttgtcatggttaccttgaacatgggctttggatttaagattctcacagacactgctttgaatctcagtgctttgaagacgcttactagctgtggaactttgggctagttaaaacaccttagaaccaatttttccttctgtaaaatgggaataaccaaacccatctcttacaggtgctgtgaggatgaaacgaggcaatggatagaaagtgcttagcctaccttgtaccatattttgatctaatgatacagtgggctaagtattttacatacattctatcccctaatcttcacagcagctcttaatttagaaaagaatttagaaatagcatctgcattttataggcagggaaactgaagttagatatgaatagctagcatttattgaggactttctttttgctaggtattgttcactttatatgtaattcactcattttttaagtgagtaaactgaggctcagaaatgaggcaacttgtccaaggtcgcgcacctagtaagtggtggagctcggtccagctgactcctagacatgctcatagcagtcatactgtgctaggctctggggatatggcagagaatagaaaggaggaggatctctgtccttcctgagggagacacaaagcgggatggtaaaaattcggattgggggaaactgggttctatgggaagacactggcaggaaccctcaacaagggcttccctagggcttttcctcccataccttcccaaagtatttaatcttctcataaaacataaggtcccggaggttctcatccaggacttctccaggatgtcaaccattatcccatcacctgtggccagagtcgccatagttactgcagcgcagtggggctcagcttaaggcacctccagtttcctcgctcttccatgcccattcttgtgcctttgcgtgaactgatctttacttttcagccagattttattagaaatgatttaggaatttcaagcaggggcatttccctagcaaccgatgacataagcacaaggcccaaatctgtgctgttaacagggaatggcgttctgtgggctccgatctgcgtctctgaccctcgtaaaccttgtcttctaaaggaggaggctgagagcacatcattgcttttctaagagtccttttgaagagggaaatgtctcaagtgtgcccgttaatagactgatgtgggaggcagttatatttggatgcctttaaaagccacttggaaaacattttccccctcttatctatcacctttcacatctctcagcagagtaacactaaaacctaattttagccaagattacatcattttctcattctctgttcatagctgggaaaggtttttccatagtaaagctcctctccccgaaaacccagctcctccgcaggacctcttgggcttctgtgaaggcttctttatccataaagtttagtttgacaaggggtcttctgaaagcagattggtcagctgttaaagaaatgacatcagtggtgattccattgattcgttcaattggcttaaggtggaaaccatattgaaatgaattcttttcattcacatattattgagccccaaccatggaacaggatctggaggtaacaacactgaataatagatgacacccacctgaccagaagagtaaaagagtttaaatgtattttgaaatgtttttcaagtggtataatagcaaactcactaattaaaaaaaaaaaaatagccttaagactttcttaggtggaaaagcttatctgaggtgagccccgaagggtcagcagaccaaaaattgaccagccctcaaactgcagaattatgtctcgcatttagagagccccagaatctgccagcttgtgctcatcgttagactaaaacctacccctttgagttttccattttaaaaattgatgctattgttatatgagttaattaagctattgcaaaggtttttggcagtgccataaagatctgtacatcacctatcaatacagtccacttttttcacgtttcttcagttagattttattgtttaaatacttttttttttttttttttgagaccaagtctcacctcattgcccaggctggagtgcagtggcaccatctcggctcactgcaacctctgcctcccaggttcaagcgattctcctgcctcagcctcccgagtagctgggattacaggtgcccgccaccacgcctcgctaattttttgtatttgtagtagaaatggggtttcaccatgttggccaggctggtcttgaactcctgacctcgtgatccgctcacctcggcctcccaaagcactgggattacaggcgtgagccaccgtacccggccttgttgtttaaattcttaccaggttggcccaccgcaaggaggtggcaggagggaagccccatgcccaagcctgagcaagactatttgtaaagttgagcagatcactccatttgacttgcttttctcatgggtatcatgagaaactggggggtggcctccaagactccttgtgaatctaaagaccaaagtttgtgttagaaatattctagggccagccagcacagtggctcacgcctataatcccagcactctgggaggccgaggcgggcggatcacttgaggtcaggagttggagaccagcctggccaacatggcgaaaccccatctctactaaaaatacaaaaatgaggtgggcatggtggcacacgcctgtaatcccaggtgctcgggagactgaggcacgagaatggcttgagcccaggaggtggaggttgcagtgagcggagataggcgctaccacactccagcctaggcaacagagcaagattctgtctggaaaaatatttacatatatcttttagggcctctcagaacctgacgcttctgctgagggcacacattttccctgctagctgtgaaagagattctgaacacttagcattcaaaagcagtagtgcctcgtagccgataccaggacttcagtcctgaacttgtgaacaggaataagcctctctcctcttcaggagattgcatctgtgtaagaaagatcttaaaggtaagaggggattgagccccggcacaagggaggagtggaaaagacagtggctacaatttgaataccagctgttaaggtattacggtattaacctccagaataagagtaacaatacagagtcctccttctctgcttgcctgcatcttgggtgctgttaaaagagatgatttatctgctcagtaaatgtttataaaaccccactgtatatataagtacttagggttcctttgtacttgacttctcaagtggaatgactgtcatttggaccacttcctaggcagggattgctgcaggttagatgagggtggggggcaggggcgagataccagagaaagtgcccaagagcaccccaggggcaactgccaggcagcttctttttctatgagatgactcattttaccaccacgaattgaaatgaggcttgcatgggccattgtagataatcgaaagaatgtcaccaccctcccatctgtcttcagctgtcacagactcacacaccaagcatttcatcagagttctagttcttcaagttcatctaggtctttttgactggagcaatctgacttcctacttttcttttgctagaaggtgataataattgcagcttcattcactcagtgctgcatttgctgtttgttggtttgtaattcgatgcgcagtcttcttgtgtctttgcgggagagttggttttagaggtggcacacaccaaaatcatgaatggatttaaggagggagaggctgaactaatttgattgttaccaagtccataatgtgttccttgggaaaattccacttgtctggactgtgctcctcactttctgagattgagaactggagaaaggaggaacgtcacagacaagacagcaagaagcttaaaaaacaaattcctggatttggagcagtgtgctctggtggaatattagatgataaactacactttgtggttttgttttgtgcagttggctgtagaggccacatggccctgtataatgacctcttcccaagatgttagacatcaaatcagtttgatttctacccccatgggaagaggaactccggttgtaaagaggcagcttgagaataactggtaaagggtgacttgccatttccccgctggtcttgcctcccaggagtaactgttatttgaccacatgacccagttacaacctgttacccctgtgtggccagggcctcacccccccagagcacaccttcgggtcaggctcatgcctgatttgtgccttctttccttctcagggccctccaggttgagggaagacagctttacacctccaccttctgtattagctccaggataaacttgaaaactgcctactctgagggtttttttggcattttaaaagttaagtctgactttccgagccctctcagcatcctgccaggtatcttatcttattcaaatatcctaattgcttctggggctgcacatcatcctagcacctaactgacaaaatagaccttcacctgagggcctcattatgctttctgcctgtgcatcaggccaaaaatacctccacaatacctgctcgacatcctgggcttccaagtgacaaacaaataattgggtgaaacaaaccctgggcgccgagcagctgccatcagtgtcggagcacagaagagtccacggcagtaacagtcacagcgctgcctggttcatgtcagagcaaatctttgaacagtgggttgtgctgacaccagagaatgacagctttggaaatggcatgctagttactgctgcaagtgaggcctctcatgtagaccatgacaagcggctgtcatttccatacaggtgaacaactgacatcctagaagggggagggcgggagccacgcaggaggctgtgtttggcagtaggtggggccagacttcggagaggggtcccaagtaccggtgaccctggcgaaaactagcctaaaaacacagtctctttccatgcccctttactcactccccacacatcttctctgttacctctttggagttcatctgagagagggctacagaaatacaacccaacatgcttaaaggatgtttgcattttcactctgttccctccacatcttttcttctttttctttccttttttttttgagacagggtctcactctgtcgcccaggctggagtgcagtggtgcaatctcggctcgctgcaacctccactttctggctcaagttatcctccagcctcagcctcccaagtaggctaggacttacaggcacaagccaccatgcctggctcacttttttttttttttttttttttttttttttttttgcagagacagggtttcaccacattgcccaggctgggctcgaactcctgagctcaaaatgaaccgcccacctcagcctcccaaagtgctaggattacaggcatgagccaccacgcccagtgtcctccacatcttgatatgtcagggattagctttccggtcgcaatgcttagttttatagaggatggaaaaggcaaggtttctgctgataaggaactcaccatgaaaaggaatgggttagatgaaattaagtgcagaattgggtctagaccggtggttctcaaagtctccatcagcaatatctgcatcctctgagtggttgttagccatgcagaatctctgccccaccccaaacctacagaattggaaactctggggtagagtcacaactctgttttcacaagccttccaggtagttctaatgcagacgactgtggtccagaaaaaacgaggaagaacattttggcagtgaggttttgtaaatgctcagacgatccacagagtcactgggtgaaatcatactctattgcacagggaataggtctaggttcgtagttgggcagccttttttttggaggggacagagtctcaatctgtcggccaggctggagtgcagtgtcacgatctcagctcactgcagcctccatatcctgggctcaggcagttctcctgcttcagcctcctgggttggtttgtttgtttgtaaatatcaacttcacctgatctgttcaaagtgcccctgcacctaccatttccaatccttccactctctatagccttgtgaacaggcctactcatgtttagcgtggttctgacagatgctaggcctgtacctagggctctgctcatctgaatagagtttgaaaccatgaccttgggccaatgttatgctgtaaccagctgagctaacttgctcaaccgcttctgaaagacaaactgttccatcgagttccttcttggcaggtgctgcatcaccaatgccggcctgccatctgtgtgaagggctatcacagcacacaacacacacacatactgggcaaatgtgccgtgattaccactaactattttgtaaacaaagtactgtgttaattctgttttaaactgctttatccaggattgtagaacaatgggcagaagtgttttgaaatctttttttcttctgtattgaatattagagttttaaggccataaaattaacatgtaaattgagttttcccaaaaaatgtaaaactcttaagaagtttaagtaagttacctaaatagtaaagctttttcagttgtccttcaagaataggcatcttccaaaactagttgtgttaaagtagtggttctcaaactttagcctgcatcaaaattagctagaggacttgttaagatacagcttgccggccgggcgtggtggctcacgcctgtaatcccagcactttgggaggccgaggcaggcggatcacgaggtcaggagattgagaccatcctggctaacatggtgaaaccccgtttctactaaaaatacaaagaaattagccgggcgtggtggcgggagccttgtagtcccagctactcaggaggctgaggcaggagaatggcatgaacccgggaggcagagcttgcagtgagcggagatcgcgccattgcactccagcctgggcgacagaacaagactccgtctcaaaaaaaaaaaaaagatacagcttgcggggccccacctccagtgatttctgattcagcgtgtctgggctagggctccagaacttgcatttcaagtaaccaggtgatactgatgtttccagtcccctaagagcactgtgtgatctacatgggttaaatttaaatgcctttttcaatagggaatattttcaacagggaatatcacaccactcaaaggtgtgaaatgtatctttacatgtaagatgaaattgacacatgaaagtgaattcaattttatcatgaatcgggagctttttacaaaatgaaaattttcaactctaattcaatatagaaaatgtagaaatgaacccccatatatacccattacctagattcatattaagacttttccacaattatttttaggtgataggctggatagggcgatgtccaccttttttttctttattgctgaaatattttaaagcatgtctcagacttcatatcattttacgactacatactttagtgcacatctataaaaaagaacatttcttacaaaatcacatgttgttatcacactaactaaatatgcagtaattcctcagtgtcatctgaggaatatacccatccatgatctcatctccatgattgtcccacaaggggtcattttacgtgatctgtgcacatcaggatacaaacagacacacatactgcatgtcttaaatctagagtgctccaccctccccagcttcccattctttcaagtcattgacttgttgcagaaaccaggtcagctgtcctgaagactgccccacattctggaagtccttgcggtgtcatttagcttgttcctctgtccctcgtatttcctgtaaatggaagttggccgtaaagctttgattagattcaggttagagttcctggcaagaaaacttcataggcattgcaacgaacctcatgttgcctcacatctgggaacacacagtgtctgggtgtcccagttttagtgatgtcaaaattattcagtaagtttaggttgtggcaacctgatacttgcattggcatgttccccgtcaagcttttatctcatggtctcatctattgatgatgcttgcctgatgcagtaattcattagagatggcagagggtgacttttctagcattattccacatttattggctgaaattcttcagtacaatggcactttccctcatcaactagagttctttggttacactcaaatataatacaaggaaaaaagtaaatgctcaattctctccttctaattgcatgttttcagagcaaaaagttggtgctctaccaggagtttattaataagtctgaacagttctctgcatttttcttacaataaatctaacctatgctttcagtgcattgagcttttcttacatggtttgtgtttatcaattggagggacaaaatatctaaaaattagaaaggtactgcaagaacaacatcgtcaaatgaggtcatacacacttaagtgtgtgtgaatttagtcatacctgcccttcatagctctgttcaaatgccacattctccaggaagccctcctaccttcccaaggtttgaacctttcctgtggcacttcctgcatcctgcctgtctttttttcttttcttttcttttcttttcttttcttttctttttttttaagatggtgtctcactctgtcacccagcctgtagcagtggcatgatctcagctcactgcaaccttcgcctcctggactctagtgattctcctgccttggcctcccaagtagctgggattacaggcgcatgccaccacacccagctaatttttgtatttttagtagagatgaggtttcaccatgttagccaggctggtctccaacccctgacctcaagccatccacctgccctgtcctcccaaagtgctgggatttacaggcatgagccaccatgcccactgcctgcctgtcttttattgaagttgtagatgtcctcttccccttttctctgaattctacccctatcctacccatggtgacccacagggtgctttgaattaaaatgaattaaaatataatatcctaaaagtgatttcaaactttggaatttaggttatatcctgagaatcttaagtgacttgattcaagaaagtaggcaaaaacctgaatcgtgtttggtctgatcaacccatttggaattaatcgaaaatctgatgatcccaactgggtacttttcaggaaaggagtgggaggctgcccacgtatattgagtgcctacagtgtgccagggcacctgctgatttatttgattcatacagtagcctagccaggtccgtctattacctgtgagaacactggtgactggtaagtgacagtgagttcttgccatctcctgttctttgccctttctcttataccagcccagcataaagaggatcgggggcttcagtttggtgaatttaaaaatgtctcttgttaaaggccgggcacagtggctcatgcctgtaatcccagcactttgggaggctgaggcgggtggatcacgaggtcaggagattgagaccatcctggctaacacagtgaaaccccatctctactaaatatacaaaaaattagccggatgtggtggcaggcgcctgtagtcccagctactcgggaagctgaggcaggagaatggcgtgaacccggccgggaggcagagcttgcagtgagcctagatggcgccactgcactccaacctgggtgacagagcgagactccgtctcaaaaaaaaaaaaaaaaaaaaaaaaaaaaagggaagtctcttgttcacaacacagcttctcatccagcctgacctgtttgaagtatgtctggggtggaagatcctggtgatgcaattccagcctgggaaaacttgaggagaggttcagtatagcaccatgggcggcaggctgtcagtgtgtgttagatgtattcggttacttcgttttatgggagatttcatgtgatactaagacgtaacctcccacaaaatgagatttatagaattgggtatatgtctaatcaataaacatcaaactggaaaaactgtaaaggcatttcaagtgatagtagttatggctggaaatctcagtggagttattttttttttttttttttttattactgtttaagccttgacacttttatttatttagacactgggtctcactctgtcacccagactgtggtgcagtggcacggtcatagcttactgcagccttgaactcctgggctcaagtgatcctcctgccccagccttgcgagtagctaagactatataggtgcatatatacgtgcgtgccaccacacctggctaattttttaattttctatggagacaccgtcttgctatgttgcccaggctagtctggaactcctggcctcaagtgatcctcctatcccagcctccgaagtagctggaactacaggcctgtaccaccatacccggctaactttttaaatatttttgtagagatggggtcttgctgtgttgcacaggctggtctggaactcctggcctcaggcgattaatcctctcacccctgcctcccaaagcatcgagctcctggtgcactttctaactcacccttcgaggatgtgtgtatttatatgtgtcagggagaggaaattgatctcctgaggggtgggtggaagagcacttgtccctagttaatccttttttgcctgttctttaaaaagcgtgatagataggccaacccactatgagttttctggtggcaaaagtacaagaaatccctgctatttatccactatctgtgtagcttcctctttgaagcacctcaagccctcgccagcctcttcttgtccgttgctgatctttggctctgggtgccagtcagcctcaggggcggtgctgccttttttggcagagtatcactgttaagccactttttctctttaaaaaatgctacacagaggtttttgaacctgaaatgcaattattttaaaggcatcctcaccactcacttcccgagtgctctgttacacccagcgccacctgccaaccacagtgaacatccagccatgtcatttcttccattcctgccctggagtaaagtagatttactgagctgatgacttgtgtgcatttgtacattgcaaccttagcttacctcttgaagcatgtagagcattcatcacccaccattcattcactgcctactcccaccacagctgtttcgtggtctgtctgctccctgtgccacccccaccccatcaggtgggccttttgcaagtgatgaagtcacctgtgggggaagagctttcctttcctctcctcaactcagaaggcctcttcctcttgctcaagagggtgctgctgctttctgcctccttccccggccggcctccatcccagttcaccttttcagacatggcccctcagtcaactcttcccttttctcctggctttttatttctcccagtctcttaagagtatccttagctttaaaaacaataacacagaggatgggtgcagtggctcatgcctgtaatcccagcactttggagcctggggcgggcggatcacttgaggtcaggagttggagactagcctggccaacatggcaaaacaccgtctctacaaaaatacaaaatattagccaggtgtggtggcgcacacctttgatcccagctacttaggtggctgaggcacaagaatcacttgaacctgggaagccgtggttgcagtcaactgagattgcaccactgcactccagcctgggcgacagggtaagactccgtctcaaaaacaaacaaacaaacaaacaaaaaaacccaataacacagaaatgcaaacaacagatctagccctgctgcttcttcatatacttcaaacaaagaaaccttttttgatatctttttttcattccccctttgtataaaataccttgcattggtatatctttttggtgataattaaggtgactatataacttactgtccaggcctggacacttttgagagtgaaatcgactgtttcttcatcattatcctgggacaacaggcctcaccctggactgtccatgtaaaccagggcatataatcacccaagtgatcatccaaggtttttcagtttgtcagagtggttcaatccactcgtgatgatactgccatttattgagtacttactatgagatgagctttgttctgatcacttcaattaacccatggaaccctcacagtgcccttttgaggtagatggtattaacactgttttgactgtgaggaaactaaggctgaacaagttgctcaaggttacacacctagttacgtcctccacactcaccccatgctacatcagcccccaaggtcaacatccatatctcccctgagctgttagcagagatttctaaatgtctgctcaattaaaaggagtgtacactgtaaacaagagtatcgccttccaaagtaagcgtttagggttgcctggttgtcaagggctcaataacaggagtgaagtacttaattcttctctcaaatagtatgtggagccggctcggaacaagcagggcttcccctatcactaatattctctaaaacacactccccaccccacccacccccgaaatggagtctcactctgtcgctcaggctggagtgcagtggctctgtctccactcactgcaacctctgctgccctgattcaaacgattctcctgcctcagcctcccgagtaggtgggattacaggctcctgccaccatgcccagctaatttatgtatttttagtagagaccgggtttcaccatattggccaagctggtcgtgaactcctgaccttgtgatccacccgcctcagcctcccaaagtgctgcgattacaggcgtgaaccaccgcacccggccaagacacacatttttaaaacaaagaaatggaaaagtctagactctaagctggttacaccccacacagtgaaattctggttatttgtttctgctgatttttctcatctcacaggtttctcattcccgaaggtaatttaggatgatgttacttaagaactggagttaacttagtgaccagatattaagccatgaatttcttggtcttcctaggaatgggaattttacacaagtacaagcatctcttttgagaacttaggcctctcacagatctctagcctgacgtctcattcgtatctcttttctttcccttgctgttgctgttcttcttcccctactttaaaaagcctttcctgccaaaatctgaatcgttactccacggagtttattatttaggcagatccgaagatcaacacgaagtctttttgttgttgttttcttgtatttttttttttaatgccaccagggtgacaggaagatttactgaaagctgaacttattttgtttgctctaatattcacaagcctcaagagtttaaggaagtggtaagtacacccgctgcctcggggaatactgttagggtatgagcataaagttatccacactcgtctccaaatcgcaggcgtcaatctgtagggattatgcagcgggggaagaaggtggctattacccagaagagagctgcttgagagcttttcagcattcttccccacgggcacagagcatcttctcttcatgttcctacaaagtgttatggagaggaaagtagttggtagggatctttttattgtacatatgttttaacacacacacacacccctttctttcagctctggttccctctaaaaaggtcctgttctcatcctggccaccagacttcttccaccaggggtcccttctctctttctttgtcaccaggccaagtttgttaaccatcttcagaattacaggactttagtagctgaggaattccttttaaagtggttccaaactcagcacctttaggcaacacagcacattgttctgctttgttaagagaagcttgttttgaagagctaggaaaatgagttcaagctcagatttctctgggtagaaagggtatcccatatcagatgatgatgtgaagaagcagattgtgaactgtaaagtgaaaaggtcttaaacacgagagataagcaaaggggtgtgtatttcaggtaacatacaaacacaagggaaacagacctctggcatctcatcgcatctataaatctggatgatttcaggcaaaaatgaaaacatttgcttttcttcaatcttgggaatttctaaaacattgagttttttaataataataataataatagcaccatttgctgagccccaaatatatgtcttctgctctactgggctcctgatatacgttctctctagtgggcccaggacctgcaaggctggtattgttactgctgtatagaggttcaaggagatgacatgccagaggccacacgactgacgtgtgtgacagccagaatttcattcgtgtgtgtgtgtgtgtgtgtgtgtgtgtgtgtgtttccgatggagtctcactcttgttgcccaggctggagtgcaatggcatgatctcagctcactgcaacctttgcctcctgggttcaagctgttctcctgcctcagcctcccgagtagctgggattacaggcacctgccacaatgcccggctgattttttgtacttttagtagagaccggttttcaccatgttggccaggctggtctcaaactcctgacctcaggtgatccacccaccttcttttgtcaatttatccagtgatcaggtatttgagtgcctacctgacattgtctgagagacagtggacactgagatgttgtacatagctttgcttgtagcagttcatgacctgctactgggctagtcagatattgaccctgagtctattggaccgtagctcactttctttttatgttgcaaaattgcaaacctgtagaaatgttgaaagaacagtatgacaaacacccatatacccttcacctagatccactgttcttaacatttttctacatttgctttagctctcttttttttagataagtcatttcaatgttaaaagtatcatgatgcttcagtattcatctgctgcactttctgcataatctcataccattatcatacctccgaaagttagctgtgattctgtaatgttatctaggatataattcatattgaactttccttgcttgtttccaaagtgtgcttttttacaaaatagtgagcttttttttttctttcatttttgaatccaggattcaatgaagaccacacctttttggttgatacgtctctttgacctcttgaaattaaatatagcccccagtcccggccccaaccccttttaaaatctttaaatgacatcagcagtttaaagagcccaggctggttgtcttttaggaagtcctactttgtgaatttcctcatggtggggtttgttacccaattattttttaattaaaaaaaaattccattttcagtctgtgttcacactgctttatgagtccagtttgcttagattttttgtgggggtacttagatgtagctgctttgggaagagggacacgtggaaaatatagagggagatggggaatatttagttcagcattttatatgctataaataattatagctgtatagccaaatgagcttttagagctctggattccattggaatttaaggatttttctcttcccctcttttcttgtagagattagtttgttgccaacaaccctggaactggcgaactgcttaaggcataatgttttcattaagaaaggatttaactaattagatttgactagcaagctgacaggttaatcaataagggaagtggggctcagcaccccttaagttgggagtctccattaagtcattatggtgtctgctaaaacattcttcttcacaatgattcttaagaatttttacgtgaatccctctaataaatgttagaaaatcctgtccctttcaaattccgtaaagatctgtattgtgttcatgtatttcagattcaaactgttgagtattttagggagcctcgcagtgtcagacaggcccttaaatattgtcttatttttacttttgaagacccagtgggcctgttcatcctttgtcatgttacttcagcttttacaaactaacttcactgcagtttattatttaaatttaatttgttcccagataaacctgaatgttgattaaaaccagtaatttggttaagtgtcagaattagaagaaggatgtggaaagtgacgagtcggggataggagtagagaacgtgagcttcttgagtcacctgcaatgggtggtgttttataatgctctcttccctaatcatgttaatcaggagattttccttttggaactcctgactgaaagcttcttagtttacacacatgttcctccaggatgaacgctgaaaataactttttcggttttgtttgtttgtttgttttcctctatacaaccccttgcaattgctttggtttagaacacctttggattctaagtttcatggttgttctgggagacaccacattcaccctctcaacccaagaccttgaagatgggaggtttttcggacctcatcatagacctccaagggcacttggaagctcagagaggccaaactgccccaggaccagtgggctggcaaatggcacacctggatttggcagaaagcccctagagcctgcactcttagccactctgttaaaggagctcttctttttgagtcagacagacagcaggaagcgcccgctgtacagattgtcaagtgcatagtgcttggaggcatttgaaggaagtaaaaggctctatttttttccccagagaaactgttttaatttacctttctgagttgtagagaaaaatactcgcgtagctctgctcttatttatgtattttcaataaaacaaacttgtgtatttgggttttagtttaacaggtcattggcccacatgtaaagctgatttgttaggagtcattacctagaaaataaaattctgaaataaagatcaagtattcctgaaactaacgttttgtttatagacctttgcaagtatacatgtagactttttgagaatttgagaagggtttttgagacagagtctgggtctgtcacccaggctggagtgcagtggtgcgatcaccactcactgcaagctccacctcccggttcaagcagttctcctgcctcagcctcccgagtagctgggattatgggcacctgccaccacacctggctaatttttgtgtttttagtagagatggggttttaccatgttggcaaggctggtctcaaactcctagcctcaggtgatccgcctgcctcggcctctcaaagtgttgggattacaggcgtgagccaccccatttggctgaggacttcttttataaatgaagatgtggctgtgattttgcaggcacatatatacctttaggtgttttcagttactttcatatgtgcttatcagcaatttgattccatatttgatttataaccctgcaggtgtacaaaactaatattataactagattctctgttttatagtaagcttatcaaaaatcaaggcatagtgagaattaaaacatcagtttatttttggaagaatgattttattttcatcctgacttttttttttttttttttttgagacagagtctcgctttgtcgcccaggctggagtgcattggcgtgatcttggctcactgcaagctccacctcctcggttcacaccattctcctgcctcagcctcccgagtagctgtgactacaggcgtctaccaccacgcccggctaatttttttattttttagtacagacagggttttaccgtgttagtcaggatggtctcgatctcctgacctcgtggtccgcttgcctcggcctcccaaagtgctgggattacaggcgtgagccaccgcgcccggcctcatcctgacattctttatgtgtaaggtgctaaggtggtagcatactgctaaaactagattagtagtacttaatctagagggatcttttcaataattccatacattaaacaatttactgtctccattacaaggtgtaccattgacttaatactggttttttggggagggagtgagtttgagaaacactaggacgttaaaaactgctatgttgattgtaggatatctggatttcagaaacgttagcacatgcttgtgcaggggtgggagagggagaacctgtgtcttagaaatgaagaactatggtacatttatgtaggatatgatatcacattttataatttgtctgcttaaacaatgatttacagatcttttgagaaagagagcaaggaggttgggccttttagtaagacagaaaaatgaccttccgtttaagacttagacaaattaaattggactttgaaagtggtttacccttttcctctcgggtaaatgtcggaagtgagtgccctggctgaacataagggaaggtccattgtcagcaccctgaaagcctgtttgaaatgtcatcaacttggagcattcattggcagcgactatcaacagcccattttaaaaggatgccttgggtagaatggaaattacagtggccagccgttaatcctttttaataagggcaactgttgaggagaattatgttgtaagaatgaatgaaatttgggagcaactctagtccccatgttctgtcgtgactgtcaacaccaaatgtactttcatttttgcaactgcctaaggattttccatttaacaaacttacatgacaaatgggaaagcagtggcattccctgagagtccaaaatctggtttggctctgccgttagcacatttgcctgcagggattgatgtatctgattgaagaatgttgagttcagccaagagttaaggttaaggtccttctatttgttttgggtcagttcctacaggtagagaatttgaaagccctgaagtggtttcattgcccctagtagagataaatggccaaatgtaataaaaatagacagtgctgtccttaattgtcctcccctttatataaaggacctgggaggtggatcacctgaggtcaggagtttgagaccagcgtgggtggtgggcgcctgtagtcccagctactcgggaggctgaggcaggggaattgcttgaacctgggacattgaggttgcagtgagcagagatcgtgccactgcactccagcctgggggacagagtgagactccatttcaaaaaaaaaaaaaaaggacctgggagaagggaaggctagagggctagagccagtttgtattttattaggggtcaggatttactatgttaagttttaggatgtgaatctggaattttcttttttttcatgttttaagaagagaatagaaagatgatagaagatatttgacacctgaaatgctacctctcaacacattagaagtttttatatagagacaatggatgtgtttattagaaatctttatttactcataaaggaaatctcccaaggaatattttgctgtcataccatacatatatttgaatgagaaatggcatttcttaaaaaaaaaaaattacctcattgactcatttccaccacatatttgaactaatgaattgctgtatggaaatatactaaacaacttacagacatcctattgtcgtatatgtgatataaatgtcaacatttcctatcaaaatggcatctgatgttggccctcttaaagttctgtggcttaaaatactaacagtaggaggaaaataaacagagaccaaaatgcaaactcaacaatgagtaaaaataccacagtacaagtggaaccttctataattctgtatcccagaatttttgagaagagaagataacatcttaagcattaagaaatcccaagaccctgtccagcttattgctgttggagagccccaagaccctttaatgctccagtttagaggatcatattgtcaagtcagagaggcttaaacacaatagcatcttctggaaccctagtgacctgtattgagagtggatctggcgcttttgttcttttgagaggcaggtgtaaaggataacacacgggattatcttattttaaagcatctaaaagccaatcccatcccccttcctcattctctttcctctcagcttttagagtctttgatcaggtaaattctaaaggcagacgctagtgaagagtaggtaggtaggcttgtgttttcacttctccgtgccagctttctgtcctcaccctcctcgtcagttagcactgatgaatgtgtagaattagtgaaggctgggtattaacatcggtaatgtaactttcagaacctctgcagtgtctaaggggaggaaggttatttccaccccacctcgtgggaattcaaaggtagctttccgattgtgatcaggttaaacaattccctccaggccagcgtgtgggaacctgcacattcctaccaaagcaacggtaattgtacacaagtgtgttttcagatttctgtcatagcaagcaaaagggaccacagccgtgtttgttagagccccaaatgcctgtttgccacagggctgggttttttttgtttgttttgagatggagtttcgctcttgttgcccaggctggagtgcaatggtgcagtcttggttcactgcaacctctacctcctgggttcaagtgattctcctgccacagcctctcaagtagctgggattacaggcatgcatcaccacacccggctaatttttgtacttagtagagatggggtttcaacatgttggccaggctggtctcgaactcctgatctcaggcgatctgcctgcctcagcctcccaaagtgctgggattacaggcatgaaccactgtgccaggccaggctgtttttaaaacttacgtttcagaggttaaaaatttgtcttaagataaaaagactttcttaatcatctaatgtatcccaggatctatgtcttggttttataagacaggctggcagtaaatttcagacctgacctaacaagttaaaatcctactcctgggcagaagtcttctgtgttagtgacaatgtggaaatgaaggaaggcttccatttgtggataagtgtgattggacaaaggccaggatctgcaggtaatacagtggaggaaacttagcaggacctgattgttcagattcttctatgttcccctcctctgggaatagggagggcacctctcaaatgatggttttatggtgtatttcaggggaaggttagaaaatcctttctaaattttatgacctgctttggggaaagaagggtgggaaggtgagagtgacctgctgctactgctgttttctcagatcccaacaggccgtgttttagggtagtatgtcctgaagcacatcgcttatagaaacaaataaaaaaattgtttgctttgtgatgctgtcctgatctgtggatcttaattgctattactctgagattttcttaaagcatataattctttttaaatgctttatgccagccaaagttagaagagaatcctaaacttatccttaaagtgcaggattatcatggtttttgtagtgcagcattatctggttggaaaactaggtcagaaagacccttaccaggttgagttcctccaagcaatttcaaagtccatctggaggccgggcatggtggtggctcatgcctgtaatctcagcattttgggaggccgacacgggtgggtcacctgagatcaggagttcgagaccaacctggccaacatgacgaaaccctgtctctactaaaatataaaaatcagctgggcatggtggcgggcgcctgtagtcccagctacttgggaggctaaggcgggaaaatcacttgaacctgggaggcggaggttgcagtgagccatgattgtgccactgcactccagcctgggagacagagcgagactctgtctcaaaaaaaaaaaaaaaaaaaaaaagttcatctggaggcagcaccgtgcaagttgtgcctttgaccattttcccaattggtgattctaccagtgagagagaaattcacatcttgtatttttgtgtgtgtggcctgagtaagagtgccaaggcagcctgcattcttaactgatccattaactttcttcctccacagatcgtttccttaacaatgctccctgattagaagaaatgtctcctctcctcccagttactcagtgaacagcgctctctcccaaggggccacatgaaagggaaacccaggcaccacctccgggcaggattagcagcctgggaggagccactttctgttctttgtgaaagctagagctgctctgctcttgagaacagccatttacaaaatggggcgaaaacgacggccacaccctccatcactctttttctcctggtgctttccagagcctttggagacctgtgccgggggtggggcttggagctcccgtgccgatggttaaaggtaccatggctgggccagtgcggaccccagtgctgttccccactactcctctgcctctctccacttcccagttccttcctggtcaggagcccggcagccccaaagactggtaatagcctggcctgtaccagatgccctgttacttccccaggggtctcctccttcccacacttcatgatgcccagtttctgttctgttttctttccaggaacgtgtccctacctggaatccccaggggggcttccatgttccattagagaacttcacattcaaccctcgttttctgttttaaccaatcttgccagtaagtggtgagatccttcagggtaggacccaggtcttactcttcagtaaactcctagtttcaggtgttgaaatttggcagtcagtcaggcgttgttgaaatgaccagtaattgtttctgtactgtaggtaataaagctgcggaaattattctcttcctgaaacctgaagacttcagaaatgtgaggaagccaggcctcaagtgccctcctctttcagatgttaggataagaggttgagaagttgttgtaattgaatgaactgtataagcacaatgtcatgaacttctaatttcctcttgctgaagatcatgacactgtttgcccattgtatgtatgtatgtatgtatgtatgtatgtatgtatgtatgtatttagagacggactctggccccatcacccaggctggagtgcaatggcgcaatctcggctcactgcaacctccgcctcccgggttgaagtgattctcttgcctcagcctactgcgtagctgggattacaggcacacgccaccacgcccggctaattttttgtatatttagtagagatggagtttcactctgttggctaggctggtctcaaactcctgacctcatgatccgcctacctcggcctcccaaagtgctgggattacaggtgtgagccactgcacccagcctgtttgcccattattaagcagtaaaaggacaaccagtttttttttttgttttttgtttgtttgtttgttggttttttagttagacttcacagaccatgaaattcactcttttaaggggtacatttcattgacttttagtatgttccaagagttatgcagctatcactacaattaattttaggacattttcattcccccaaaggaaactctgtacccttagcttctgtacccctcatcctcccaatccctcagcccaggcagccactaatctgctttctgtctctggctttgcccgttcctgggcacttcatatacatggtgtcatacaacatgtgatctttcgtgtctggcttctttcacttagcataatgttttcaaagttcatgttgtggaatatatcagcatttcatttttaattgccaaataatattccattgtatggatatgccacgttttgtttattgattcatcagttgacggacattcaagttgcttctatttttttggctactttgaataatgctgccgtgaacattcatgcacaggtttttgtgtggatgtaagttttcatttcaggtatgtacctaagagtggaagtgctgggtcatgtattagctctatggttagccttttgaggaactgccagacggttctccaaagtgactgctcagtttttcattcccaccaacagtgtatgagggttccagtttctccatatacttgtcagcacttgctattgtctgtgtttctgtttatagtcggtgtgaagtaatatttgattgtgggttggatttgcaattccctgaatgactaatgatgttgagcatcttttcatgtgcttatggccatttgtatatcttctttggagaaatgtctaccccacccatttgcccactgttaagtgggctatttgtttttttattgttgagttgtaatagttctttatacattctggatcctcgacctttactcttaaaatgatgtgcaaatattttctcccattttgtgagttttcttttcactttcttgatagtgtcttttgaaggacttctttttaaaataaaactaaagactgatcactcattttatttcaccttttagtgagtattcattccaaatgacggtcaagaagatactatttttttttttttactttttatttgggaataattttaaacttataggaaggttgcaagaataagaatagcacaaagctcatatatcccctttacccagatctttttttttttttttttttttttttttgagacagagtctcgctctgttgcccaggctggagtgcagtggtgcaatctcggctcactgcaagctctgcctcccgggttcatgccattctcctgcctcagcctcctgagtagctggtactacaggtgcccgccaccatgcccggctaattttttatatttttagtagagacggggtttcaccatgttagccaggatggtctcgatctcctgaccttgtgatccacccacctcggcctcccagagtgctgggattacaggcatgagccaccgcgcccagtctcctttacccagatctaactcttaatttgttgctccatttggtttctatttccgtttcttcctccccttcccctccgccatcccccccgcacaaatagacaatttttttctgaaccacttgaaggtaagatatatatcataaccttttatgtctaagtaattcactgagtatttccgaggaataagggtaatgtctttcataaccacagtacagctaccaattgcaataaatttttcactgatgtgatgcctttatctaatcagctcttcagattccaggtgacaaaatgtcctttacggcattacttttcccctccagtataggatcttgtctagtgtcgggtgttgcatctgagtgaaaaaattaatgtctataagggtatttcctaaacatgtgattaataatcatactaaagtgtattatgcattacagctttcaaagtgttttcttgtttctttattattaaatatatttatttttcctcatagcaaatacttagaatagtgcttaggttagcatagtaactaatacttagattggttcgtgcatcagaatttctagcaggtctcatctgacccatctgccctttaggattcctcacatggagaagaggcttccatgtcctgagcacttccctagagaagagggggtgaaggagatagggatggaccagtctacctgttgagaaagagacagagaagtgggtctcagtatccgaggttcctgggttgacctgcagacatcacagggccaggtcctttccttcctagcagtgctatttgtcaagacccctgtctgtctcccctgacagaaacattgcggtggtgggggttgtgggggtgcatccagcatgaattctccttatcgttttgactcttcctgttcccgcctggctctcattgaacccacttaatcttcttcctgatgagttggcccaggcaggcccagctttccctttaacaatttgtcatcttatacatcaccagattccaaactctctcaattctagcaattctgctttaggataagaaaaaagcgtgtattacttttgcaaacaggtgcaaagtaaattggtaatcgtactgaagtacattatgcattgcagttttttaaagcattttcttgtttattgtagttatctggcctcataacacacacttgaggtagatgtggcacatgtgatctccattttgtccacagaggaactgtggtttaggaggtggcccctcaccaaagctcacacctgtcttctctgattttgcatcttatgctatttccacagggctgtgcttcctaatcagtttgttaataaaactcagtattgtgcatttggtaggaattggtttatacaccattcaagaatagtaaacatttacaccctagatttttaatgatctgagacagcaccgaagtatataaaaaagttaggctcctgagcacttaattcttcaaggaaggggatggaggaaaatctctatctgcagagataatagcagcttaagggtatcttaaatgggatgcttctcaggactcttggagacttagagctagtggtgtttaataaccacagtttacatcactcagagtcatggaatagttctattgcataaacagagcattttatggaaacttagaaaccctcactgctgcaggacaaatgctgtacaaaatcgaagatgccaattgtctagattattttcccctaacaattttgtatgaaaaatttcaaacatacagaaaagtgaagatcattgtacagtgaacagctttattcccacctcttccactcccacctgtactctcaccacccccctacccccacatctagattatgcagttgtaacatttttctacgttagttttttgggtttttttgagacggagtctcactctgtcacccaggctagagtacagtggggtggtctcggcacactgcaacctccgcctccagggttcaagtgattctcctgcttcagcctcccaagtagctggaactacaggcgcccgccaccacaccctgataatttttgcatttttagtagagacagggtttcaccatgttgaccaggctggtctcaaactcctgacctcaagtaatcctcctgcttcggcctccaaaagtgctgggattacaggcgtgagccaccacgcctggcctctacattagttttatcacataaatccaggctatttttgatatactttgttaataaaatcattaagcatctttgatgttttggatggaaggcaccctacagtctcttggtggctgagtttccttttatttttcagaatccctttgaaccccggcaacatgggacagagctgagagcaagggccttgattctcatactcaagcctcccgacagcccgctgcatgcgccaggcttcacgttgtactcgtttgtccagataccatgaaaaccctggtcgggtgtggtggctcacgcctgtaatcccagcactttgggaggccgaggcgggcggatcacgaggtcaggagatcaagaccatcctggctaacacagtgaaaccccgtctctagtaaaaatacaaaaaaattagctgggcatggtggccggtgcctgtagtcccagctactcggggggctgaggcaggagaatggcatgaacctgggaagtggagcttgcagtgagccaagatcgcgccactgcactccagcctgggagacagagtgagagtctatctcaaaaaaaaaagaaaaaagaagaaaaccttgataaatattagtatggggatacattgtcccctcccccctttttctctcagttaaaaatctgtcccagaatgaggtttggcgggacatatggtttggcgtgcttgtgggggctggcagggtgaggtatgtatggtagtgtagttatctggcatcttatctgctcactggaaatgttgggcactgaatagattagtcagagtttccagaaatagaaaataaagccatataataaatgcagaagtcccctagttaatgtcagctgttgtgtgatatctgccctaagtcattttattgcctttgtaagattcttaaactgtttatcattatccctgccttttttaaaaatggaagcaacatcttcctaaagaggttgttatgagacattagaaggcctgctttcatgcctaatagttatcaaaactgaaattcagtatagcagtgttgaaggtgaaagaaggtttgggtacttttaggtagcaagagagataattataagctttcaacccaaggtcaagataaatataaatctggaggaggaaaaaaaaaaaagaagtctagcttctcattagtaggacagcgttctcattttataagaccttaatacccaataggaaatggccgtcaattctgttcatttcatattctcacagcctgtctctcaggtgggagaacacagctaattcttagggtaagtgtcctcttttagaataaaaccttaccaaaggagagctgaaatgggttgtcccccaaggctgggagatgtgtttggttccctttgcctcacttcgacctttctgaaatcaagaaacaaacaaaatgaaatcgacttgtgaaaggatgtcaaaacgacatggcaaattcagttggtttgttcagaattttcttcctgtatttcctttttgaagttacaacagtcattcaggagcacgtccagaggagaagagctgggagggaggacgggtggcttctagagtcaaggctgggtttgcctaaccctgaccctcacgggggtgatgcggatgttccgaagaatgcattagcctttgactttaaggaccgcgaggagagttttcttccgaatcaagtgaatgcgggtgcatcaccctgtcttcctcattccctgtgtcagggaatgcatcggtagcctaaatgactttccctggaactgaagcatgtgttggctctactgtggtgctttaatgtttcctgaaatcctccatttggaggatagagtgcccaggagtgagagaatactgtgttattagaatgcttgttaagagggaaaaagaaaatagagcattaacagacaggcaatgttccattcccccgaggaagatttatgtgacctagatgaacggaactacaaatcttggagggacaagagacttcagaaatggcaagttcttagtttgggaggctaggtattgaagtttatccaaattaatttggaagtttagatcagttgcaatcaaaatccttatttgattgacagtggggatggataaaatggagtttggatttgaaaatctacataggaggaggaagtaatagtatatctattttattatacgtgtgtgtgtgtataactataacaattagaatatcataacactgttaatagaccataaagtgacaaactaccccaaaacaaatcccattttcacataaaaatttaatatatgataaaaaagccttcacaaatcaaaggggaatgaaaggcaagattattcatcagatagttaggtcttcatcttacaccggaataaattcaattgaactgaagagttaaatatgtattacaaaaaaaaaagccagcagaaaaatcaatagatcatatcaatcactcctctagaaatggacattatgaaaagtagatgtcagtatggaaaaatacttttactaccaagtgatataaaatgtggattgaagaaaaaaggtgaaatgactggcatgctttattgccagttggtttagggggtcaggtgtagatatttttgttacttgttttccaagatctgtgatgtggttggagtaattcaagagaaatgtatttataatatgcatgctttaaggtacgtctattcctacttttaaaagtggcagatttgtgttttttaatgcataaattagttgaatgttcatccatccaaagagggatttcttctgatagattggggtgattagctgaaagactcagttcctggagaagagaacactagtggaaaatgcccaactgttaggggaatgaggaacaacagtgctgttcactgcattcctaacgccggcttatcagagttttgttttctgtttcatacacttaggaaagtattgttgccacaaagtgcatctctgcctgttagaaggatccagacatagcgtagacggattgtgcaatggagtcagaaataggctgtcctgctcccagtgagtgacttccccaccccttcatcctccttgtaaatcaccggcattcctgatcactttccgtggttccagctaggttaacaacagaagggatcatttccctcataacagtctccccattagtcaaaagttttactctcaagtgactaaaacgttactcataactgcttacaaggagaaaagatttattttccttttacttctttaatgcacatctggtggagaccctgataagcagtaagaaatggaaaaagcagggacctagaaagtgaaagtagacagatttgggtagtgcatgcaggctaattaatgatcccaggtgggctggagtgttctggttacattttccatgggtccagccctagagcagagaccatgggcatcagcctgccccttcccattatgtggctcaagcaccaccgtgtgccaaagggcgggaacattagatttccccaccgctgtaacatctgtaaattccacagtccatagaatcaaaatggaagagaacctcacgtttctgattgccagtcagaaggaatttatttttgaaacccagtttgctctgttatttgtagtgcaagatagaaatatcttaaccgattttatccagttcttatttaatgtctgtgattttaggaggaagagactattgtgtcataggtatttgaaattcacaagcccctctccaacctaattttaccgaaatgtgttggtttcccctttccttaaactcacggaccacagttactaaatagtttccagagtggactgacatgcatttttctttacagctctgtcattactttctttattatcagagagtacacaggatattgaaataacctaaaatccagagaggaggaggagccaggggggtgaagagaagtcctgacctattttagagcccttgggcttcataggtaaccttgaaaatggaaacacatcattgcccattttattgaggttgtgattagcagtaaaatataatgcagactaattattatgttgcagccaattagcaataaagagaagcattttaatatacaaataattagattttaaaattttggctttgggaatttacaaagccctctatttgaaggcttgtacggaagacattctgaaaccaactttttgtcagataaagtccataaagctgaaaactgacatgaggaggtatggccgggttttcctgcgtctcacagtgcagttaggaggctttgatacttcatgggcccttctgcaaactttccttagtattaggaaatgaagtcttccaagtcagtcaagttgtaaacatgcaaaaatgctgggagtggcagtctctccaaacaaatgacccgttctcactgcggttttctcctggtgctagaacctgtaactcctgagttgattctctccaattggccagagaaatgggcgttgctgctggagcagatgaaaaggctattaaggcttcctgaagcacttagattaactagcttttttttttctcttggagcaaaaagttggaacaagttttttgttttttttttttttactttttggacatatgacaaatgtgtataaagttgtgtgttgtgcctgaggagctggtgaatggagttgctcttttgagagttgcttttatatcattgctagctgtgaggtacgtggtgggcatgaagagaaccagtgtcagtccctctgcagaagcagaggctgtgagctccactgtgagctgccaaggcccatactgctgggggatctttaatgcatggcgcaaggctcctgtgccccaatcccggaggagcggtgacagtccagggaagagaggggaccacgtgagtgttacatgttcttgatcacatttttctctattggaaaggaggatgttgaaagttaatcatgtggtttttctagtcacttaagtccttaacacactggatatacatagttcaaatacaaggaaattaacctggtttcaaatgtcttttcctcattttatggcacatggagtatagagcatattcaaaaccctcccatcccccactttgtagacaacacatctactcagaaggttttaacttaactttctgtattctggtgatgtccacgaggttttgaggccttttttttttttttttttttttttttttttttttgagagagagacagggtcttgctctgttgcccaggctggagcacggtgttgctgtcatagctcacttgcagcctctacctctagggttcaaacaatcctcctgcttcagcctcctggttaggtgggaccataggtgtgcaccactatgcctggctaatgttttttatgttttgaagagacagggtctcaccatgttgcccaggctggtcttgaactcctgggctcaagcaatcctcctgcctcggtctcccgagtagcttggactacagtgctcaataccacaccccactaatgttgcctttttttccttttttttttttttttgtagagatgagatcatattatgttgcccaggcccctctcaaactcctggcctcaagcgatcttcccaccttggcctcccaaaatgctgatattacaggcatgagccactgtgcccagtcacattttttatctgttaaaaaaaaacaaaaaccaagtttggatgttatgatgttagtagtgtgtctggttctgaagttacaggataggagatagagaaaaattgtgacctgcccaaagtctcaaagctaattctaaataactaaagttgtagaatcttttgtttggaggaccatcttaaaggtgtgatctgtactcagccatttgtctgatgtgtaaatcctcagtctgtagcttcccggccacgtggtcaccaaggctgtgcttgaacatccctgagacgcctttcaaggagcaccgttctgtctttgggcagctctaattgttaaaaaaaaaaaaaaaaaaaaaagtcttccttacgttaggctgaagtctgttccccatgtagttgttccccttggggccatgtaatacaagtctacttcctcttacaaaagacagcccttcaaatgttggacaacagcagtattcccggccctcctggctcccctcccctcatccactaccaaggaagcatggctgtgagtttgttcatcatcctttgaatgtgctccaactcatgcacagcccctttaaaaggaggtgtgcagaacctgattctcccagtggagcttaatcagtacctgtcatccccattttcccagtgacagatttttattgagacagccaacacttggattggtgttgcctttgacgaatttcaggttactgcaaagtgaatccaaataccaactattttcaaataaaagaaaggagaggcaagacttagcagcagcaggctttttacagtccttcaggtttcaattgtgggaccttacacgtggtgctattgcagctccaattttgtttttttcttttaacccatcatttcagcttgttaaactttggagattcatattctgtcattgagagttgtccttccttcctttgctgcttcagaggacttagtgatgcctttattagagcttttactacattgcattatggctctttatgtctttcctcctgagttctgctaggatcataatcatgtctcatcatattcctcttctctcttcaacactgacagctcatagtaagtgcttaatacattttcattgaatgaatgagtcaaaagtatttgctcttccaaattctgcttattgatagtttattaataattatatattattcatgctgtttcaatatttatcgtacttatttgaatatatacatttatatttatataaagtaataaatgtgggtattttattaataaataagttacttattaagtacattgaagaggacaatggctagatgctgttttgcagcccactagaaactttcccctgggccaggcgcagtggctcatgcctataatcccagcacttagggaggccaaggcagacggatcacttgcggtcaggagtttgagacccgcctgggcaacatggtaaaaccccatctctactaaaaatacaaaaattagccgggcatggtggcatgtaccagtaattccagctacttgggagggtgaggcaagagaattgcttgaacctaggaggtggaagttgcagtgagctgagatcgcaccaccacactccagcctgggtgacagagcgagaccctgtctcaaaaattaaaaaaaataaaaaaaaaaaagaaacttttccctgggatgactgttgatctgttctttgacattctttttaagataaggtttattttatcaggaatttccctaattttatagtcagttctgttacaacgctacatacagtttccttaaaatcaccatgctgttcacagtggtacaaatgaagccataagacttatgggagaaatgggattagggaccaaaaatttatcactgacagaaaaaaaaaaaacaggaacccagtaaaaacagtaacttagttttacacatgctaaatggttaagaaataaataggccgggcgcggtggcttacgcctgtaattccagcactttgggaggctgaggcaggcggatcatctgaggtcaggagtttgagaccagcttgaccaacatggagaaaccccatctctactaaaaatacaaaattatccgggcgtggtggcacatgcctgtaatcccagctacttaggagactgaggcaggagaattgcttgaacccgggaggcggaggttgaggtgagccaagatcgtgtcattgcactccagcctgagcaacaagagtgaaactctatctcaaaaaaaaaaaagaaagaaaaaaaaaagaaatgctacaataaatatggcatctaccttgtaaaaagcctgaagtttgctcatgggagctgacatgaggagggttggagccggtggttatagtggcgtggtggaaggaggattatctgaacttggaaagaaggttgtaacagcagatctgaatgtgctacactcgtagcacacacagtcagctgaggaaggcaagggatgcttgaggctgtatggttaatgtattcctgtgggctccagaatgcggctcagttttctccattcaccttgtactttttgcagacaaaattgcacctaagcaaacgttacattcacattagaataaactcacatttcaaagcaagtgtcgcagcagctcctgtttctttgttgtgttatttgcttgatcagtaaagcatcttttttgttcttatagtaattccaggcactggtatataaggatacataaattatactacccactcactctctaaaactcttgttcttaaagattggcttatttttgctaggaggaatgaaagtacatgttaaagagacatacttggctgatctagccattttccaaagtctccccccgccagaggaatatctcataagtctggttcctaattacatttagcagatttctctaaaatctaaaagctggagtttgaatggttcttacttttcagctagtatctaaaaggtgattcacttaggagcagcatagaggagaaacttgtatttcacctatcaagtttctgatttaaaagtgaaatttcagccaggcacggtggcacacacctgtaatctcagcactttgggaggcgaaggtgagtggatcacctgaggtcaggagttcaagaccagcctgaccaacatggagaaaccccatctctactaaaaatacaaaattagcctggcgtggtggcgcgtgcctgtaatcccagctactcaggagggtgaggcaggagaatagcttgaacccgggaggcagaggttgcagtgagccgagatcgcgcccttgcactccagcctgggcaacaggagcgaaactccatctcaaaaagtggaatttcacctcatatcatttacatgtgtgtgatttgatgatggctttaactgaaaatagactaatgccaatagaatcggagactcttagaactggaaaggaccacagatatcaggaagcccaaacttctctctttttcagatgaagaaaccaaggctctgcgaagtggagtgttacatgcacagtcacttagctagtggtaaagccagaacttgaatccagttaattttgaaactataatatgttgccttgcaaaattgtatcatagaaggacataaaatctgtgcatttaggaggaaatctaaactcatattatttcagctttttagtctgtttagtaagggagtttcaccaattcagttactactgataataagcttccccttgttttatttttgtttctttaagaaatctgggccggacactgtggcacacacctgtaatcccagcactttgggaggctgaggtgggcggatcacatgaggccaggagttcaagaccaacatggccaacacgatgaaaccccatctctaccaagaaatacaaaaattagccgggcgtggtgacacgcacctgtagtccaaactacttgggaggctgaggcaggagaaccacttgaacttgggaggcagaggttgcagtgagccgagattgcgccactgtactccagcctggctgacagagggagactctgtctcaaaaaaaaaaaaaaaaaaaaaaaaactagtatgacacaaactcaccaaagtggctattcctcagactctgtgctttataaattcacgtttgttagggcagacagaaaattctgtttctttgtacccaaaaagatttaagcatttgtcgtgcattgatctggggttttgagggggaaacatccttggttatgtctgtgggatttgtggtgccttctggaggattaagatgtcattgcctctagtcagggcatgctctcttttccagttggtgggtcttattttgtttacatctgcttcctcccagcactgacagatttgaaatgtgtgcctgaagtgcacctttgtgccaggcccatagttttgactggggccctcatgacccattggccatggtcactttgcctgggagcaatcatcatttctagggtataggaacttgaagcaaagaatttgctgcattttcaaaaagcaggaaggggtggttaaagtgtggatggaggggtaatctccccccacccccgccccagcccctgttttgtaagagaggctatccaactcatgtatttccagccccgagtgttggcaaaaacattttcatattgttctcacttttctgactgagtccaaaaagttcctgggaaacaggttttgtttttcctcgggggatgtttggatttgaaaacaccaaatttcaactgcaatcgtttgtccaagtgtggtgttgaaagtactgtctagatctgagtaaatcagaatctgaagaaatatagccaacgtcactcattaacaatgggttttccaagggtgagtgacatgaggccatttgtctgcggtgaggtagatgcgctcctcttttcagtggccccctgaggccaccaatgtcacgggcaagcacatcctcggtttggggccattagctgaatgccctctgtttcatcttgccttttctaggccgccctctcctgtctttaaggtcagggtttcagaatgtccttcagttctgctttagtcaggactaaaagccttccacagtgccttgacgaggaggacatataaggaagaggcacaattcaagtaaagtcagtctgtattgattttgtgaacccggggaacagtaagccagccttcagtgccgcctggctgccgggcgcatgccgttgtcagaccgatgagcgaggctccatgcagacaggtgacatattcgaggtggcaagagcagcaagagcttctagatcctgtcattttgcttctgacagtgtctttgtgtctttgtacagttggaggacctgactgacacgtgagccccccttggcagccatcatcttcagaatactgctttcctcccacgggaggagcttgtacctctctcatgtgtacagggtgcttatgtgctcatgagcaggcaaaggagcaggggacggtttcttccagatcacccttccaggtgctctggagttgatgtggcctggccaccttttcatcatcgcccctccagttccattgcagtgatgcattgcaggctctcctcaggaaaatggtgatttcagtattatattaataattagcaatttttttttttgcagttttaaaaaattgactcttaccctctgcatttgagaaaagtccttattatacgtttctgtattgtatcatctcccagtttgatgtgtatgtatcccgattgtatttcactatcattacggagatttttattgtgtcaagacaaaaccctgtttctgtctccccagccccatgtactttgagcttagtcattcgggcatcatttcttccagcattcactgctcctcagtgtttcatttccatttaatttttctatttagtttttagcagttctcgttggctaattttaaaaagatttgtactttgatttgcttataatgagtgttttaagttacctgctgactgcgcagttgtttgactttgtatcaggtttccggatttaaagccagtgttctgttgaaaatttaaatactatagaaggctgaaaatatgaatcctctgacagctcctcataacaattcccagggtagcagctgtttatattttcttatttttttctttctatgcacataaaagtgtgtttgtcctcataaagagtgttgactgctatagacggagcgtgcagaccacaggcgtatacctggaggcttctcccacctttgattattaacactgctcgcctttaacattatttgcttttgattgctctttttgttatacaaaaataaccaagctattagaatcttttatgatttaaaatagaacattagttttattgtatattgaaaatagttccttaaacttcataatggcttccaattatttcacacttgcttgcgttatatactattattttattgcagtatgatgtccaattatggaaacaactccagagagacatgatttttctggcttaacatgtaattgtttattgagtatttttctcattatgatttttttccttttgaattgcagttataaaggaacttgcttagattttgtaaattattatgtggttaaagaaatcaacgatttatcaagtgctcactctgtggaaggcatcgtgtgcagaatcgaagtaaaggcaaagattgaaagaaatcattcctcaaaaaagttgtgtgtattaaaatatgaagagcagtaaggttttttgttgttgttgttgttattttgagacagagtctcactctgtcactcaggctggagtgcggtggcacaatctcagctcgctgccacttccgcctcccggttcaagcgattctcctgcctcagcctcctgagtagctgggattacaggtggctgccaccaggctgggctgatttttgtattttcagtagagacggggtttcaccatgttggtcagactgatctcgaactccggacctcaggtgatccgcccacctcggcctcccaaagtgctgggattacaggagtgagccaccacacctggcgtaggattaagttttattgtcattcaaatatgaacatatttaatcttgtataataaaatataatttattctataagaaacataatgtgttgcttgctaataccaaggacattaagtgtagactagaagttcatcagagcagatggctagcaggggctgtgagactggataggggttaaccgtgaggctgaaagatgggattcgaaagtgcacctgtgtgggaaaggggagagcgcaggatcttggcgcactggacggtggctgaaggagagggagaggggggcaggccttgatgaggagttgggagggattctgtctgtgatgagaagccactggagagctttaaaccagcttttgtgaacacggggagtagcagtgttgttataagtagtgattattgtcagcatgatcgatttacattttaagagctcactcagggtgctggcggacagtggattctgtaaccattattttgttttaaatagcgtcacataagcaataatttacccatgaaccaccagttaatattgggggaatgaaaacaatggatgctgtgattctgagcttagatgatggggacaggacagagtgggagtggaagggggtgggtgtgattttcgtcctgttgagctggaggtaatggtaggacagccaggtagacaaggccctcaggcaacaaggccatttaggttaatttgtgtagctgcttcttgaagaagaaacaaatgaaggccgtattaccttctgccttcttttttgaaagcatctctgaagataaagttcaggtgattgcaggaaagtagaagtcattctgacatgcatttccgaagcatcaacttggttgtctgagagcatttcccttccaggattataattgtgagtggtaagcagcactagtgtattggtgacttactccagctgtatccaaggacaggtaaaacttcccactgtctctttctagaggctactttgtagcatttcagatgtgaaaggtgactccagcagagagctcatctatttattatttatttttgagacggagtctcactctgtcgcccaggctagaatgcaatggcgcaatctcagctcactgcggcctccacctcccaggtacaagtgattttgctgcctcagcctcctcagtagctgggattacaggagcccaccaccacacctggctatgttttgttttgtttttgtttttgtttttgtttttgttttgtagtagagatggggtttcgctgtattggccagctggtcttgaactcttgacctcaggtgatccgcccgcctcagcctccccaagtgctgggattacaggcgtgagccactgcgcccagcccagcgagctcatttctttattttattttattttattttatttatttttgtttttgagacagagtctcgctctgtcgcccaggctggagtgcagtggcgcgatctcggctcactgcaagctccgccttctgggttcacgccattgtcctgcctcagcgtccccagtagctgggactataggcacctgccaccacgcccagccaatttttttttttttttttttttagtagagatggggtttcaccatgttagcaaggatggtctcaatctcctgacctcgtgatccgcccgtctcagcctcccaaagtgctaggattacaggcatgagccaccgcgcctggcccagagagctcatttctaacaagctattatcaccatcctcactgctttctaaaccttataggtatgtagcttcaaagtttatatttgaacgtttttcctttattgatgacaaattaaggataatgaaatgaagtaatggcaagcgatgaaataatggcaaaagattttattttcctacaaagtatttattacatggatgttttatagaaaatcaatgtaaaggttgatagacttgtcctttaaaaaagatacatttcttcaaatatagggaacagcagaatgctccctgtcaccccctttgtaaaaacctctttcagctttgcagccatcatggctggggataagtagatttatttcttctgttcctaaagattattatagatgaaaatcatttggtgtggagattcttcatttacagctacgtaggatgtagcacttatcaaaatttctgcaaatcaaggagaatagtgttcatgaacctaccagtgagatattttaaaagaccgcgttctggaaaagtgaaggaggataaagaagcagtgttcttctgagggtgctaccaacatttgggactctcagaggccctgtagcccagtccccattccactccatgggtaacacctcatggttctttcatgggtgttcagcattctcttgaatgcttcccctaaaggcagtttgttctcctgtgaggcagcctagtccatttcacttgaaaattttcttctgcaatatgcattgtttggtcctggttctgtccatgatgccatttccaatcaatctgcttcctcttcagtgtgagaagcatcaggtccttgaaggtgctcacagttgtacttggggcaaggctctggaactcccttttctgcatggtccagtgaatctgcatagagccggactgggaacagtgcctcaaacaggagctccctgttgctggctttcgtgaatatgttgtttttgggggtagctcctaatctggtgaacatcaccactgcctcccaccaccgcatcctgtccaacctacatgtcggtagaggacccaccctaggaaggaatgaaggaaagaatttctaaggttgggtcttgggaagcagagacagagaaggatccgcagccttatggacagcctccctcagcagtggggcttgctgaggctctttaaccctcccagcagtgctgtagaacagctctgtgcaaacttgaatgtgcatggggcagggctgggcggcacggggaggggggtccgcgaatgtaccgtcctaacaagctcctggatgatgctagggttgctgggccgtggaccacactgggaatagtgaggctgtagcatacatcgaagtcatagtgtgagctggtagattgtttgggaccagaaagatcaaaacttacttagaaaaaaatgtcaaagtcctcttttccctgctcctcctcctctaacttaaagaattaagggctgtgtgatagccagaaagctactttcatggattcattttagcagcatctctggtgctcacgcataagctagtcagggagattgcagggggttggcagcacccaggtcccctgggccatagcaggttgtgtgaacagacttgaggagaagttttgtcttctgtcctcaggagtacaaacaggcatgtctgaatgctgacagagaagtcatcgccaaaggatagtagatattacccaaggcaaagcctgcttctcagtgaactgttgcctatgggacaagaatgatactgggaaaacagtgattgcttttaggatatttgataaagctctaaaggaatagaagagcttccacctacactacactccaagtgacagctgtgtgaacttggtggaaaacttgactgaggtcgctgagactgctggtggaaattaatcaccctcctgctctgcagtgatattggcaaaagatgagcttagggccagagtggtccacatgcctgggtgtctgtggtccctcccctgcagaacagaatgaaacagtcactgccataagatatcacagacacttctttctactagggtaacttggagcctttctttggctacctggaccctgatgagagggtaatctggaggaataggaagtgggcacagggatagtgcatggtacaggtgactcgggtgcggagagtatgtgtgtgtagggccagagctaagaaaaagcctaggataaactcgacagatggaaagtcttttttttttttaaacagggtctcactctgttttccatgctggagtgcagtggcattgattacagctcactgcagcctctacctcccaggctcaggtgttcctcccacctcagcctccacctcccaggctcaggtgttcctcccacctcaccctccacctcccaggctcaggtgttcctcccacctcagcctcctgagtagctgggactacaggcacacgccaccatgcccggataacttttgtatttttttgtagagacagggttttgccatgttgcctaggctggtctcaaactcctgggctcaagtgatccgcccactttggcctcccaaagtgctgggattacaggcgtgagccaccacacccgtccaacagatggaaattcctactttgcctcttggcatgcatacccagcctcttttctaaatgggtctcagtgattgtccaatgtgtgccccaaatcagatgaaatacaatcatcagatgcaaagcaggaaggtggtagatgacggacagtatgtaagtcggtctttgctgctagtggctttacttcatccttgagaaaatcatctttggtaaagtcataagtgttgaaactcgaaactagggtttaccctagacccacccattggccaaccttaatgggcacactgactttttaagagtgtgaaagttattagctaaatgacttgttccatggccccattatatcacagacatgttgatgtctctgttatcaaaagacgtgcaaaacaccccaaaatcgttgatgacattaacaggtaaaatgacaggggcgcgttgcaacacagaatgtgtgcttcagatggtgaccagggctggattagcctcatggttatggcccatttggggtgtggacatcagcttctcggatgaaggtgttagggttagcagagggcagcggtaggaaggaaggtgtcagatctataatgcaccccatctgtgagcctcgcggctttgccttccacacaatatttagtaatgtaaatactggaagcagggctgcctgtatctttattttattcaacttaatgtgaaaagcaggatggttagatactgggaagactatctttttaatttttttacaccaaacatctaaaattattcctattcagtgccttggtctcacccttgggaaaatttccaaaataagctaacattttccccattgtcttcccgcctaaggaatgtgtgctgtggcttttaggtcaatgatagccttgtccttcaatttcatctttactcagagtaggcgtgctgtgtggtgcaaatccatacatgtttgtttgaaaatccttttagaaccttgccttgttaggacctcctacacctgtgtcacagacacagaagtaccgtgtttaagtattgagcatacactagttttttgtgacagaatctcactctgttgccaaggctggagtgcagtgggacgatctcggctcactgcaacctccgcctcctggggtcaagtgattctcctgcctcagcctcctgagtagctgggattgcaggcgcgtgacaccacaccacctaatttttgttttttttttttagtagagacagagtttcaccatgttggccagggtggtcttgaactctggacctcaagtgatccactggccttggcctcccaaagttctgggattacaggtataagctgccacgcctggcctgcatacactggttttaagggtggctgtgcttgggctgtgtatgtgcgtagtacacagtgtcatgtgagcacttagttaacagccaggcaggggtggacaggccaggacagctaagaatcgcggaaggagtctgggggtagcaggaaggctgcactgggaatggaaagcaagcaggagatgatcttatccagaggaagcagctaataaatattgaggctggcaggaggatacaagcaaacaaacaaaaagtggggccgtgtctttaaaagctttctccgaaaccaatatttggagttttcctgtgttcttggaagtgactggagattgcatccttcataccttatttctcctgtcaggtctctacatatcacatcacaggattcagctgatattggcctaagacccttggggtcggtgcagtgggaacgtgttatagatataaatgccttaccgttgataactcagaataagatataggatatcatcattaagtctgattatctaagcttatctgtgagccttacagaaaacaaaaacgaaagatcaggaccacaggttctttgactaccatttccctatttttttcatttgtcctgaacagggcctaacacaaagataggcacatgaggcagggtagtacaaatgagtttttcccccgtatgaagtgacaatcacatggattatatgtgaccttgacattgttgagtttctaaagactttttaaggatgccatacccacccccaatagatcacaacctatttctctcattctaatgttggtcatttgattacatagtcctttgtggctctgtttgcttgagactgcaaaataaacaaaatgtttgcaagtccaggttgaccctaaaagctcttcattctgtaggccaaagccatgattcagagaacctgtggtctccacagtcaagattgtggttgatacaccccccttgaaggcagatgttttggttttaaggcatcaggaatgtgggcatgtgcatcaggattgatgtgttttggtgtggggtttaggagcaataaacttgaaacaagtttaagtacactcaactgcggtgtgttgcttttcctttaatccctagcagattaacccctatcagggttaatctgctcaactagatgatagccaaactagcttctctgataacagcagcctctaatccactggactccacacagctctcccagtgggctgctggtgttttggcagatgcaatggctattttttcctatttaggattttgcttttaataggaaccctgaaggccctcagaggtttgtgatacagacttcagcccacagctcagcctcccagatggtaattaatgtttacacaacatgacaagcacaaaatagaatctcttcgagccctgccaagcacccatcattccccctgatcttccactcttgcagtgtttgaaaattaatttgccttgaacaaacagtgggttttcctcaatttatttgtacagtttcagtgaccaagaagaagagctgcaagactgaatgtcatccttccattcgttcaagtaattgaatcttctaatggaacaaactggtctctgcttaatgatttgaagaaaagagggagaggaggaaaataaagtgaagtgtatgttagagaaagtggacatttttctgcaaaacatcactgaatgtagaattttggagatacaatcaaaacttagcagggggaatttaaagtattgctaaattaactcagtagggcggttggggttttaatacgtatatacaatgtgcagtctttgcttaaaaagagattttgtttgaggcaacagaatagacaggtgaaggtaattaaataatgaacattggccgggcgtggtggctcacgcctgtaatccccgcactttgggaggccgaggcgggtggatcacgaggtcaggagatcgagaccatcctggctaacacggtgaaaccccgtctctattaaaaatacaaaaaaaaaaatcagccaggcgtggtggcgggtgcctgtagtcccagctactggggaggctgaggcaagagaatggcgtgaacccaggaagcggagcttacagtgagccgagatcgcgccgctgcactccagcctgggcgacagagcgagactctgtctcaaaatagaataaaataaaataaaataaaataaaataataatgaacattgattgggcagggtggctcacacctataatcccagcactttgagaggcctaggcgggaggattgcttgagcctacacgttaaagaccagcctgtgcaacatggtgagacctcatttctacaaaatataaacaattaaccagcatggtggcacatgcctcagcctcccagctacttggagactaaggtgggaggatcatttgagtccggggagtcaaggctgcagtctgctgtgattgcaccactgcatcccagcctgggcaacagagtgagactgtgtccaaaaaaataaaataaaatagacattgctaccagcttgaggtaattgcatgttgattcacagaaatttgatatttccatatgtctctgggattgccagtgtttaaacatttcagtcccttattaatgttcgcactttaaagtctgggttaattttcttatttgactgtgatctgtagtctttctgtgtggtgtgctctttgtggctttgtcatttggacagtaacgagagaagctaactggaagatggaataataaaaataggacatgtctctttctaagtcataaggattagatattcaaaaagatacggatgaatggatgatgcatggatggatggatgttctaggagctagtgccccccacatagttttcttgatgcctttggaagcttcttcaggtttgctgcggtaatgaccttgtagttagtaagtcctgttaggagacttcgtaacagaatatgaagatgtgaagaccagaagtgcagaagctgtactttgggagagttggttttttgtgtatttttgtttttgttttgtattcctcctcctccttcatcaatattcaccctttcctttctgtccaaataatacccagttagaaccagttagaaattctgaagaacaggtggaaggtttaatatgcaccatgttctgatgtgtgcctgtagtcccatctcctcaggagactgagtggggaggatcacttcaccatgtgagtttgaggctgcaatgggctatgatcactccagcgtgggcgacagagcaagacccttttaactttttttttttttaaacacatgcaccatatttttaaaaattaaaactatgcaccatacacagagtcaaatatttatctgtcctcttggtgaagagatttttaaaaaatctattcaatagtccaggcatggtggctcacgcctgtaatcccagcactttgggaggccgaggcgggggtggatcacttgaggtcaggagttcgagaccagcctggccaacatggtgaaaccccatctctactaaaaacacaaaaattagctgggcatgatggcaggcccctgtaatcccagctactcggaaggttgtcagaagaatcagttgaacctgggaggtgaggcagaggctgcagtgagccaagattatgccactgcactccaccctgggcgacagagtgagactccatctcaaaaaaaaaattcagtaggtaaggcaatttaaaaagacttgaacgatcactttctcagttggcttattttaatggtagaggtgtattgtccgcgaaaagagttaattttaaaatatagcatctctttttttactttaacaataataatactcttatttactttaataaaaatttaataagtatactttactaattacagtaaataatactattatttaataactatatataattatttgctgtgtttaataacaaagtgaacattgactttaatttttatattgtgcttaactttccaaattttctataatattcatttgttttgcacttttcctcctcctcctcctcaattttgaaagttaaaagcacaatatgagaattaaagtcaatgtttatttctggatgatgggactgcaattaatgtttatctttccagtctcttttctgtgcatacttgtatacatttacacacgtagttttcactattgagatcacactgataatagtgcactttatttaatggcaattttgtcatgagatattttctgtgacattaaatacttcttcacaatagttttgggaatattgattgattacttacttattatgtgttgtgcattgtggaaagcactttacatggcctaatttatttccacaaccaccctaggaggttgttactgcatttgtgcagtaagtcattggacttttagaagtgtaggagttcatcagagtataccgaatctcaaccctaccagacccagcataataataagaaatattttatagcgcattcattttttactttctggaatgaaatagatacttaatgtacccatctacatacataatttaaaagtatatataaagccctaataaaatataaaggagaaataagtggaaaccaagtcatttataataacatacctttaagtatgtaagtgcttgtttatattagaagacaatgtttgactttatatctagaatggtatctaaatacttctactacaaatgcagactcacacaaatacatggtcatggagattcagatacctggagcagccttaccattgtgtcatgattttcccaaatagccatcaacccttgcatatgacccagatataacaaagtacagtccctgcattcctggaaaaatcagcgtatattaaaacccatgcaaagaattactttgtgtttatatacaaaaacagaggtggtgggttctagggttttcagctgcacaaatgtcgggtggaatttaggaagtgcattgagatgttgtcgtgtggggttgctgcgcacgttgcagcaaatcagacatccctaagagccaccagtgacctgcagtcatagtgatagccacacactcccacaaatttccatctcttcccatagggagtagtatcctccaatgggaactatctattacgtgactgacttagttcgcgcttttttgcactgaaaaacactttgaaaaaagcaattttgtgggggaagccatttctgaaggtttacaagccctgtaattttcttgttaggttcattcccaggtgttatggtttttgttattatgaagtggatcctttctaaacttcattttctgactgttgctggtgtatagaaaagctgaggttggttgtggtttttctttatttggatatctcattgcactctcttattagttctaatattttctcagctggttgcctctgttttccagctaggtaattatattttttgtaaacagtttttcctctttcttttgttgtataatatttgctgttggttttcaatttagttgacaggaataatttgtttcttaaaggtttggccaacattgtctgtgaaacagataccttttgggaggggaggtgaaggtttggattattgagtactttttccttttattttgatgatcctgttgggtttttaagtcaattttagcaatttatattttttcataaaatccattttattttcaaatttattacacattcacagattacattttcttatttttttatgcatatatacacacacacacaccccagttccctgtctatccagttctcactcctcccaagcccctaaacaggtagtcactgctgttactgttttcttgagtattcttccatggcttctttttttttttttttttttttttttggaaacagggtcttgctctgtcactcaggcttgagcgtaagtagtgcagtctcagctcactgcaccctccgcccaagtagctgggatcacaggcagacaccaccacacctggctaatttttgtatttttagcagagatggagtttcaccatgttggccaggctggtgttgaacttctgacctgaagtgatccacctgcctcggcctcccaaagtgctaggattacaggcgtgagccgctgcgcccagccacacggcttctttgtacgtaaaataagatgaatatatatattatttccctccattttccacaaaagatagtaaatgctctacgttgtacattcggcattcttttttacagctgcaaggtgttccattgtgtggatctgcaaacatacgtaaccagtctcctaatggttacatttaggtggcttccaaacttggtattcaaaccatggtactatttcattgtgtctgtagactaaatccttaacacaccacaccaagggaactccatttgttattttgctaaacctccacagaggttgtagagtttgcattctactagtaaagtacaaaaaaagggcccattttccccaggcaacttgtatcaaacctatatcaaaatgaaaccaatttttcctaatctcttaaagtttgtttattgaggtacaatttacatgcaataaactcaccctttttaccgtaaagtacgcaatgtaatttgaatttgcatgtattttagtataagcatgatgaactatttttataatcacaagaagagagagttttaaaccccaaaatgtaatgaatacaacatttaaataagactactcaatttgtacattcttatgtctttcaaattcagcaactttcattctttcctttatcctttggcaaattcagagtatgcagtgcaataccaagcgatttcttaaaatgtgttgctgccaattttggagaagtacagtaagacaaattgactgtcaagatggaaaagcttaactgggaagatacatttattgaataattgaaaggaagaggaaatgcattaccgattagccacaaaaatgcctgacgcctgtgcctcaagagactcttgtaaatggggagtcataaaactgtttcagcccccgaagttcttaccagctcaaactcatcactgctttgtttataggttgcagtaccagagcaacgatggactgattgctttcagggctggctgaagtgcagtgttacagccactctttgtagctttactaaccctctacactttaagtctgatgtacttaaatattttaactgaatcctggatttatcattacctgctttgctttgagacttctgctttttaggaggcagcatagtatagattggagaaaaggcagttggtgttggcagagttgggactggaactcaagccttctggtttacaaaacaaggacgtgacttccagcaagcaagttccttcacttctctgggcatattccctatctggtcagagagtgttagattagatcctgctactcaaaatgtgatcctcacatcagcagcctcagccttacctagaagatcctcagaaaggcagaatctagagccgcatcccagagctgtggaatctggatggggattctaatcagatgttcaggtgatttgaacatgcattaaagttaaaggagtgccgtacagatttgcagggttccctggagaggttggggtcttcccttcatctctggtagcttgttggaggtggtgctgacggccacagccttggcaccactcctcatgttctagctgtggttaggttgagattgagacagtgaggcaacagaggagacaagaaagtcaactccagtggcctttccggggccttgggaagcgagcccacgcctgcaggatgccatctgcaagcttggctgtgttatccaaattcttgaggctcgttcaagaacaaggaggtaaacagagtcaagctagatatctgtagtacttccttatgtgtctctgatgtgcctccttaccagcataagtaagtgtgaatgatatactccaagtggtgtcctttggaaaaggaagctgattttgggagggaatttgaatgtatacttaccaagatagaaagtatttattgatgtcttcaccagcccagtctggagaaaacagagtaatacaaaaagatttttttttttttttgagacggagtctcacactgtcgcctaggctggagtgcagtggtgtgatctcagctcactgcaacctctgcctcccaggttcacgccattctcctgcctcagcctcccgagtagctgggactacaggcacccgccaccacgcccggctaattttttgtgtttttagtagaggcagggtttcaccgtgttagccaggatggtctcgatctcctgacctcgtgatccgcccgccttggcctcccaaagtgctgggattacaggcgtgagccaccgcacccggcctacaaaaagatttttaaaaagtgtttctgccattgtaccaagcataaaaatcctgaattagctgtcagtgtgagaagagtcctgctcatgtacctagaacttctcactgggtgaaacccctcctctgttttgtgctgttaggatttctgggctgttcttactttctgtcccagacctgactcaaaggcctggatcatgcatatgaagcacgtgatttttcaatgcctttgataatagcttgctgtgggaaaatcctgtgaaagaaaaatatgggaaattttgtgaagacacatggagagacacagagctggatccctaactgtgacatctctgaataaagggccttccttcctcattggatccaggagctttgctagctggatggggacctatccgcagcaagggcttggggtgcccctttagccctgaagttaggaacaaaggttttgagaagcctttcaatttcagctttatcctaagcaaaaatcttcccagaaaggttgataagacagcactggacagaaatgtcggaagtccagagttacttttcatcagcgctttgccaagtgctcggtcttttcatacctctgaagcatgtgaagaaggcagctttcttcccatctcgctggtgttattgttccaggctgtttggagagacctgaagatagccaagttctgttagccaaaaatttgctttgtttataaacccaagttttgtttttgcttttgtgcatgttatcggtttgatctgtgttaccaaaagaacattgaaaataatgaattgctttgatgagaattccaaggaataatggcaaacaagtgtgtatatacaacagtacgtaaacagaaatatgtaagccgggcacagtgcaggcacctctaatcctggctacccaggaggctgaggcaggaggatcacttgagcccaggagttggagctgtagtgtgctgtgattacacctgtgaatatccagtacagtccagcctaaacaacctggggagaccccacctctaaaacaaaaaacagaaaaccccagaaatacatagaaccaacaagaataccacatacttttcccgtttgatacaatgaggtaagaggagaaagttaacgcccagggcagttcatttaagaatgcctgaaaaacaccttcatttcaaaggatgttgtcatctattctttttctcttttgaaattgtgtagtaataaaaggatgcatcttttcagcacaaaaatatgggaaggataattttcccccagttgtatacaaaagtacttactcccaaatggggccattcttttctattgagtgccctactggtctttcgttattctgttttgagatttttatggagtttggcttatggggtaatcaagccattctactaaatgtggcccttttgacctttggagggagatcttttgacctttggagggagtacatcttttacatccatacaggagcagctattttctatatttctttcacgattgtagaatttcacttaaatttaatatccaaggttagtctcaatgtccagcacccctttaacttggttgagtggggaaccccatgtggtcccaggggactttcttaaaagctctagcaagtgtagttgatgggaaactttatttcagttcccgtttgcacctttgatctcagaagttgctgggatcaggtgacgggcattaagagacctgccttttcacttggaagttgagcacttgctgaacaaaaaattatctgtaaatgtcaagtgtgtccctttggtcaaaatggaaagtggggaggaagggaaggccaagaaaaaacatccgtgtgatgttaaataatgtttgactcatttcaatagaaaacacttctcttttgtatgttcaacaaatgtatttgttttaaaagggaaaaatcaacttgtcaactattgtttcttaattgtgatgccataaaagactttctggagattaaggaaaacattcattttcagaatgtagtctaggctgctgttttttctcatacagagacagagtctcgctacgttgcccagggtgctcttgaactcctgggctcaagcgatccttctacctcagcctcccgagtagcttggactgtagtacacaccaccacacctggctaatttttttttttgtagagtcagggtcttgctatgttgcccaggctggtctcgaactcctgggctcaagcaatccttccaactcggcctctcaaagtgttgagattacaggtgtgagcccctatgcctggcgctaggctactttcttgaatgcagtctcctctggccagttggcctttctctcccttcccacacccccagggtcattgctccccatggtcaaaggctgttcctgcatctttctctgtccaccattgaccccatttgctgtgggcgcatacccccgcaggtggtggagacaaggacccaagccaggagggttggtgccaggtcctgttgctggagttgtgtgatagccttggagtttcctttccctccttatgccacactcgcatgtcattgcctgtggttttgtctttgctctctcccatgcagatccggagttaggtgttggcacgctaccagaacatgacagccaggatgcagggccgattgtccccaagatatcgggtctagagagaagccaggagaagagccaggactgttgcaaagagccaatctttgagcctgtggtgcttaaagacccctgccctcaggtcgcacagccaataccccagccgcagacggagccccaactccgagctccttctccggaccctgacttggtgcagcgcacagaggccccacctcaacccccacctctgagtacacagccaccacagggccctcctgaggcccagctccagcctgccccgcagcctcaggtgcagaggccacccaggccacagtcccccacccagctgctccatcagaacctcccacctgtgcaggcccacccctctgctcagagcctctcccagccattgtcagcctacaacagcagtagcttaagcctcaacagtttaaggtgagtggcctgctcttctttggcctgacttttgccctctccctggggatcaggtgggtgggagtcggggagggatccctagggagactgaggtttccttgttggaaacatcatccttttctctgagactagagacagggaatggggctgttgggtgagactcgggtctcttgggaaaggacaggttgggatgggtgggtggtgaggacattgtaaagaagtaaaatatttatgggcactcgagagtggaggcggaaggagaggaaggcttggaaagccctgggccagggagacccagcagcagtgggaggcagggagtcgaagcctggggcatatcagaggccatgcagtgtgagcagatcctttcaagagaggctctctgcctctgatggaagaagtgttaaagaaaactcgtctccctgcagctccaaaggcaggaagattgggacctgatgagtattccagcttaaggattttttttttcattctgatttacttcctcctatgtgggtcagagaagtagggaagaaacaaaacaagctgcatttagagaaagtgagaaatttctttatggaaatccaggctctctcctctgtcttgtttttgccaagttacaaagaagcgtctaaaaagcagcacagaggaacacagcaaagaaaagagaggcagaaacccagtgtgcagcgccaagtagagccgagccctggtgccccgggggctataattctaacccggcacagctcctgaggctgtgtgtctttgttactgtttttcttttgaaaacctggtggctttggtggttccgggccttgctttttcctaagaggggaaagcacagtctttggggggcaggtttcctccttccccaaggagccgggcccggcttctgccccctcggccgtttctgtggcctccagaccataaagtgatgtgagaacccaggcacctgggtttcacctcttctttgtgtgtcttcatttaagaggtaacaagacagatggggggaactcagatcatcgctttttttattcctttttgttaaccgttgctttataggagatgtagctagtggaggatggaaggctggggattttctaggggcattgatgagaatctggccacaggagcgagagaggccctgaggtttaggcagaatgagctgtctcgacaccaagatgccccacagccctgaagcagcagtttcggtttgctctgtctgcagtagcgatgggaaagtttgcaggagttgtgatttcagaaagtgtgctcgtacagggaggatctgtaaagaggaaggggcaagagagactgtggtgagggtttaggggaaggaggtaggattcttttaaagagaatacattgcttacctttttttatttttttcttttcttttttttcttgttccgatagcagcagcagaagcagcactccagcgaagactcagcccgccccacctcacatctcccaccacccctctgcctccccgttccccctctccctgcccaaccacagccccctgcacagcttcacacccaccctccagccccccgcacactcacatcaccccaatatgtttgcccctcccactgctctgcctcctccaccaccactgacatcaggaagtctgcaggtggccggacacccggccgggagcacttactcaggtaggacggaggggcctgtgctcgtgaccccgacccccaccgcccctcgctgtgacctcaccctacctatgttgtcccgattgcaaggttgcatttgcctacaattttttccttccttactgtgatcttcctcaaacgctctctggcctgaggtccagcaaaaatacctgtcagcacccatactaagctagctcagcccctgtgaatcagacactgcccgaagagagtgggtttgtttggagttaggaggcatttccagctaaattcagccactgagtggtcagacccaggtagtgtgtcccgtgtcgtctgggctcccctgagggcgatggaagcgtccccaagcccatgtctgtctcgctccaggatcttagattgtgtcctggtttaaggggtttcttttcattgggcagggcagggccttctcctgtctccttgggaggagatgacacactctttgtgacaatatatcccagaattttaagggcagatctcatgttagacacagggtccttgtctcctcacctgtgttaatcaggtcaagcgtcccagttttggtccagtgtagccatgttatgccgccaatacagagagccatatagcagtaattgacacttgaagaggacatgcgagccctgccgtgtgaacagctgacatttattagtgtgctatcactgttcccaagcacttaaacgtgcaaattgctttaaccctcaaaaatcaaacccatgagttaggcaatattattgtccccctcttggagatgggaaaactggccctcagatgggttatttgccatgcccagggtcactcagccagtggtgacagctggaaatcggactttggcatttggcctggagtttgttccccagattgatagactgcctgtccctgaaagctgggagaccagctagagaacagggagacagggtgcgaccgggccttggtctcgtctgcttcattgattgcccccgtttatctcagggcccagccacaccctgtcacccctgccactgtgtcaccagccccgtacccctccacaggaaggcagtccgatgtccttttctgaaggaaaaggcgtcatcgtctccctcttcttctcttccagagcaagacatcttgcgacaggaactgaacactcgttttttggcctctcagagtgctgaccgcggggcttccctgggccctccgccctacctgcggaccgagttccatcagcaccagcaccagcaccagcacacccaccagcacacgcaccagcacaccttcacgccgttcccccacgccatcccacccaccgccatcatgccgacgccagcacctcccatggtgcgtaccccaggcagaaatgtgaggataagtagagcacgactcttttctttatgcagcacgtgggaccgggctgggcagcggggccaccagagatcgaatggggactgacggctgttggctggagagaagggaatgtgtcctagtgccctgcctcaggcagctctgacttcaggggcctaaagtaggaacttctttctaggcagttgtatccagcactgcgggcggaaatgattccatctgccctcaaaacagtcatgtccagtgttgatggctaacttcttaaagggttgtttagttttcttgaacttcccgggggactgtcaccaggcagaaaatgcacctgcttgtgctttgcatcaagtgctagcacatacattcttgcagggtaatgggggtgaagaagagagaagagaagggagagagacctctgccaggaggctgggactgcattgggtgccacctgtgcattccgatggcttccctaaacccactttgttggaggtgttatatttcttgtgtttcataagacagtccctaatctggtattgtgctctgtcagccagtgttcagggatccccgcagggacagaacgctctgccttggggcaagaggaaccactggccatgacatggtcttgctttaactgggggctagcacatgtccagaaccagtgaggaatttttttttaagttaataacgataattcatagtgccatattagaatgctaaatattctcagatagagtcctgtctaacagtgagtattagagtcattttttacttatttaatttttaatatttcaggaaatactggattttaaggccattactataggcattgtgagaataaattgcatgattttaaaaggagtccacttcacccaactttgcttcctctccttcctctccctccccccatcttgtttaacttactttttaaaaatgtgtttttaaagtttgttttataaatttcatttcaaggaatattagcaatgaggccttgtgaccagaaatatgttcttaatagcaaatcctgtatctcttttttggatgaattatacttaacaattagattttgaagatcctaagattttgagaaagttttctgctggcctgtgtgagctgtttcacaaataaatttaaccaaaggtagttatagcatcaatatgatgacattatttagagggaacaatagtatactctttttctgttccaatgaaaggctgtctggcctaccccagatcactttgtatttgggtataatacatttcagaagacagctgcatggcaagacagtttttctgccaaagtgaagatgaaaatagggggaattcactgggtaaatcagaccaaatgctcacctctctctgatttatctggataattggctgttctctcctgtttagaggtttggttcgtgccaatctgtagaaagaaaatagtaggaagaaaggcatcctagtacgtgcagaactaaaacgtaccacttggtttttaattttgttcttccatttctgttggcttcttgtcagggagactcaggagctcagaatggtttcatatgtaatgaggttatggggtctcatgacagcttaatgacagggaagctttgtagggccacctccactgtagcagtgaacaaaaatgcagattaagtaactagcttttgctttgatccctttacagtttgacaaataccctacaaaagttgacccattctaccggcacagtgtgagtttcattaccatgctacacattgaatgtaactgctttgccatttttgtgctcttgccacagatcagtcaatgactagcagccttccttaatcatctttgcaagagttcccattgctcctcgccactttggatgcttgcttttgtggtgttttgcttttggtaaagatgcagtatcatcttctgaatcaaaagatcataagcattccaaaggcttgaaagcagagttgctctttagtggcagtcaggcatctgtcctgcaaagtgagatgtctgcaatggagtcagtagagttccaggagagtctgaaatcacagcatttcagtcgtcagttgaaatgccactaacacagaagttctggaatgcaacctgaattatttcctcttaaatagaaagtcccttgtctttttgactcatgactcttcaacaagtagattttcatttgctctagactaaatgtagaaccttcttccacatggctggtattgttctgttgagtttgttacaatagaaagtaaaaatatcacttaattaaaagaaactcccaaaattgaaatgagtgatattttctctttaaactcattctcctttatttaaaaaaaataaaaaaaacttgttttatgccattttaagagtatgttctggaacttcaattgataacaccctaagttataggttcagttaacttgtaagacaagagcttatttttattcaaagaccttgaatatttccatgatattttgatgatggggtgaatactgcatcatttttatctgaaaatttgcaagtttctttgccagtgatttcttttttttttttttttaatgaaaccagaaaaaagagaaggttaatcatgcttgtagccgtgttgattcaccatactcaactgttcttgcttaggtttgtagatagtgttatcatttgagaagtgctactttaatagatcagcaaagactgaattcattcatattctgaaccagataattagataccatgttagtcaagaggttagctgagaagtcaaggctagaaaatattagaaatcaattgaaaattatgtactctaggggcatttagaaataacgtaagatgaaagacctcttcaaaaagaagttagaaaagtgtatttgagtgatgcctcctccccctccctcccaacatggtccccgctgttctgctcagtaccagaatacaaaaacatatttcacggggacacccaaagcccagtagacctatgggtttcctctttgggtctggcccatggatgccaccattctgcccttagtctatactctgctgatttaaagtaaggaccagctaacaaaataattcaggctgggtgcagtggctcatgcctgtaatcccagcactttgggaggccgaggcaggcggatcacaaggtcaggagacggagaccatcctggctaacacggtgaaaccccgtctctactaaaaatacaaaacattagccgggcgtggtggcgggcacctgtagtcccagctactcgggaggctgaggcaggagaatggcgtgaacccgggaggcggagcttgcagtgatctgagacggctccactgcactcctgcctgggcgactgagcaagactccatttcaaaaaataataataattaatatagaaagttgagcacccaaaaagtggctcagatttactttctaggacccactgcggtgccttctgatacgcatattctacagtcctaggccaaagatggagaataagcctggaggcctgaatttttggaaggtgtatgtattattacttaggcgcttcaggtttttagtcagggggaggaatagtcagctatatttatattctaagaggtcaatgatggaataaagcaaaaagaaagtggtaagaacatccagtttttaaattgtaaacattaaagggaaaagcccacctggaggcagaatactagaaatttgagtgtgtttcactggggcatgtatttaattactcagctttattcagtgtactgtgggagagttatttcatattaggagttatagtggataatatatgaagtactcagtctcccctgctttggggattaggacattataaggggaattaagatgcaatgcactcaagtatctaaaacacaattttagacttaaaagtagttttaaatgagggcacttggcttgcaatcactgtttaagtggatttagttcaatatcaattagtctgaaaaactttgctgcatcattgaagggagcaaaatgaaataaagaccaacagaaaaaggacgtgctctgaacacgggattgcgaaatgtgaatttcagtcattaccaaaaataactaacacaaatactttattaagacgagcttcaattattgttgtaattttgacataataaaccaccacgaaggtggggcattatttaaaatatttgtatggtggcttgataaatggaaacaaaccaataggacctcaaaaagattaaatttttagaaggagggaaagttgtgtttgcattgtcttcagattctctgtatttttttcctcaattgtgtccttttataggctgttgattcaggaaaattcatagtcttcattcagaatcattcttttaccatcatagagtggactcctacgtgaagggcttggcttgagtatcctccaaagagcttgttcatttaatagcagataccattcagaagtggccataaaaactcagacttcatatgttaatacggaagtgctttgagtacctgagacttaaacaagagcaactgaaagctcgatagtgatattccagactcgggttatttctgtgcaactagaatccatcttctagacaaattggcagctccatttaaagtatacatcgagtcgttttattttaccctttcacaaatatttgtcattattttagatgagagaattaaattgtcctctggaactgccacttctgcaacaacctaatgaagcaaggattgtgaatatactctcatttcctcaaactattaaaagtctgaaagtactaattgagttttaatggtataaaatcctggcactcatgaagacttctttttcttccccctttttttttcttttttctgtctttttccccctctaattaacttgtaattttctgggcatcttatttggctcaggatccctcctgtttttgaaatgcattaaaatctccaatcatttaggacttctatctgatttaacaattaataattagaaaagctccctttctaatgatgccctcacccgggatgtcatttgctggctgattgatcctgaactacttttaactttttaagttacacattcgtggcacgtctgtgtgatcattccatcatggcttcttgactaatggcatcaaactgagattacgtggcttgctcatgtcgatgtctttctatgggacgggaatttgaatatgtcacttgcctcctactaaaatcttttttccccctctccgtctttggccacagctcttccattcctatcctcctgcagtgtcgggcatcccccctatgatcccacccactggcccttttggttcactacaaggagcatttcagccgaaggtaagaaacctcacagtgaaaacacacaggcatgtgtctaagtggcgtcccgggccaggcgtgcaggaagttctgcgtcctcttgcctgtgcagtgactcattaatcaggtcctaagtgaccactgggattagagtgagcctatttttcttttttttccaagtccatctagttttaaatggccgtgaaaatttacttttcaaactgtactacccagataatctcagttaagctaagatttcttgtgctcttcaaaatatacacaatatttatttttttactaccaatatcgtggacataacttctggtcaggaattctatgaaatatcagacacatgtgcgccaggttgttccgcaggtgtatgtaattagtaaagacacaaagctgggtccttactgattttagtagaagtggggataaaggttccacaactaaaattgtatcctatgaattctcattctccctcatttccctcgccaaccccatcggctgcaaacagggcctgccggcaggtggggtggtcgcctcccattttggtcctcctttctttctccctctctctcagccatcccacccctgccatggttacactggccaaggccaagactttgtcatcagttactaacatcctagtgtgaaattaacctttcatcctttataaaaatcaaattctgttctacctagtcagtgataatgccgtccagcgttggctacagctgtctctaaaggtcaatattgaagagtcattctcgaaacactctctttttaaatatacttacaatttctattttaccttcacacaaaaataaaaagagccgtactttcatgtgggtaaccattctcagacttgaagatattctgctgtgtgccattgggttttcgtttttcttttccccaccatctcatggctaaggtaaaacacagttttggtccagagtcttccaggataagcacataactgcatttccaaagacgtgtttcattaaaagaattaaaaggcattagaggtggggtcccctcccccttcaaaatcacctgcattgaattgcattgaattcagttcatctattgaatttgcctgcattgaattgcagcctatatgcaaggttacagatatacagggcttttatgactgcctcgttaaacacctcctgtctggagataaaatgatggtgattttaaactccttcccccagtctgcacctcactactccctcagaccctggtctgtcccctctaggttacaccaaatctctggggcctccccaaacagactggtaggtcatttaataaattagactatttccctcgctcacaattatccaatcacacagaaaactacatctgggcaagaaagtgtctctcctggtgttgaaataggcctttccaggccatcgtcctgattgaatatgtagattgcagttcattagtggagttcttcatatgtatgcaaatcaggttgttaacaactccagcttaattgttagttgtactgcagctgattgcttttctttctttcattcttttcccccccttctccttgtaggcaagcttcgggcctaaacttgagctccttttccccacgagtttaacttcctggtgtggggggtgttcatagaagttgtgatttcttccataaaatagctggtgtcgtgtcctgaatcctttcccactagaaatagtgattgtgcccaaagtaggctttttattgttgctaattcaaaggacagaagctcacagataaggttaatattagcaatatttgagaatggtggtgggaataggtaagagcaagcagaattgctttagaaatcatcaaagagcagatccgcaaggtccctaaattaggttctcttgtcccatttccaccactgctaatgagtaattactgagtataattccttattattgtctaccagttaaaacggagagcttaatgtctgtaaagtacttccagttattctgatgagaaacacctgatactgccaattataataatgttcacttaagcgtttcttggaatgtttggtgattaagcaaaaaaacagtggcagtccctgccatgggttcattcagaggaagaggagttccaggacagcatttacgtttgttgcttctcttttttggtcctgtgctttttattgcagtgaaatgttctggggacctctctctgcttttacatgccattgctggagagagcaagctgtggtcaggcccccttgagaaagagcatgtgtggtccctgagaaaaatgaatcttgcgtttcagaaggaaacaaacaaatgaagtttggcttctctcatttagcagaagggaaggatcttgctttcatgtcacctgttttgtgcttcctaagtaagctgtggtctaattaatttgtagacatccaaccctatcgatgtcgctgctcggcctgggacagtcccacacactttactccaaaaggacccgagggtacgtgcaaagtcaggcttggtctcaggtaacaccagggtgtgtgtgtttgcacgggacggccagcccagtgctcgcatcttccttagctcctttgagcgagctgctgtttcagctgttcttctagtttgtggaagaaaatgccaattactcttagaaaacacagtctctcctgctcactgcgagcataggacacaaagagaccgacttgccgatgggagaaaagaggaatgagttacggtctgagcccagaaattggacagtgtcagcttgtatagtttttacttaaccaatcttctctgtctgtatctccttaaattgtcttacacaaatgaagtagctacagaatgttttgaatggaaaagcactaaggcgcttttcttcctggaagtcaggctacacacatccccccgcttgcctggggtcaggaagttattgtactgcacggctctttggccctctatttttaatgtgctagggatccttttgtactctagagctaaataaaatatccattatgctttggttatgttgtttattcataatttattaccactgcctgcttccaaaaaaggaatctgaagttatacgatagatacaatcttgcctcattgttatttgtagtcatctttatacgaaatatgaaaaaatctttaacaatattgtctttttacctacataagggcagtcagaaattgataaccagagttagatagaagtttaaaatgactcaactatgtaagtatgtcatgatgtatagtgaacttctggaaaatgtctaatagctataaataatgtaaagtcatcaatgtaagggtattggtaaagagagcctaattctcctggatggatggaaaggacacctctccccagataccagttagtagacagctttaaaagccaggggtctgaaggccattctccctcagacctacccggtgtggtttggagctcaaaacagtgaaactcctggtgtgtgatgtgagcaaatcatgttgccagagggcacattgctattgattaaacttgtacaggggcttgtcagcgtagatgtaccaaggcttgtgaagtgggggaggggacacttggcacttttgatagtgtgaaaatgggttaattattctctaaaagggcttcatttaaaagtaaaattctaacattttaatttcccctcctaatgaagcactacaaatttgttaattagagcaattgtttgagtgacaggcatgtaaccaagttgtcattttctcttcacagttgacagatcctttcagacctatgttaagggtaagaaagcttcttatagaactgttttgcaacctctatttgactccctgtgggttaaaaatacaagtctattacaaggaaataagccatagaaatgttggaataagacattggaatgacggtgattgggtttttcagatagtgtgattgaaaatggcctaaactgttttgctttgaccgttggaggccattggctttttttttttatctctacaacagagaaaagtcaacgagtccgatctcttgttagcagttctggtaaaaggtttgactagttggaacttaaggggaaagactgaagctataggctgaagttagtctctcttgcacttagaaaatatgtagctgggtccatttattttggctggtggctccctctttctgtagtaagtgacattgacttgccatagccgtttgacctccttttaaggtgcaggaaggaggtactataagcatctggtttgttaacatcttgcttaaagcaaattgttctcgaggtctggagactggccagtgtgatgacctctaaatgaatcctggtggttgggggtaagacagacatgatgaattgttggacagaagatggatggacagcagatttcttgctatgcataactcatttctagggcacataatcagataatttgatttctccaggggaaaaaggagaattgtgtcatcacttaggtgaggcagtatattatttgtgatttcaaactacccataatttcattgcaagagaagagaactgacccagacttgcatttaagtatatattttcggaactaactccatactgtagaaaccagaagcttctgttcttcgccgatgtagaatgaggctgtgttttcttctcatctgtccagtagtcactgagcgcgcacgccgagcttatgggtagattacttagcagaaatgaagtgaaaaggtggtccctgcccgctgactggtagaagagaatacactcacagcactccactccttataaagcaagacatgaaataattggggagatgtggattcaaattcaaccccagagggtggaggatggacttgagatctgcagaggcctagatagagaacaggaaggaaggaatattcttctctttgtttctttctttaaacttaggaacagcgcccaccaacacgaatgggtagttgactcttagcatttacggtaactgggcttcaatcaaaatgtgaatttctttgtaccactttgggggttaaaataaaaaccaccacggtcttgggggaggttaggacaggttctgtaccctctcttattttgatttgactcacagacattcactaatgagctcttctgaacagctgatttgcattatagcatggcaacatttgttaagtagggcttcccactctaccaggtctgccagctggcagcagaaaagaaagagaagaggcacagagtgggattcaggcttttgccgtcttgtccttggtaaccggggaggcccttgtcaatgtggttttctgagtagcaaacccacgtggggagagagggggagctggctgtgactcccttatgactgggcgctggagagctactgatggaaggcacttggagagtacaaagcactcttgtttcacgaaaaaagcctctgcagccaaaatctgctgaaagctttggggaaattgaaggtggttttctctgaaatgtcttcctcctaaccacgttgctctttcttgttccagaaaccagggaagtggtgtgctatgcatgttcacatcgcctggcagatttaccaccaccaacagaaagtcaaggtcagtccgaccttcgtggtgtagggaagaatgggatgcacatgtgagtgtgtgacgtgctcgggagaacctgatgaaggaggcatttaaaacacattttacagacccatagttaggaaggatcaagcctctcttggaaaagctactcagaagtcttacttattttttcctagagtcagggtctcactctgttgcccaggctggagtacaaggggacaatcatagctcaccacagccttgaattcctgggctcatgtgatcctcccacctcagtctcccaagcagctgggactttaggcatataccaccatacttggctaatttcttgattgttgtttttgtagagatagataggggtctcactgtgttgcccaggctggtctcagactcctggccccaagcagttctcccacctgagcctcccaagtagctgggattacagtgcaagtcacagcagccagctcagaaatcttactgttaattagggaaaccactagtgaaattacaaaacaaaagcaaactgataatgccccagggttttgttccctttataattttgtcattttattgatccaaaggtcttgaatatggattaaatgctaaaataaagcttttggaaataaaattatagtgaccaagaattagaatacagaaaatactctgcatctgggaagagctacaaatgaatgttgggtttgggtttttgtaaaaatagtgactggtgcattcttttcattttatggctgtgggaaaatggtagagtcatgtgtgccctatatgaagatgatgccgctgaactgtcattggtcctcctgatggtcagtgccagggattggaatacagtcagtacttgcaggagccacgttctggctagttacctcgctgtccaaagacgatttttcctttttgtctatattttcatcatagggatgaacatattccatgttctgctagagcctttatgactcagtaggggagagatcaagaacttctgcaagtccctggatacagcatcagcgcttggcttagggaacaaagtaactgacaagtctgtattttacagtctgggtatttataggctatgttacgatgcctgcaaaaatgggagcaaacaagcaatcaagtaactccaataagcttcacttaatccatttcttcatgaacaagcttttagtcctaacagcatttgggagttctcatgaaagaaatacaggagaccaatgagccaggagatagatagagctcttcatcacagaagagacatgtttttaaaagggttacgtgatttttaaaataaaacaacccaagttccagtcactctagaggctgaggcaggagaaccccttgagcctgggagtttgagtccagcctgggcaacatagcaagatctcatctctaaaaaaaaaaaaagagtaaaaaataaaaacccggttaaaagttttaagatgcaaacctcagtaaatgaggtcactaagatattttgctttggttgtcagatacctgctctttcttataacatgccatcagtgagtttggctcatttgtactttattgttaggggaagtttaattggaagccttgtggtctatcttagaaaatgtgtgtgctttgaagagctaactagattttgatgattagttcaattcagtttttgttctggttgatgtggttagtggaacggtaggtaaagcacatcttccttgtaacttctttggttaaaagagatgagggatgttgcacgtgccactttagcaacttctttcccataaaagtgtccccagtgacttaaactttcattatcccaattcaattagaaagacctcttgaacatgagataacttcgttcatcttcccttttcagcaaactgcttgtaatccccaagctccattttgcttcatggccctaagttgtggttaatggaactgtgctatgtaccatgcaatattagcactaaataatttggccaccaaattaaaggaggtattcaaaagaattttatagattcatagtgaattagaagcttggttttgaggcttggctattactcgatactgggactttcattatagcattccctgtagatttgagcagaaattacatcttccctctctctgtaacgttcatttacgcattcttttagtcgttcacccagtgtttattgaaagagcctacgcctgcaggttccttactgtggcgggctgggggcatgcatccttcctggcgtctagttgcttagagttcagtaatgaggatcagttgtgtgtaaaaagtgaggaaagtgtgtgtgccctcttaatgggtggtgtcatttccagctggaggtgcacgggtagcttttgctttcagtaggggtgatgggtgagtgggacgttgccgtcagcagtaagagaacagcagacttccctgtctcagatcctcacgccatgctctgtcaatatagatgccccctcatggggctttgctgttgtacagcagggcaaggatccctcaggacatgagggagattgagctgaggctagaatggggctaaaggggctgagagcatcagatgagtccgggagatcagaagagtagccaggcacgatggctcactcctctaatccaagcactttgggaagccaaggcaagcactttgggatcgcttgagcccaggagttcaagaccagcctgggcaacatagagagagagacctgtctctaccaaaatgaaaaaacattagctgggcatggtgacatggatctgtagtcccagctactcaggagactaaggcaagaggatgcagtgaactatgattgtgccactgcatttcagtctgggcaaaagagcgagaccctatctatctcatctctttaaaaaaaaaaaaaaagagtgaaagtcagaagcaggtactaagggcagtgaaaacccaggagactgatggggaagaggtcatagcaagggaaattcaactagaagcttcaagtcccaggaccccatgccttgggagcagtgcttatccaaggcagtgtgaagccagttcaaagagaaagctgtcaagaaacaaggaggtggggcagctttgaaaccatgctggtgcaagggcctccagcctagagaaggatgccaggggaaaagattgagaggaagattaagacccaatttctactgcctaagaggatggtaggcggaaagattagcctgaggatagataaataagacaaaacagagtgatttctgtccatgataaggacttcacacaagagtttgttttttttttttggagacagcctcggtcacagcaacctccgcctcctaggttcaagcaattctcgtgcctcagcctccccagtagctgggacgacaggcgtgcaccaccacgcctggctgatcttttgtattttagtagagacagggtttcaccatgttgcccaggctgcccttcaactcctgagctcaggcagtccgcccgccttggcctcccaaagcgctgggattatggtttacttgtctggatggacactgccctcccccaaccttcctcaggtaattacaggtagtaggaagagaaagggcctctgttagttaaattaatactcctactttgtttttctttgttattgttatataacagtgatcatttgaaagttagcttatagacatgcaaatatttcttcataacttttggttactaatgtactgtgagctattagagtatggcaaagagtcattaaacaaacaattaatttatacagcagattgttcatgcagaattcctaataaaatgagctttaagacactattattttaaaccttactaaaatgggcctttacagcaaaacactgaactactttgggagtggtggcagtctccataaataggatatggttttatttctcaagccattaaccttgaagaccaaacatagctgggtgcggtggctcacacctgtaatcctagcactttgggagaccgagatgggcggatcacttgaggtcaggagtttgagaccagcctggccaacatggtgaaaccccatatcgacaaaaaatacaaaaattaactgagcattctgggaggcacctgtaatcccagctacttgggaggctgaggcaggagaagcatttgaacccaggaggtggaggttgtagtgagccgagatcccaccactgcactccagcctggaaagcagagtgagggagactccgtcacaaaaaaaaaaaaaaaaaaaaccagaccaaacactagtgttgtcactagacatttctggtgtaacaggcactaccggcctgcagatctgacatttgagggtgaaatggtttttgtgtagctgctttctctcacagtgtttgtaaacttgaacccaagtgcaccgttcacagtctccagctccagctcttcactaacacctttattccttgctgttggccttgggacccttactgttccccttgctgtgtagaaacagatgcagtcagacccacataagctggactttggactgaaacctgagttcctgagccgccctccaggccccagtctttttggagccatccaccacccccatgacctggcacggccttcaactttgttctctgccgctggtgagtgtgggtttgggtggggggacagagctgagaaatgtagttctcaggtaactaaataaatgaggtttgggctctgagctgccgctcagtcaccacctacaaaaatacagttaatgccagcttgcaaggcaacatcgcagcacatccagggagttgggaatcttcattgatacactctctttcattaaaggaggaggcagagatcatctttcccttacagggattcacattgcttcggttcattatttgcttctatattaaaccagtataactcacaagcatgtcagttgctattgagaaagatctgaaggcttgcaagggcagatcggaaggaaacaatgccaggaattatagaaggatgcggtcgcccttaatacggtgcccgcagagcactgtaattttgcaccgggatgctcagtcatgccgtgttttaaagtcctgaggataaagaaaggcgattaaggcagttgccaggagtatggtctgtgatagggaggttgggccactcggttgctggttttctctgctacaaaacgtaatactattgcctggttggttatagcggtggaagaaatttaggaaacggtgtaaacacccaagtgacctgctcatcggatctgtaattcatttaacctctgagaatacacactgtcaagtgtgcgtgtggaaggggtgaggtagagagtgacgattatgctcattcctgctccaggtacaaacaaaagacagcggctgtaaggactgtgtgtgtgctggatgagaacagccctcttggtattaagggtttcttgtcattctgtcttctctaaagcttttttaagtgtaatttctggcacacagagctcagctcagttaacacttaaaaatgatggcactgagctcattctgctaataacttcatacccactatgctaagtagaatttattcttctggacgtaagcagtcaaggggctccccatttctgatccttacgagacaagtcttacagccatcctgccagctgccaccccaggcttttatccaagactcactgttggtggacctctggctcttctgttcaggaagagagaagcacccacactgcaagaaatcatcattataatgggccttagctaccaaagcaagtgcgtccccctggagggtagatggaatttgctaaggtctcaggtttttctctgtcagtgctgtctggggacatatttgaaggctctgttaccatggcacctaggctctgagacagggctacatgaagagcaatttttggaaagaatagatttctctctggcttccatttgagccaagtggatgaattggcttcttttgcttcaataattctggaactgcaaggcacccctgggggccctgggctcagcaaagctctggtcttcattgaagcattaattagcttgcactacacagacagtatgtggccaaaattttatttagctgacaacactgctaacggcctgatgaatattctggaatatattcacttggtggaggcggggtatcatttttacacttcccaggtggaaaataagccagtatgcagggctgaatagataactcctcaggtgtcttccaattccgaactactgtgacggggatgatgttcctcctgtactgagtggcttcctctccaaacccaggccacaagacttttgcagcccagggaacagcagtccaaaacataaatcgagttaacagagtgtagacagcaacaacccctacgtttaatccattttcctaagggaatttatatttgtttataggaacttagacaaaatgcaaaggattatggaacagtttttagtaaattctttatccaggccttgtttatacttccattctagaatgtaaccttctttagcataagcagtatgggattctgcccaaaatagttatttggtgaaccttgtaactgatgtgtataacttgtacatacttaagaaatccagccattttcatcttgctattgggtgctaatcccatgaatataaactagagacttcttcagatgaccctggcaaatctctcgtctaggacaaagcctgccttccaggaagctagcctccttagctagtaagtagcctcgtattaacaagcccatttggtgccctaaggcctttagaaatgtccttccctaattcacatttgcacactctctttctctgtctccttccttccttcctttcctggcttccttcaggaacaggaatagaggcatcttcaagaagtacacattaggcaaaatacagagaagaggaggaaatgtggatcaagggacaactgaaggaaaccactaaattagacctgagttccctggcaggcaaagcaaaaacctgtcagagtcagttataagattttcagtgccccaaaacataagaatcaaccagcttttcctggcattgaaagttgagagacatcagaggacttcatctcctaaaacctaattgagctcacaataatgagttttatagagtcgggtcttatagtatccttcgatgtgggtgcatgcgaactaacatactcttcaggagaagggattctgcaagtccccagagcagcgtagccaagaaccacagcttcaggaccacccctcctgagccagagatgataacgggctgggtttctggaagtgtttctcaaagtgaaaacttggtcctccgagatgctctatgaggagtggattccatgatgaaatgttcccctcttagagaacgaaggagcctataagcttattaataagcttattaatggctctaagaagcccttcagtaaagaaacttgcttagctttttttaatccagtatttctccaaatttacttggttataaagcctcccctcctcccatgacccagggcagttatctctgtctttgtaatactgtgtgtcatcggcttaaaaaagaaatacctgtttttggtggtggccagccacgctgggaaagagaaagagggatgattgattttctgcttcctaaaaaaaaaaaaaaaaaaaaaaaaaaaaaaacacacattttcttttaccctgtgtcttgcctgcaggggcctgggtggacttcagccatgacctcccttgaacatattttctcacggggcccttaagcaagtagaagccggttgcatcttcgaagttggctttttgtaaactctggtttcgttatgtttgacttaacaggtgctgcacacccaactgggaccccttttgggccacctcctcatcacagcaacttcctcaaccctgctgcccacctaggtgagtcgcccaaaataatgggaactgagatgtgtgcttcaggcaaccctgctgtgtttaccatgctcccgctgcacctccgggcaagctggtgggagtcccagataccctgcttaccatttaggcaggagatggtgctctcttaggagtttcagtacatcccgtccagcttccagatttcatctcttacaccgcattctttcggtagtagagctgtgctcggcagtggttctgcctgaacttcccatggtgcagtgggtgagagccattccttggtatctcagggaatccgagtttacaacagcctgttcctgcccattggaagaagatggtgagctcttgccccatagcaaaggtcacctctaggaagcggaaagaaacacaagctgacgttatggagaggagttattctacatctcactgccccgataaatgagtctcttcctaataaaggtgcatgctttgtgtggcctttgtgtattcgatcccatctgcaagtgtacaggcagattcaggcattggcttgcacaacatcagggcatatcataggcacgccctcagagtttcatcatggattcagatgccacctcctttctgttctgttagaatctgcagagtgcattcctggcagaggcgagactgggcgggaaggcaagttagtacatcctagcttgagtagtgtccccactgggcaaaggaagagtaatacaaaatacacagttgtagaagaagagtcctcagaaatattttgctaacccagtgcctaaatccaagtgtaatgaaaaccttttacaccatctggtaggaaaagtgggacaggccaggtgggggcgtagagagggcagggatcccgcatcgccctgctcccaggaagctctgggttcctctcccagcagagcccctgaccatttccttcttccccatcttgtttgcagagccttttaatcggccgtctacattcacaggcctagcagcagttggtggcaatgccttcgggggacttggaaatccttccgttagtgagtacctctaacttttaaaaatctgccttggactttttatctcctgtgatccgcatatggctcaagacctttctagagaaaaggaaactatgctctggggggaccagtgtaggttatatcactgcaaaagcaggccttcacagtggggtgaggtggaagtgtgcagagccaccactgtgagggcagccccctgtggctatccagttctgaggggcaggaacggcagtgtagttgatgaccacagaaagtttactcaagtgcggagtttcatccacatcccatctctgctctccaagattttggctgcagctcacattacaagtgaaagcaatagttacagcaattgttacatttcatcttgcccgtggcattcgtggaattgaaaaaagcacaatgaaaaatagcaggaagacaccaccaggctgcgacaccaccaggcttgggataatcaagatttggcaccattttattctccatcatctaggaggactctgcagctttctactattaaaaaagcccatctcgattaggagaagaattacaaccccatctcacgttctaaacattagtgtttagtcgctgaatatgcaaattattttctttcatgctacataccatatattccgggtacaggaagagctaaaacgtgtctctgagcataccgtcacaggtcggtctttatttaaaacacaggaaggagacctgtgtgtctggtgagggcaaggtcctgtctggtctctggtgacacttgagagggccacggtgggtagaggagacagtgacttctactgtgaatcaatttagaattgttaatccaaatcccaccatcataacacacccttctgcatgcctggaacttctgcatgcaccagatacgttgaattaggtcatctcagtacccatttggtcccttttcctttttaacttcccctgtccccacctttgcttttggttttaaaaagaaaaaaaaaagctgtgagctacctctccagtgtaggacaagacttcctctaatgaatttgttaatctcctttccttttccagctcccaataatatgtattcattttaactctgaatgctgttaaaagttttttggtaagtaccttcattacagcagattatataatttctcttaaacctttttgttctccacttcaccatttcagcacccaactcaatgttcggccacaaggatggccccagtgtgcagaactttagcaaccctcacgaaccctggaaccggctgcaccgaacgcctccgtcgttcccgacccctccgccctggctgaagccaggggagctggagcgcagcgcgtccgctgcagctcatgacagagatagagatgtagataaacgagactcatctgttagtaaagatgacaaagaaaggtacggaaagaaaccgctctcgagtccccacgggggagcctgctctatgccaagtaccagtggaactggccgcccaccctccctgtcccagcctcgtgctttagccgccccggtagcctcagctcctccccacagccagtgcccgcagcccctcgcagtccccatggcccatagcatatggtgaccgtaggagatagcagagctagcgacagattcctgtctcagtcgcagttatacatcagcacgtcccaagtccctgttagcgtgtccaaacagaagtctttctctagaagacagggagttggagcttcgggccagacacacacagcatgaatcaattccatatttgctttcaagtccgtgcagtccatttaaccatccataggtttttctcgctcttttcctctttttgttttcttttagaaagccatgtttgcattgcctcatcatatttttctcaaattttgttcaaactcaaagcctggggctcacagatgactaataaaattttactcacatagatgtagagaaacgtcgacaagcagttttggtttggttttggtttcactagtggataattttgttaaccgttgtctctgcacttggtaacccatgcctaaaaaaaaaagtagcgttaaacagggaatgtcttggagttttttttccaaagaatatcgtaacgcattcttgacaaaaatgtctttttttttttctttctttaggctatttattttcactttaaatgaactgataaggaatgcacaaatatgcttgacagaaaatacctaatcccaatttccttgcagtatttaagattcaaatttgatccgaatctttaatgtttcttttctttgtataccgtgtatgtatgtgtgtgtgtatatcctagtaatttcaaagaaagaattcaactttgcaggctctaaatggggcagattagtagatactcatcagaggccatcatgctgactgataaaagaaaaacaaattttccttcaaggcagtatgataacaatctcttaaccactgggaggaatgtttatgacattcatctctgagctgtgaactgccaaaatgaggcacgcctagcaacataacctggccgaccctaggccgcgagctctctgtacacagcctgtcactaggtgcaatgcaggatgtggccaccagccctttgcgtgtttttctggatggcgtcaaaatggcctcttggattaaagtcaggaagcttaataaataaaatatactcttcttccatccttcccttaaaagttattcttcttctctgcatgtgggcaagaaacagcccttataggggagcctcctgaatactctgtggtcctctgatccttgcacaccagcaccaagccagcatggcagcctgctgctctcctcaactttgccatatctgtcttggcaccatccgtaagacctgcctggtcttagttttaactcaagttttaccttattgtcattccatttgtttttgcattttctgcccaatactcttgagcccccatccaagacaggtctctaaaattcttgtctcgtgttttcactcacagctgctctctaaaattgttttcaatgtccccatgaggtttcgtgtttagggacctgcttttcctactgccttccctccgtcttctcatcagactttggctttcttatcccatctggtgcacaagtgctctttgcaacccaaaagtcctccaactgtggcttccttttgagcctttctcacgtgctgtgtcttggagatggctctgtatccacgttctttgctctgaaactggtcacttgtccttgtaaggagcaagagacttctgtgacactgatgttgaaccctttcttccactggttcagtgttgcaaagttggaagaaaagtgatactgggcgttgggctcttaaaacgtgattctttacactagatgatcccgggagtccagacagtcgggctggattgccacatcattgccttattgaccacatgcagccatcttggctttctggaagctcttcttctgtgctcttggttgaggctcttaacatgcagagagattcttgctcccagcagactccccctcaccctcatccctggtccatctcccccattaagcttcctctaaaatctaggtaagtaggataagggtggctggctctgccctgtccagggcacggctgctgccttggcgaccatgggaagcagcccccagcctgtcctcttcacaccaccatttcacccgcagcccctggcccggccgactcgcccctttcatttcatctgcgtccttgtcttcccctctctcccccagggaaagcgtcgagaagagacactccagccacccttcaccagcacctgtcctcccggtgaatgccctgggacatacccgcagctccactgaacagatccgggctcatctgaacactgaggctcgggagaaggacaaacccaaagagagggagagagaccactcggaatcccgcaaggacctggccgccgacgagcacaaggcgaaagagggccacctgcccgagaaggacgggcacggccacgaggggcgcgccgcgggcgaagaggccaagcagctggcccgggtgccgtctccctacgtgcggaccccggtggtggagagtgccaggcccaacagcacctcgagccgggaggccgagccgcgcaagggtgagccggcctacgagaaccccaagaagagctccgaggtcaaggtgaaggaggagcggaaggaagaccatgacctgcctccagaggccccgcagacccaccgggcctcggagccgccgcctcccaactcctcgtccagcgtgcacccggggcccctggcctcgatgcccatgacggtgggggtgacgggcattcaccccatgaacagcatcagcagcctggacaggactcgcatgatgacccccttcatgggcatcagccccctcccgggcggagagcgcttcccgtacccttctttccactgggaccccatccgggaccccttgagggatccttaccgagaacttgacattcaccggagagacccgctgggcagggacttcctgctaaggaacgacccgctccaccggctctcgactccccggctgtacgaagccgaccgctccttcagggaccgggagcctcacgactacagccaccaccaccaccaccaccaccacccgctgtctgtggaccctcggcgggagcacgagcggggaggccacctggacgagcgggagcgcttgcacatgctcagagaagactacgagcacacgcggctccactccgtgcaccccgcctccctcgacggacacctcccccaccccagcctcatcaccccgggactccccagcatgcactatccccgcatcagccccaccgcgggcaaccagaacggactcctcaacaagacccctccgacagcagcgctgagcgcacctcccccgctcatctccacgctggggggccgcccggtctctcccagaaggacgactcctctgtccgcagagataagggagaggcccccttcccacacgctgaaggatatcgaggcccgataagccgagaacaggagcaagaacgaggaagaagaaaccctaggcagacaccaggccaggcttgagagacagaactcctgcatggctcacacagactgggggggaaagccccaccccttccccttgtaaaaaatgtatagactcagtgcacattttgaaatgttttgtatattatatgttgagatttttcagatcttttagcccagtcatatgttctcacgtctcctactttttgtttctcgtataaaactttttgatttgaaccaaaacagtgaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagctttactttgtacaaatgtaaatagataaagtaacataatacattaatacttcttaaaatgtgctatttgcaaacttacttaatatcagtgaacacagtcggctaaagctgtgttcccatatattgttatagacagctaaacccttcaactatgcaatgaatgttcgggcttttcacaaaagcccgcctaactcaaaggagccttttcaaatccatttacagcatacttaaggtcatattttccctgaacaagcgcttacgtgatatgactctgttttccttgcttgttttttttcaaacggagaaacatcctgttttgcaaattggaccccaggctggaacttagcatctgaagttgccgcttgtgggctctgggggaaagtgtagccccggagaggtaactgaggacatgagcaaccagtgccagggagggtgggatttgccagatgccaaaatcaggggacgggtggtggtgtctgtcagacacacacaggtcgccagtgacttcacacacacctcatgtgagaaccatgccttttttagtgtgtcctatttcatacctgtacacacttcctcgttttgtaatgagatttacttacacccaaacagatcctgaaagaaagcttcaagttttctcagatgatggatatgttttcactgtattcaataactgacggatgtaaggtgcacgtttcctgatgtgacgcactgtattccagctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtatattaaagtgctatctgacgttgttatcctgtttttgcaaaaaaaaaaaaaaaaaaaagttaactacagaccattgtttctaataagcagagagatctattttagtagtaaactgaaggtttagttgtgagcttcagattttgtgaactccagatgttgtgcggtgtttttttttttttttaagacaacaactaaaaaaaatgcaaggaatatgtacactggaactgtagtggtagctttcagtattgtaaagagattgttctatacggacctttttgctgtttatcctgtatgtaataaagtcctttctagatcctatgtgaaaagaaaagtgaagcaactgaatcttcagcatgttctcatcggcggagccttcttgtgtaatgtaaactgtgccatgttattaaaaaatgtgaactaagcttccagctgcttgtttgtgtgaggtga
